United States Patent 11,913,074 (METHODS FOR ASSESSING RISK OF DEVELOPING A VIRAL DISEASE USING A GENETIC TEST) - sequence listing, part 2

SEQ ID NO: 55 - DNA, 64827 bp, Homo sapiens
  source 1..64827: mol_type = genomic DNA
gcacagtgtttttggtgatggttgtttttagcaaccttaactgtaaaaatttctcgtttaaaatcatgaattacgtgttaaggtttcaacgtatgaatttgtggagggggctgggcacaattcactgcatagcaaataactgtactttgagaataacgtatatttaaagtttaaattgtgaattttaaaaattcaatttgatcttttccaaacatttttaaagaacgatttgacagtcttaggtcctctaataaaaatcacttgcagtgaatttttaaaaaatggacaagtaatagttgtgtagacttttgcaatgttatgttttgatacatgcttacatggtagtgaaactgggcaagttcccttgttcctctcgggatgtgtgatggggctgatggctcactttagtgccctgctgctccaacttttaggagagaatacagacaggtaggctgtggggctccaacccttttgcagtgtctagggctgaatgtttacaactcctgaagctccactgggcatgtgttagagtgcttttttagtttagctatccataggtggcttgtgttaaccagttcaatcagacccctaccttatcgcaaggacagagggctttctgtatcctggggttcctgccttggtgtaccagaagaatcggatcacatgtgggcttggagaatgagtgcaaggtaagtctggcaacctgggctctccttcaactgcccccgtcaaactgcgttgttctgccggtggatggcctgcctgcatgccggtgcctgctggtgcatcccattcctctcaacttccagccgctcgtgtgttcctccactgatgtactcctctcgatatgcagccacctgtgtgtctgcctgctagcgtctcagggttttacaggcacagggtaggggcgtggcaggccagggtggtcttgagaagtgcaacattggggcaggaaaacaaaaatgcctgtcctcaactaggtccgtgggcacaggcccagggttggagccctagccagggaccacgcccttcccccccccgccatgttatttaaagagagcacacccttccatatcagtggaatggctaaaacaagctaattcccatacgcattacctcatctattttttttgtgatgagaatgtcagagtaggcggttagacgtgagcagggcatgcacgggcccccaagaatgttggacatttgtcaagccacagtcacaattataaatctgtccctctgaaataatgagcaagacaaggaagggaccccagagctgtctggttctcattgggaccgggattgaagggcataaaactatccctctagggtaataagtggccatggctggcgctgggaataacaggagtcttgcaacagacagaagacacctggagttagcaaggcagtcccagacaaggttttgagcatgtgcagtaatagaaaggtgtgaaatttacccggtgtatgactttcctctaggggcgctcgaccagtaagggagaattgcatctaatgggcatgcgcacaacttcagtaaccatccagcgcctactgggagggctactgggcatgcaatacttgagggccagcccgggaggtgaagaacaaagagtggagacagcctggaaaagagtaaggggtataaaaactgtaagcaggcctggggtggtggctcacgcctgtagttccagcactttgggaggctgaggcaggtggatcatgaagtcaggagatcaagaccatcctggtttacatggtgaaaccctgtctctactaaaaatacaaaaaatcagccaggcgtggtggcaagcacctgtagtcccagctactcgggaggctgaggcaggagaatcgcttgaaccctggagacaaaggttgcagtcagctgagattgtaccactgcactccagcctgggcaatagagcgagactccgtccaaaaaaaaaaaaaaatcaaagcggaagcagcacttgatttttgaagtctcctgcttgaccctcttccaagcctactttctccaatgaactttcacattgcttaaaataaatgttcccttgcctgtctctcatttgaattctttccttttaaaagtacaaagtgagaagtgacagcatgctggcagtcctcacagccctcggtcgctctgggtgcctcctctgcctgggctcccactttggcggcacttgaggagcccttcagcccgccgctgcactgttggagtccgtttctgggctggccacgcaaggccggagccggcttcctcagcttgcagggaggtgtgcagagagaggcgccagcgggaactggggctgtgcgcggcgcttgcgggccagctggagttccgggtgggcgtgggcttggcgggccccgcactcggagcagccggccggccatgccggcctcgggcaatgaggggtttagcacccgggccagtggctgcagagggtgtactgggttcccccatagtgccagcccaccagcgctgcgccctatttctcactgggccttagctgccttcccgcggggcaggacttgggacctgcagcccgccatgcccgagcctccctgatgaacaccaccccctactccatggctcccagtcccatcgaccacccaagggctgaagagtgtgggcgcatggcgtgggagtggcaggcagctccacctgcagccccagtacaggatccactgggtgaagccagctgggctcctgagtctggtggggaccatggagaacatttgtgtctggcccagcgattgtaaatacaccaatcggcactctgtatctagctcaaggtttgtaaacacaccaatcagcatcctgcatctagctcaaggtttagtgaatgcaccaattgacactctatatctagctactctggtggggccttggagaacctttatgtctagctcagggattgtaaacgcaccaatcagcgccctgtcaaaacagaccacttggttctaccaatcagcaggatgtgggtggggccagataaaagaataaaagcaggctgccggagcttgtagtggtaacccgttggggttttctgtgctgtgataaggtttgttcgtttgcatttggcgtctgcgttgcctttatgagctgtagcgctcactgcgaaaattgtcactttatttctgaagtgggtgagatgacgagcccggcaggaggaacgaaacactcatctgtgaaagttgcaacttcatttctgaagtaggtgagacgactctgtgaaagttgcaacttcatttctgaagtgggtgagacgacgagcccattaggaggaacggaacactcactgcgaaagttgcaatttcatttctatagtgggtgagacgacgagcccagtgagagtgaacgaacaactccaggcgcgccgccttaagagctatagtattcactgagggtttgcggttttattcttgaagtcagtgaaaccaaaaaccaatttctgggtgtaaaaagaccaaggttcttgcaaggttgctcctcccaaattccttcagataggggaagacacacagtttacaagaacattttgaatcttactcattttcaagtatataatatatatttttaattgtagccaacatgacttacaataagtaaacttaaaaagatataagccacccatgttgggtgtgggggtacatgccagtaatcccagctgcgtgggaggctgaggtggggtagattgctggagtccaggaatttgaggccagcctgggcaacataacaccccatttctgaaagtaaacaaagccctaattatgttcattttcccccttcattttcagatttcccattttggccacgcttcacatgcgacacatatagaagtacacagcagcttccccccttacctgcaagggatatgttcagagatctccagtggatgcctgaaactatggatagtactgaatcctatatatactgtttttttctatacatataataaagtttataaattaggtacagtaagagattaaaaactcaaaatatgagttaaactcatatgcaatataatatatgcaataaaattgaaatactgtcaaactctgtaaagtatttgaagagatttgttctgagccaaatgtgagtgaccgtggcctctgacacagcccctggagatcctgagaacacgtgcccaaggtggtggtggtcaggggggagcttctgggtcgcaggtggattccaagattttctggttgaaagttcatctaaagacctgaaatcaatagaagggagtgtgtgggttaagataaggtgttgtggagaccaagggtcttattctgcagatgaagcgagcaggcttcagagagcatctattgtaaatgtctcttttcagactctcctggatcaggagaaagacccggaaagggaaggagattatctacaaaaatgtagattttccccacaagaggcagctttgcagggccatttcaaaatatgtcaaagaaatatgttttggggtaaaatacttcaatttctttcagggcccgttgtctgtcatgttggtagctaattgctagatagagtctgttttgtcagcgttaaggtctgttttaatgtaatgctggtcagctgtgcctgaattccaacgggaggaaggtagaatgaggcatgtctgagcccctcctccctatttcacatcgtggcctgaactagtgtttcaggtttactttcgaatgcctttggctgagaggaggggtccatttggttggggggcttagaattttatttttgggccaggcttggtggttcatgcctataatcccagcgctttgggacgctgaggcgggcggatcacctgaggtcgggagttcgagaccagcctgaccaacacagagaaaccctgtctctactaaaaatacaaaattatctgggcgtggtggcgcatgcctgtaatcccagctactcggaaggctgaggcaggagaatcgcttgaacccaggaggcggagattgcggtgagccgagatcgcgccgttgcactgcagcctgggcaataagagttaagctccatctcaaaaaaaaaaaaaaaaagtattttatttttggtttacaataacatactgtaataaaagttacgtaaatataggccaggcgcggtggctcacgcctgtaatcctagcactttgggaggctgaggccggcagatcacttgaggtcaggagtttgagaccagcctggtcaacatggtaaaaccccatctctactaaaaatacaaaaattagccgggcgtggtggtgcacccctgtaatcctaactactcaggaggctgaggcaggagaatctcttgaaccagggaggtggaagttgcagtgagccaagatcacgctgcactgcagcctgggggacaagagcgaaactccgtctcaaaaaaagttatgtaaatatgatctctctctctccctctctctctctcacacccacagtgctgtactcacctatttttggaccatgggtaactgaaacactggaaaatgaaaccttcaataactggtaactactgtgtaggtgccatgtagggtttgtggactcctaatgaggaaaaaggagtgaggctggcaggaccaggggaaagcaaagagagaaagcagataagctataggttcgcttttctttatggcccaagacatatggcccacctgtgcaaataatgtacgtaactcacaaacttcctgcttatcatcaaacacttcaacttatcatcaaacacctctgctgacagaagaatgcaagcgagctccctactgccttggcgttctcaatcagccgagaaccatcctctgaaaccctcagcaagcctttgttcccttgcactgaactcctctcttgctgattctgcccatttcgaccttaacgaggtacatcatactttctctaataaatctgcctttctttacctacagctatcttgggaaattcttttaccccagcaccaatggccctggtaggtgctgctcacccgtgacagggttcgcatactgaaaaaaacacaagttctgactatgttttcagaaaaaaaatgcagttgttctgtaatcagatttccgctgagcgcttgtctgtttcctctaagaataagggggaaaggaagtgttatttctaaaaagggtattttaaatgacctccaagtttactgagaagccatagcacttactttcaactttaatttccctttgccgcccatcaccttttagcaaagccacatgagcgtgcatctggctgccctgtgcagacagacaggggctggggagcaagcataggagggcctgaggagctaaatccccagctgcccttgaccatcaagagggtgtattttaaaagctaaattaggaggttctgggttttaagtaagaaaggggaaattggccaggcgcagtggctcactcctgtaatcccagcaccttggtagtccaaggcgggtggatcacttgaggcaaggagtttgagactagcctggccaacatggcgaaaccctgtctctacaaaaacaatacaaaaattagccaggtgtggtggcccaggcctgtaatcccagctacgtaggaggctgaggcacaagcatcacttgaacctgggaggtggaggttgcagtgagctgaggttgcaccactgcattccagcctgggtgacagagtgagagtccatctcaaaaaaaaaaaaaaaaaaaaaaaaaaaaagagggtattttactagaaacatacataaagttactgtgttttcaagcttgccaaaaactgaacttgaacttgtgtgcctcgccagatgaaatggtcagaatagacacgcttactggcctaatggctggcctgtccttccagaaagtctccaaaaatgacacagaaaagtgaaatcaaatttcgctgtttcatttattcttctctttaaggtatagttttctgtcccaagtgtataattttatagttgtgaaattcaagaataatggtaacataattactcttgattctgtaaaagtatctaaatgactaagagaataggttaattagttagactgggaacacttttgtaaggataaaaaaaattcatccaaacttttgtctacagattaaaaacaacaataatagagctgatatccacctcaaaaggttgctttggaaatgtaattttattcagtgtatgtaaagcctttgcatttggcagggctgactgaaaaaacaaccctatcaattaatgggactgtggcttgtgtctatcagctgccgtgttctcctttagaatgagacagctatttctgcatcaagggatatgaccctacgatcttgctgctttattctataatggaacagatggcatgcattttatcatgctgcatccacctcatattcctgggttaagcttacttcccatacataattcccttcccatacataattcccttcccataacataattcccttcccatacataattcccttcccatacttaattcccttcccatacataattcccttcccatacataattcccttcccatacataattcccttcccatacttaattcccttcccatacataattcccttcccatacataatttccaaacacaaccttaccaaggttgtgctcgtcaatatgcagtgaactaaagagtgtttcctcccttttatttcttgcatctgttaagattggaatgatttgtgccctgagagccacatgcagtatccatgtgggaactggatgtgtgccctgttcacccagatgcaaacggtttcagtgcaggagtgaatagaaccaaggcccagtgcgtgcgcaatctaggcgggcctgagccagtgattccattctccttccccgagactatccaccgcagcttcaggaggaacactaggaggtccaaggcccttattgaagatgagtgcacccaaggatcctgccaccatctgcatgaccacggtcagccgcctggccgagctcagagggccatccagcccagaaccatgcctgcacagactggcgaaggctgagtcctttcagggagagtgaatcgaaatgagaagaacagcatgaacccaggggagagacgggtaagggtgggagccatatgaggaagagcaggtgaggatacagtgagttgcagagaaagaacagatctcccctggcacaaacaatcccacaggatttgcatataatagaaacccttacttccctgtacacagtttaaaaatatttttctggccggcacggtggctcatgcctgtaatcccagaactttgggaggccgacatgggaggatcatttgaggtcaggagttttagaccagcctggccaacagggcaaaaccccatcgctactaaaaaaaatacaaaaattagccgggcgtcgtggtgcatgcctgtaaccccagctactggggaggttgaggcatgagaatcgcttgaacccaggaggcagaggctgcagtgagccgagattgaatcacggcactccagcccacatgatgaagcgagactctgtctctaaataaataaataaataaaatatttttctgattacacaagaatacatgttcacaatggaaaatttaaaaatcaaacaaaaatccccccaatgtcttcttgtgccatttcctaaaagatgtagaggcattactcagatggttgtgccttttactgtattgcaatcaaattaagagtgacagataacccttcaaaggtgatgtcacagacagctaaggggcggtaactcagtggggaccagggagccttccagagcgggatgtgtggtgttggttgttctcttcccctgtcagaggtaacacataggaccctgaatgttcatcttaactcactagtgataccatccttatcctggggaaagggaatgataccatgatacctggatggttagagactattccacgtaccccactccctgcccccatccctgcccctaagcaaggatgtggaccccgtgcctctgcccaagaactggacacagggcagcagctgccagctgcagtgcagaggccctctccgtgatgctggaagcatcacataaacggatcctgccccaccctcggagcccttgttccaagtctccttgtccccgttctttaaaaaataccaggaatgggccgggcacagtggctcacgcctgtaatcccagcactttgggaggccgaggcgggtggatgacgaggtcatgagattgaaaccatcctggctaacacggtgaaaccccgactctactaaaaatacaaaaaattagccaagcgtggtggcaggcgcctgtattcacagctactggagaggctgaggcaggagaatggtgtgaacctgggaggtggagcttgcagtgagctgagatcgcaccactgcactccagcctgggcgacagagcaagactccatctcaaaaacaacaacaacaaaccaggaatgggctgggcatggtggctcatgcttataatcccagcactttgggaggccaaggtgggcagatcacgaggtcaggagttcaagaccagcctggccaacatagcgaaaccgtctctactaaaaatacaaaagattagctgaggccggacgcagtggctcacacctgtaatcccagcactttgggaggccgaggcaggccggatcagctgaggtcaggaatttgagaccagcctggccaacattgggaaaccttgtctctactaaaaatgcaaaaattatctgggcatggtggtgcatgcctgtagtcccagctactctactcgggaggctgaggcaggagaatggcttgaacctgggaggtggagcttgcagtgagccgagatcgtgccactgcactccagcctgggtgacagagtgagactccatctcaaaaacaaacaaacaaacaagaatgctgtgcagagcagggagtatgagggacaaaaccagcactatctggcccttctttccccagctctcccactcatccttgccacatctcctgctgctcctgagtcccatctgtcaccccagcctggacactaaggggaaagagaaccaggaagagtgagagcatatgagagcacagttgcaccaggtaaaggaggagaggccaggttcccactgcctgcaaaagaagtcctttctgcctccctggaacattgtgtggctccatctgagcctgacctgtccttctgctcctggatggctgggtgcagggatcacatttccagcaagtaacacaaatggccccagaaaccttagctgtcttttctgtctgcaatacttcagtgaaacagaaaggcacctggtgctgactcgtgaagtcgccgtaaactccgttactataaagggaacactaccatcatttgacatttttggaagtgggcagtgtgtgtgtgaacaagcatgtgatccaccagtcctcagggaagcagaaacacccacagggcaggggactgctgtcaccctcatctggttcacctgctccccccacctccatgcaggcttccggagagcttgcggtagttttagaattgagcttcccgcacctccctgtagcaccccatttcaccccattctctccctagaagtgggatgagactccactactgagtagaggagacagagaagcaccatgtatcttcctgtgccaaggaagagtcacaccaccgacctcaagggcagctgtctgcccacaatgaagtcgtggggtccccatggctgtggggggtgggcaacacctcccccaagcaagggtgagctaggtggtcattgccgcccctactaacataacccagacccagagcagcaatttcagatcctaggaaacatctcccgtgcagacacacaaacacacggagtgaatgcggcatcccacaaatgggccctttatttctgaactgccaccactgcacggataaggccacttgggttgcaggcacactgtggagtgtcaggggacagagaggagaggggctgcacaccaagactgccctgtcctcacggagaggaaaagcggccgcagaagagaatcccgttggtcttgctgtgctggatgaagaaaaggaaggggtggtcggcgcagaagcgggggacgaatctggcacaccgcatcatcatgatggcagctgtggcggctgcagcctccgtgccttcctcattgacctccacaaaagacttgtgcacgaccttggacagagacaggtctgtctgggacattccagagaagtctgccttgcccagctcgaaggcatcagtcatgcccaggttgcgcaggacactctccatgtcgtagctttcctctagtttaaaccgcgggagggacacttccacctcctcttcatccatcatgtccagcctcgtccattctacgaacttctcgtaagtgagttctttctccacctagagggagacagttgaagactttaagacccagggtgctgctgcccagcagggccctgtgctatgctgtggatgccagacaccagtggcagcgtggctatggtcagcagcgctccagtgttaaacggctgaccgcaaagtagggacagcagccacagcagacacccccgagtggctccttgctagcacgcctcgctcacagcttagctgttaccgttctcaagtcagtggtctcgtccggaagcatgatgatcatattcagttccttgccaacatatggaagcaccaagatttgggtaaatatttctcctatataggtcttcttaaaagtagattgcttaaacatcatttgcacaggtttctcctcattctacaaagaaaacagataaacatcaagttgaaacaagaccccactgacacatgggacaaatgtgtcggagctggccactctctgcagggagaaacgcagctcggtttctccccagcttccagaacacccggcagcgcctgctctgccatcttcattacctcaacctccagaaactggggtgcccagggcccaaacccaacgtgtctttcctctcattgatcgcattcagtctcatggctttaaacacaatatcacaccaaatttacctcccgcctgggcctctgccctgtccttgggcctcctgcattttactgcccacctgcacctatgtttggacataaaagaaactcccagcgccacctgtaatgcggcactccgtagatcctccaagtcggctctgtctactgcaactctgcccatctcagctgagggcagtgccactgtccagtggtcaaaagccctggagtgcccctgactcctgtctttctctcacaccctgtgtctgactcactggcaaattatattggctctacctcgagaatataacaaaatctgacctgttccttctgcctctgctgctaccagcctagccctggaatattgtgataatatgattgtgattgttcccagcacagtggccagaggggcccggtagaacctaaggcagatcacattgttctttggctggacacccttccctggctccccatttactcggagcaggagctgaaagtccctaaaaagcctggaattgtgataagagctcgtccccagttccctctccctttgcttatctgctacagtcacagaggcctcctcactgcactgccagcaaacccagttcatctcatctctacgcagtaagcttgtcctccagaacctggagagtgaacttctgcctctttacggtctttgttcaaaaaccaccttggcagagaagctgtccttgatagatcttacctgaccctacactcccaccccaaacacagattcctatcccctcccttggtatgtctctgtaccatttaccactgtctaatatgctcctattttcttatttatgcttgctgtctctcccccaagaaaacataagcttcaccagggcaagcatgctttgcttgttttgtgcatggctgaaaaatacctagcaccatgcctgatacatagaagacactcagtcaggttaggcatggtggctcatgcctgtaatcccaccattttgggaggctgaggcagacggatcacctgaggtcaggaaatcgagaccagcctggccaacatggtgaaaccccacctctactaaaaatagaaaaattagctgggcatggtggtgcgctcctgtaatcccagctactcgggaggctgaggtaggagaatcacttgaacccgggaggcagaggttgcagtgacccaagattgcaccgctgcactccagcctgggagacagaccgagactccatctcaaaaaaaaaaaaaaaaaggcactcagtcaatctctgctgaataaatgataaatgcataaacgaattaatgagctgggatgctaaaaaggccaggcaacatttacacatctcaccagaaaaaactgcactggtcaccaaccccagccagccaatgagaaagactggaggccaggaaccacaccccatccaacaatccccctcagttcctgactcggagctgctcctgtgagttgagtaaataccctgcaataggcacagtcaaagacgccgtatggtccccagtctctggtgtagcacattcttctgtgttaaatggaataaataaaatacactgcggcggcagctttctgctttcacgtggtagaggctcgcctgggctggcccttagcctttggctagagcagtctcctgggcctcggctgccccactcatttccttggccagcagtaggcatgtttcttccataactgaccagacaggaactattttccggtttgtggctacatgtaccatctccgtcacaacgactcagctgttgttacaggatgaaataagtaagtaaataagcatgggccaggcgtggtggctcacgcctgtaatcccagcactgtgggaggcccgggcaggtggatcacctgaggtcaggagttcgagaccaacctgaccaacatggtgaaaccccgtctctactaaaaatgcaaaaattagccgggcatagtggcacacacctgtaatcccagctactcaagaggccacggcaggagaatcacctgaacccgggaggcggaggctgcagtgttccgagatggcaccactgcactccagcctgggcaacaagagagaaactctgtcttggaaaaaataaaaaataaaaaaaaaaaataagcatggctgtgtttcagtaaacctttaaaaaaaattaggtggtgggctggctttgctgtaggctgaagtttgctgacccctgccttcagtaattcctccctgcaccccttcagggtccaaagcctccaatcttgcaatataaaaagatctaaccttagtgactgaatgattcactaaatacacaattatatagacaagttccagtttatatagaaggtaatgaaattaaaataagaatctgtatcaactcaaaatctgtgcccttggaggtacacctctggcctcaggctggtacgctcaatactgcagccccttccttcacccttcttcactgcagaactcagaaagcatgacgggattccacatctccccaaacccacaagacctatagttctggcctacaccatatagaaagcagctttccctttctgaaacgcagaaccactaaggggaaggtttaggctcccctcccctcccttgttcctccccctccctgccaccgggactgctgaagccagctcagccatcttgtgaccatgaggaagaaggcgacgtgctgagaatggtggagccgcctccctgggatcatcgccccagtgccagaccagcccaggtctcacctgcctccagacctcctagcaggggagatgagctcctaggagataaaccatggtgaaccggggtttctgttatctgtagtcaaagcccttgtacatcttgttaatcattaaattttaaagagagaaattattttgccaggggaaaatagcacagttcatttcagaataaagcttcaaagaaaataattctttctgaattgcgaggagaacagacaatgaaaataaatttcttgaaaaactgaaggctcaagttcaagttagcctggaagatctaactatggtcaatgatcaagaatacactgtaattaatctattctgtttactttgtctatgttcaaaaatttctatagttaaagaaaaacaaaacaagagacaataaagaagattcagtgagaggaagataaagggccatcagcaaatgacatcttccacgctggaggtggttaatctcagtgtctatctacatgtttggtttggttgttttaaaacaaaaatctgtacttatccttactatcaagagaggactgaatatcactcatcggttcagcatttactaagcaccagctacgtgtctggcacttgtcagagagtcctccctgctcagcctcaattcagcaggctgagttgttccgctcctgcagtgtggcacggaggccagcaggaggcgcggtagcggggcttcccgggacgccgccagaaagaaaggagtgggtaggtcctgatgggaatgaagctagagaaaaggaggaaatgtccgctagaagatggcacgccatatctggagtctgagctttaagaccttgatcgagcctgagggctgcagcttcagacttgccctgtaggtggcagggcggatgccaggcgcccagggacacgaggccacccaatggatgtcaagcaggaggggcagggacagaaaggccccacggctgcagacgcgggaggccccgagccggagacgctcgtgtgaacacaggcgctgctcctgtcacggccccttactcgccttgctgactttaaacagtctctcctcggtgttctccttgtcaaactgttcatcccagtttcctctgaaatagacagcattcaccagaaccagccttgtcaatggatccactgagcccggagagagcaactccgcaattttacctgagcggaagaattcaagaccgcattagataggggcggctgcggatccccgacacatcaggaatcggctggggccttctccttcagcagtcaagtgcacggatagagagttccactgtcccccaaatataaagggatacgtgtccttaaagcaaaacaacaaaatcttctggtacgaaaaacatcatcaattgaataaaacacacaaagtgaacaaatatgcgttaattatgcaggatgagttcctaacacatgagataagaagcaatcatgggtgcctatgacttaaagacaagaacttaaaggattatcaaaaaggtgggcagtcagaagatgttctttacaagcttaaagaacagttaggccagacacagtggctcacacctataattccagcagtttgggaggctgaggtgtgaggatcacttgaggccaggagtttgagaccaacctggacaacatagtgaggccttgtctcttaaaaaaaaaatttattaaaattagctgggcatggtggtgctacctgtagtcccaattacttgggagactgaagcaggaggaccgcttgagcacaagaattgatgctgtaatcccagcactttgggaggccaaggcgggtggatcacgaggtcaagagattgagatcatcctggccaacatggtgaaaacctgtctctactaaaaaatacaaaaattagcagggcatggtggcacgtgcctgtgatcccaactacttgggaggttgagataggagaatcacttgaacctgggaggcagaggttgcaatgagccaagattgcaccattgcactccagcctgggcaataagagcaaaactccatctcaaagaaaaaaaaagaaaattgaggctgcagtgaattgtgattgtgtcactgcattccagcctaggtgacagagggagaccttgtctcaaaaaaaaaaaaaaaaaaagtttaaattaagaaccacagatagaccagggcgtgacccagtgtcccacagcaatgcatggcaactgtagactgtgctacccaagagggaggcagcttgagatccacactgcgaattttttatgttacttgtgaaaggaaaaactatattaacattaacacactaaccccctcctcaaaattaaaacgtggattgatccagaagaggtataccaaacactgaaaggcatcacgggtacaccaaggaaacagggagaaatcagagagaacagaacacattgagcatttccaaaatgtcaaataatggcaactgatttcagaagcagattttttaagtttgcagttattcagagaaaaaaaaatcattcctgtttacaattgacagtcttgtgaaggaactgacaataaaatggattaagaggttattacaaaagtagaataacaatacattttcaccttctgtcttttcagctacccaggtgtttatgtgttttctggacttctctacggcgctgataaagtcaagctcctccatctctgcttggtagaatttttggcaggaatctctaaaagactaggatagacagagtgacataactgcctggctacaaaaatgatgaacaccaacggcctacttcttcattgcaccaagtcagaaaatctataattttatgattgacatacataatttacaaataaatatgaggacttaacctaaactacaacttcctagctttagctatatttaatcctagcttaaaaactaagtcaaggtcaggtactgtggcttacacttgtaatcccagcactttggggggccgaggcgggtggatcgtgtgagctcaggagttcgagaccagcctggccaacatggcgaaagcccgtctctactaaaaatacaaaaattagccatgtatggtggcatgcacctgtaatcccagctacttgggaggctgaggcaggagaatcacttgaacccagaaggcggaggttgcagtaagccgagatcaggccaccacactccagcctgggcgacagagcgagattctgtctcaaaaaaaaaaaaacaaaaaaaaaaaagcaaaaaacactaagttgaatcagtctctgaatatcaaacgaacttcaccaactgctggatcctttaagggagcagccatgcatcaaggagctgcctgacaagatgctgacaagacacttcaaaagcgtgaagtagatccaccttattgaaatgcagagaatttaaaacatattggcaggtgaaaagaaattacaaaagcctatgtatggcataatggcatttagagccacacgcttcctgctgggccccagcccccactacctggccacctttatttctttagtgaataagagcaagtatgacttactgagaggaaatcacaagacttttccccaaagagcctgttggccatcctaagcaagtactgcgtgccagtcttgttcacttcggtgagaagagactggaagccctggtggatgtctccaccaccgccacttttattgaaagaaagtatctgaaatcaaaaacagaatgaaaacaaatcattcctgtatgctctgacttcaggaaatggggcaaccccaaactcagcctaacaaccatccagacccttattactgcttaaaagatctatccgaggctgggcgcagcagctcacgcctataatcccagcactttgggaggccaaggcgggaggatcacctgaggtcaggagttcgagatcagcctggccaacatggcaaaaccccatctctactaaacacacaaaaatgagctgggcctggtggtgcgtacctgtaacccagctactcgggaagctgaggaaagagaatcgcttgaacccgggaggcggaggttgcagtgagctgagatcgtgccactgcactctagcctggcgacagagtgagactccgtctcaaaaaaaaaaaaagatccatctgattaaaggccagaagggtcttgaaagcccctccctgtaccctgtctgtgctggcatgagctgcaacgccctccacaaacccaggctcctgatgctcagtacttggagtctggtggcaaacaagggtgccaaccagacctcctgtctatacaaacacaggccgcccctgacatcagaaggggcagactccctcctgcccgtggctctggaatgcccgtgtcactggctctgactaatgatacagtaggtagaattcagtagaagtgatgctgttccaggcctaggccctttttaaaaggcctgacagctgccatgttcactctcttgtaccctggccaccatgacagaaggaagtccaggctatcctgccgaaggccacatggaaagccctggagaaggtgccatcacctgtagagagagttgcttgaagaactgaggcctctagccgggcgtggtggctcacacctgcaatcccagcactttgggaggccgaggcgagtgcatcacctgaggtcaggaatttgagaccagcctgaccaacgtggagaaaccccatctctactaaaaatacaaaattagcctggcgtggtggtgcatgcctgtaatcccagatactcgggaggctgaggcaggagaatcacttgaacccgggaggcggaggttgcagtgagccgacatcgcgccattgtgctccagcctgggcaacaagagcaaaactctgtctcaaaaaaaaaaaaaaatcgaggtttcaggtgtgagagaggccttcttgaaccttccgggccaggtgtccactgaaacagctgcatgagtgacctgcactgcttcctgggagcagtcctgcctgctcaggccacggaatctgagaaataatcaatcattgttatttccagccactaagtttgggatggtttgttttgtggcaacagctgacacatgcagccatccagaagtggaattctgccatgaccaaaacctaaaacatgtggacttggccttggacccaggcagctggcagaggctggacggacaggacgaaatgactcctgggggctggagaaagggggctgtgtgtgtaccagctgaagaagtggaaagaaggtcaccctcagtgacagggaggatggagtgcctcccccgggaactcctgcatctggctaaggggtccaggaggaagctggcttctttttgctgcctagggtaacacatgggaagagaaagatgaaggaactgttccattttcaagcagaatttaaaggaactatttccaatccaggatgtactgggtggagaataaaaatgtttcttcttcccagcctttccagctggcaaaagattctaaaagagatggcctcagggcaaagatcaaatcccagacactggcctcaagggtgaggtccaaatccactttgttaaaccttagaagattcagacagcatcttatagaccatctggcaggctctcccatggcaccctgactcccaacccaacaaagagcactcaggatggcggtgggggtgcttttgtccagggaagcagaattttaagttgatagaaattccacagtggttttcaggcacttgtaacagcttggactaaaagagagagacggctcaaagtgcagggaggcctctgggtgcccacgttctacaggtgggaggtaggctgggagcgcagcaagcacgggccatttcttacagaacaggaaaggagctgccaagagcgacaccaggacacagagggcagagcacagccagggcagcaacggacaagggacaattctgggaagctgcagtggaggctcatcaaggaacaccctgcacccagggctgagaggtgaacaatacatgcctggctgggcttgggaattgccactgctccgtgacggccacgtgcctcccacgcctactgtgatgggctgcatgtgtcccctcaaatttacacactgaagtcccaactccagtgtctcaggatggaactgcatttgcagagagggcctttacaggggtgattaaggtaacataaggccattaggttgggctttaatccaataggactcatgtccttataaaaagaggagatgaggacacagacacacacagagagatgaccatgtgaggacacagggagaaaacagtgtctacaagccgaggagaaaggctgcaggagaaaccaaccctgcctacacctggatctcaggctcccagggaaccaccaggtccagagggcagaccacagcagtcacgggtggccccgaccagctacatctgtggtgtgcgcaccctctctcaacccctctcaggcgcggagatgcctctgcctttggcagtggggccttggcaagcaggacacaggcggggacgtgatgggtacttgtttcaagcctgtcttctgcgagcacttcctctcagaacccagccgccaggcctacggaagcccaggcaacgctgctgaaggaagcatgtggaaggccccagcggagaaggccacggagaagacgcccagcgccccgctgagcccccgctgacgcagcccacaagggacccacccagtgccaagtggtgcagaagcaccactcaatccacccagattcaacaaccaggaaagctgctaagctgggagagctggttacacaacaacaaataaccagaacgctactgaaaacatgtttagctgacaaatgccattctaagaaggctttacgcgtaaatgagaaaataaagactcctaacaaccaacaagcagatgacagtacccaaagatcatcacaggactcaacctgaaccttgtgactttacaaccatctacaaactcacgaacaagctaagccatgtgatgatgaaatcattcattcctctgaatcgggcgccccctctccaccccagggggtcagtcagggtgttgtccccagggtgctccagcatgggtggcatgcccttccctgtaaactcgccacccacaccctgcaatactgcacagtcatccgtctcgagcgatccctttgggatttggaataaggaggaccagctaacttgacagttaatagcaccatggctgccctgaagctgtacctgggccatctgtgcagcggtgtttccctttgcccccatgtagaccatggccagggcacaggacatgctcatgggtgagaaaaacacattcttcgagttgtctttacccagcgttttcaaaaggtttaaggcaaaggtgccatttgcttctgcgagaacatccatgatggcagacctggaacaagatttaaaatcagtatcacttaagcacagcttccacgcgactgcatctcacgcgccttaccgacagtcaccgccgatgctgtggttcagtgggcaagcagaaacacacacagaactctggctgtttctttttaggaccctccacattattttgtgtgtttctaatgttaagtgtggaaaatgaaagagttctatgtgaaacgccgccctgttttgtgaggactcctccctgcacgcctgcccgcacgtggagaaagtgggaaggaggcaccctttcctggagtctcttccttggggtggaattacagaaggggcactggcttttgcttctatgtttgtattctttggtgtgttttgcgggcttaaatgtactgttttaatttgaaaaatattcaaaatgatacattcactgacagttacacaagaaaagatggccaaatgtttttataatgagagagagaatcccatttctgggtagcaagagccttaaaaaaggatcaatcaagccacatacaaagatgcgtgaaagcctttcaaatgcctcctgacccttggatctccttctaggaaatccctgcaggtggcaaagccccaattttggaccacgcttggggacatcctgctgcaacaagccaggccttcctgcgcctgaactcacagcacactcaggacaccaccttgcctcatgggctgtgggtgcatgcccatctccaccttcacagacaggctcaggggtagggtcaggctgcacatctctctagccctgccgtgcagtgggtgtggcagccccagcagggtccagagcaggaatgcagctggatagtcgggaggggggagctggggtatcttcaggcaagtcggaatcacagaatcacatgttaaagtccaccaagcccttagagagacctaccatcaatgccccactgcactacagggaaggtgaagttgacggaagtgaagctaagaagtagctgggcttgaaacgcagggcggatgcgctttctgagctgctgctcaagaagaagaatctgcagaatcaggtgagaggacaaggggcagctaagggccccacaggcagtcaggctgggaaggaggggatgcaggaatgcagggatgcggggcctgcctgctctgacacagttctcagatgtttaccaaatgaatatgtcccagtcagagaatgccagcattctaagacagtcccagtgactcacttgagcagtgagtgggaacccacggaacaaggaaggggagaagctggagcagacatttcctggagcagatgggagagggaaggaggtgcctactggaggccctgtgaggagatgctgaattaagcggctctccactgtgcatgcctttacatttggagctggggttggctgagcaagtgctccaaagatacctgggtcataatccctgggacctgtgaatgccccttacatggcaaaagggactgtgcagcacgattagattcaggctcttgagatgggagattatcctggattgttccagttgaccctaaatgtaatcacaggtatccttctaagagggagggagggggagatctcacgggaaaaagcaatgcaaagaataaagcaaaatgccactccactggccttgaagatgaagggcctcaagccaagaaacgcaaggaccacagctgcagtagctggaaaggcaaggaggatcctctggaggagcctggccctgcggaacccatttccaacctccaacctcagaactctgagaaaataaacatgtgcagtttagccacgaatccatggtcatttgttacagcagccacgggaaaccaagacaataactcatacacctgataaagcttgtttgctgtgcttgtttaaatattttgttttcaaactcttctttattcattacacagaatacttggggcactgggcactcctggcttgccaagcctttccaaacatattttaagattactaatttctaataaaaggacaatagaaagtacatattactaaaattcttctgaatataagggagtctttgatgatacataaataaatccaggattccgcagagccctgggaacaccagtataaacaaaagtagccattacacggaactgaagcaaaattgggcctatttttggttctttggattctagatcacaagaactgcccgcttatcaacttgaagagaaacaattggtaaaacagggaaacttctaggttaagaataagaaaagaggagatgccccaaagcaagaagcacagcctgtgaagtccgtgtctcaggactcaaagccagcagacaccctgacacgtggggttttccctggcctggggacatggacttctgtctttgtccccaagagggctcagcccacgtggagaggctgccaggtgagatggctcctccataaaccaaaaaaaaaagacagaggttaagtaccatgtcagctggccaggggaaggtcccacatgctcccccaaccccatcctagactattctaccgtcagcacacgttttcccctcaaatgctgaaggactcttacgcttttttttttgtagagacaaggttcttgccaccttgcccaggctgctctccaacgcctggcctcaagtgatcttcctgcctcagcctcccaaggtgctgagattacagccatgcaccacgcccagcctaaaggacttttaattcaaatggaaatgtccacctaagaaaggctaataataaaacactccgtctccggtaatatcccggagaatctgtttcaggcgctgatctttatatcagtaacttcaacaaagcaaagccacctttgtctgaagacacgcccactggggaggtgcctgtctggccagcccaggttacaccatctggggcagaggagaagtcggtgcacatgagtttcactgtgtcaggggatttaatttgaaatactgaactggagaaaccaaagcaggatattcggaggagaagtcagtgcacatgagttttactgtgtcaggggatttaatctgaaacactgaactggagaaaccagaccaggatattcggaggagatggcacgagtcaggaggaagacagggtctctagtcctggctctggtaccctgggcaaatcactggactcctgataccagtttcctctctgtatgaggaaaagcatataccagataatctgggttcccttccatctctaacattcaataattgttaataccaaatgcagaaggaagagcaaaaatgtagctcaattttcaaagcccacagtgaggtcagtaatgatattccatttcttagttgaaaacactgctgacagccgtgaaaggtaaaattctatctatgccttacataaaaattgctgagcaacaaagaaacaataaatcaaggatgtcctagagatttaattttcttagcagaaactatgttagtcattaaataactgaatatcctactcctgataaacacccttacgtcaaacagcaagtggtacttcccatgcttccttaacaaggtaagaattacctacttcagcagccaccagcacagctgatgatagaacattagtcccttaactccccaaacaggaacaagataaaaatatctgtcgtcccaaccttgtgtaactttgttcagatagttctggcaaaggcaaatacaactcatgaaacataatgagaaaggagattgtcagaaaggagacaaaatgagcacagttagcaaacaatttgatggtctacccaaaaagcagccagaatcagtaaaatactcttaaaactgaaaaataatggagtaactgggctactaaaaaaataggaaaaacagaccccagtagaaacacgtgcaaaggacattaacaaatttacccccaaaaaagaaagacaatagctaataattatatttaaaagtttcaacttcagaaaaaaatatcacttttttgatatatactatgtgctaggtccacactgaaagacccttaccctctgagatagctgctgagaacacctacgttttataagcaaagaaatcgggccttagctctttaagtaccatgtctccagagaacccagggcaacaatggcagaatgacggctggaagccaggaccgcatggctctgtagttcactctcttaacaccatggtgcacagccttcccaaaaagcaatggtggagagtacattaaagatgccttttcaaaccatgaaccttgcaaatacaaaaacaattcatgctaatactgacaaagacaggcaatccttctcacgccatgcaagtaatacggaggcagcagggacagagcttggcccgtacccactcccgtattttccatacatcccccacgccatcacacctgcccaccagaccatgcaaaccagggagggaaacaagataagccatgttccaccccaaatcttacccaagggagttaagcctgatgcccacatgcatacaggatcagaacgacgatcctgacctcttgccttgttgtattactaaaaccctctcctcaggggctcatctgccatgccctgatcatgacacatctgtgctaacatgatgttccccggtgcctgccactagcgtgtgtaatgctgctgacacacctcatgactatccatgtcaccctaaaacaccaggaacacctgtcccgagggccagcccgggaactcctgcccctgtgccgctgccctcctgctccagcataagcccattataaagccttgtctgggacactttctctgtctcatgtcaatttccactgcatgagaatctaagaacccacgatcagtaacaatactgtaaattggtacaccagtatttcctgagtatgatttagaattatgtcaaaaataaaagtaaaatacaataaagtgaaggaagaaaagaaaatgtcatggaaacattcatactatctgaattaaaaattccacttctaggaatttcactgaaggtaaaactcacaggttttgtacataataaaacattatgtacaacattatgggatataaatagggctaataataataaaaatcacagtaatgacatgggaatacacaagattacattaaaaaagatataaaactatacatacaatttaaatttatccatgtaaattaggaaaaaaggtaagtgtaggcacaatttacagacagaatagagggaaatactatacaccaaatgtttctaacggtaatttttatgttttttgtgtttttctggattttcacattttctatagcatataatttatggagggggttggttaactcttctttttatgaaattactatatatacattcagtttaaaaatcaggtggtgttaaaagagatgttataaaagacaacaagctccttctcagccctcccaactccccagaagcaatcacttccaaaccctttgctctttcttctggtatttaccaccatatttctacataacgtgtatactactatttttgacctaataactttatcatgttttattttatgtatgtatttatttttattagggtaggggtctcacgctgtcgcccaggctggaatgcagttgcatgatcacggcccactgcagcctcgaactcctggcctcaagcaatcctttagcgtcagcctcctaaagtgctggaactacaggcacccggccaaattctagacattatctattgccttcctaatctagaggccgagggcccggtcccgatccacaggtttgctttattatcactaaatagcattcgatgctaagccaggtggtgggatgggaacccatttcctttttatgtaatgctgatttgccttatattaatagtgcctttcccccctttccttagttttctatgtactatgtattttcaaattctccccaaatgttctacaggtcagtcaaaccctttcagtacttttttcatatgcttcgacacaaggaataatctaccagctgcattttcctctccctccgtctgtcaccatgctgctgagcatgcgcgactttcacgccgaagagaaatgttcatagacggggacaagtttccctactataatacatggccaatttatagtttggcaggctggtcagactaattttttttctcaaacacagcacattgcttacagggcaaagaaattattttttcttatttaagtgttgatgacatattttaatatgtctaattttttaatgctttatgcaaacttacaaattgcacaaaccttagtagacttttgaacttctacaaatctgataaatcaagacatataaatctagtaagctagcctctcctaagactttcaaacagtacaatgattacaaaacttatttctatacctgtacttatgtctagcaaaagttattcattaatatcacagatttaattattttatctttgttatattttcctattcctttcctaaggtaacactaatgcttattttaacagtttcctatggggaaaattaatcttatggggttaaatcctaagggatcatccctttctgtaaaaacagggtggggctccctggttcatggtctttgtgcatcaaagcagtttctcagcacagggcacacactctttgatgccaagcatatctgactagttagggcagctttgagctccaatcctgccttcactgagattttataaggcctcaaccaaacaccaaatttcagtgtcttgtagcctgatgtccttccttaaaatgaaatacggagttttcctctatctgagttgcatagaccagtgttgtatggtataacttggtctttttgttgaatgtttaggcctttaagttggtttttacaactactgtgtttgttagcccaggaagctataataactaaactttttccatagcaatcctagacacagtgcaaacattactgaattcttttgtgcctttttaaggctcatcttgtttgcctcatctgaacttattaatgagcttgggctttttacaaacaatatatttcaatttgctgatgtttttttttcttcttgttctaattggctggtgggaatctctttaaattagttactttccctccaaacacacttactttatatgcaggagtccccagcagatccgtctgtggtctgttaggaactgggccacgcagcaggaggtgagcagcaggtgagcgaacatcaccgcctgagctccacctcctgttaggtcagtggcagcgttggagtcttgtaggagagtgaacctacggtgaactgtgcacgtggtgatcttggttgcatgctgcgtatgagaatcgaatgcctgatgatctgaggtggaacagttttatcttgaaaccatacccccaactttatcagtggaaaaactgtcttccacaaaaccagtctggtccctggtgccaaaaaggttggggaccattgctttaaagcaacagcaaagtcttaccaaaccattttagatttttctagtccaaagactagatatgataggtgcacaccaccacgcccagttcatttttattttttgtagagacagggtctcgctcggtggccgaggctggtcccaaactcccggcctcaagctatctttccacgttggcttcccaaagtgctgggattataggcatgagccaccaagcctagcttgggaaaaaaatgtaaggcacttgctgatttcctccagactggctctttgttctctttttctgtcaagtacaaaactcttagactgatatcatctgggacttctcacctttctccaggctgtgacacacacagaaaatgatgtttgtatgtcactttggggccaggctactcaccccaaaggtgaccagtgcagagctccagccacccagactcctcgagttggagggatctgttaacctgcccagggcacaacacccacacacaagttagaaagttctgctctggaagactgaaactggaccccttccttacatacaccatgtacaaaaatcaactcaagatggattaaaggcttagatgtaaaagccaaaactataaaaaaccctggaagacaatctaggcaataccattctggacataggaacaggcaaagatttcatgacaaagatgccaaatgcaatcacaacaaaagcaaaaattgacaaataggatctaattaaacttaagcactcctgcacagcaaaagaaactatcaacagagtaaacagccaacctacggaatgggagaaaatattcacaaactatgcatctgacaaaggtcaaatatccagcatctatatggaacttaaacaaatttacaagaagaaaacaaacaactccattaaaaagaaggcaaaggacatgaacagacacttttcaaaagaagacattcatgcagccaacagccataagaaaaaaggctcagtatcactgatcattagagaaatgcaaatcaaaaccacaatgagataccatctcacgccagtcagaatggctattattaaaaagtcaaaaattaagagatactggcaaggttgtggagaaaagggaacacttacacactgctggtgggtgtgtaaaacagttcaaccattggggaaagcagtgtggcgattcctcagagctaaaaacagaactaccattcaacccagcaatcccattactgagtatacaaccagaggagagaggaatagaaatcattctcccataaagatacacgcacgcgaatgttcaccgcagcactattcacaatagcaaagacatggaatcaacctaaatgcccatgcatggcagatgggataaagaaattgtggtacatatacaccatggaatactatgcaaccataaaaaagaatgagatcatgtgttttgcagaaacatggatggggctggaggccattatccttagcaaacacacgcagggaacagaaaaccaaataccgcatgttctcacttatgagtggaagctaaatgatgagaacgtggacacaaagaggggagcaacaaacactgggtcctatcagagggtggagggtgaagggtgggaggagggagaggaaaaaataactattgggtactaggcttagtacctgggggatgaaataacctgcacaacaacctgcgacatgagtttacctatgtcacaaacctgcgtatgtatcctgaacctaaatagaggtttaaaaggttaaaaaaaaaaagaagaaatcatataaatgaatgttctcttctgaccttattccctcatttacacttttcatcatgatatttgattccattttgccttctatactaattctttggataccacaattatagtttattgagtcttccgttccctgcgctgcctatctctggggtccttttgttatggtggctggtgtttgctttattttatttaggtctctcttttgtacctagactttccaaacattcctaacaacccttggatgtcagtacatagttaagaggaaaacacaaacaatgctggaagttctgtttacatggaggaagttctgtttacatggacaggacatgtcagctgggagcttcactgcagtgtgctcaagggatcagcagcttttttgtccgggaaccagcaaatgggagaactcttcggtgtggctatcggtggtgttctggaaggagatggggtggaagcagatgggggtcggggggcttctactggatctgtaatcccctcacgtccccactgcctcccccacagtgcctgcaggaccctgagtttgagcattttcattatcacttcgcaataatgcataaacactgaacaattaatcataaaaaagattggagagatccaaatcctaaaaggaaagaaaaaataaatccacatttaaagtttaccactcaagatactccaaatatcaacaaattataaacaatctagtgagatttttctatcgagggctttctgttatcctttcagcaaacgtgtgagtaacaaggatgcctgtttcacagtcacgttgcaaactcaagacctgtcaatggctttttaaggacctacttctttagcttcagtaaataagatagctaagtgtccttcatatatatatgtgaatacacatgtatatatgtacatagacaaatatttatgcaaaattaattgtttcaaaatttaaaaactataccatttaaaaataaaaaatgatatttaatcacagacataaaaactggatattaaagtcttattaatgaacaattttatgtattttttaaacaagcctaacaaatctatcctggcatcactttttttttcctgtagcatcaccagtaactgagcaatgttcacaattgattttattcaactaatcaagtcttaatttttttttaggtgtcactattgaattgtgcttctcaacttctattaaggatgcctttatttcctactaaatttaaccatttaaagactggtttaatggaaacttggacttcctgctttgtccctctgtttccttgtgcagtgtgtatgtgtgtgtgtgtgtgtgttgtgtgtgtatgtgtttaatatatctgagcagcctaacatataaatgggagttaaacattattttcaggctaggcgcagtggctcacatctgtaatcccagcactttgggaggccaaggcgggcagatcacgaggtcaggagtttgagaccagcctggccagcatggtgaaaccccattgctactaaaaatacaaaaattagccaggtatggagcccgggaggtggaggttgcagtcagccgaaatcgcaccactgcactccagcctggcaaaaaaaaaaaaaaaaaaaattttctttctttggatgccttggcttaatcccaagtgcagtaagcctggaaatgtaaggtgtgtggtcttccctgggaccgtacaacatctgcttgggtgcccttattattacatatgtggaaaagaatgttggttctattcatgctaatttcactctactgttactggtccgtgttaactgtttcatgctgaattgtaataaaatgcattggaattggccttaacttaaaatacttagtttacatagtcgagtatgaccaaagtacttttctctttggtggcacatcacaatggatgcaattactcagatacggtcctgaaatgagaacaaacgccatctatgctgataacagcagtcactggtgttaatcccagcacacataaaagccccagcaatacaaggccggcccaggaccttaactagaaggtcactgaacacatcagatctcatcgcatcaggcctgacccccaccagaaaggatgcaggcagctgcagggctgtcattaggcacgagagcatcccagaaagcaaaagtgcccaaaaaatggactcagatgccccctcgcatctgagtattcctgacagcatgtgaacattaattattaattttctgtacctcagttttccgaagccaatctttaggacaaaaaaaaaaaaaaaaaaaaggaagaaaataacttaaatgccaatttgtagttaaagtttcctctttgccttgaagacatcaaagcctgtaatagtttgcctgtagggagtttaattcaaacacagagcggtaaggagatccgggctggtccacacgatcgtctccacaggtctgggcgacctgaaagtgctgcggattggccaagcccagcacggccagtccagtgaacacacgcagggggcccggatggcaccgtttggcgccgaacccctcggcctctctccgcctcccgcccggctcctaacacccggcgccccaagactgagcacgcgtcctccgggtcgcggagcgggcgaggggtcaccgaggccgcggggccgaccggggtcacctgtggcccgggaggctctgcgccgcccccatcccgcgccggccgcctcttccgtgggcgctgggcctgggcgcccggggtcctcgggtccgcggcgtcaccggccgggctcgcggccacgcacgactcacccggccgcgtcgccgttctctgccgctgcgaggctccggaagggaacccaagccggacgctcgcccgggcccccgccccgctgggactgctggggtcacagccccgcgcggccacgccccattctcggggctccagcgtccccgcgcgccgtcgacccacgcgcgttcccggccccgcgcgacccccaccctgcccccctccccgctcgcgcccccggctttcccgactttggagcgacaaacccaagccagcgtgtccgagcggctcccaagccagacacgtactccagagcggggagcgagcgagcagaacggcgggcagaggcgccggagccgccccggacctcaaatactcgcggggaggcgggcggagtcccgggtctcgagctaccgtcgcccgtccggagcgcgaagggagaggcggggcgggacgtgcgggtcaaccccacccgccagccggaggggccgcgagtcctgcccggaggccttgactttgaccacagtacagggccccaccagcgtgtttatggtgcctctgtggagactgaatgctggcctgtttccagaaaagggccggctcctgatacacggccatccactggggagtgcagaacacgcatttaaaaatgagcagactagatacaggtcacaaagactttgctgatgaaacagcttgcggcaaagaagccagccaggggcgggcgcggggctcacgccagtaatcccaacactgggaggccgaggcaggcggatcactggaggtcaggagttccagaccagcctggccaacatggcaaaaccccgtctctactaaaaatacaaaaattagccgagtgtaatggcgcgtgcctgtaatctcagttgctggggaagctgaggcaggagaatcacttgaacccgggaggcagaggctgcagtgagccgagatggcgccaccgcactccagtctggtccgtctcaaaaaaaaaaaaaaaaaaaaaaaaaaaaaaagtagactaaatagcttttgcaaagcaaaaggaatagtcaagcagagtaaacagacaacctacagagtgggagaaaatcttcacaatctatacatccgacaaagcagtaatatccagaatctacaagaaactcaaacaaattagcaagaaaaaaaaatcccatcaaaaagtgggctggcatgaatagacagttctcaaaagaggatatgcaaatggccaacaaacaagaaaaaatgctcaacatcactaatgattagggaaatgcaaatcaaaaccacaatgtgataccaccttactcccgcaagagtggccttaatcaaaaaatcaaaaactcaaaaaataatagatgttggcgtggatttggtgaagagggaacacctctacactgctgatggatagtacaaccactgtggaaaatagtatggcgattccttaaataactaaaaatagaactaccatttgatccagcaatcccactactgggtatctacgcagaggaaaataagtcattatacaaaaaagatacttgcacacgcatgttaatagcagcacaattcgtaattgcaaaaacatgaaaccaacccaaatgcccatcaatcaaagagtggataaagaaactgtggtatgcgtatacggtggaatgctactcagccataaaaaggaatgaattaatggcattggcaacctggatgggattggagactgttgttctaagtgaagtaactcaggaatggaaaaccaaacattgtatgttctcactcataagtaggacctaaactatgaggatacaaaggcataagaatgatacaatggactttggggacttgggggaaaagggtgggaagggagtgagggataaaaggctacaaatttgagttcagtgtatactgctaaggtgatagatgcaccagaatctcacaaatcaccactaaagaacttacttggcagggcgcagtggctcatgcccgtaatctcagcactttgggaggccaaggcaggcagatcatgaggtcaggagttcgagaccagcctggccagcatggtgaaacccccgtctctactaaaaatataaaaaaattaggcatggtggcacacatctgtagtgccagctactgaggaggctgaggcaggagaattgcttgaatctagcaggcggaggttggttgcagtgagctgagatcatgccactgcaccccagcctgggcaacagagcaagaccccatctcaggaaaaaaaaaaaaaagcttgccatgtaaccaaataccacgtgttctccaaaaaactatggaaataaaaaaactaaaatatatattaaatttaaaaataaatgtatataaatgagcagagcccacatcattgagccgtgtgttcaaggacttccagttctctccaggcataggaattagaccccagggtactgacaggttagccaagtaagtatgaaaactccatctgccatctcagacagagcagtcttggaaaacagaaacatctagcataaatggaagtagggaagatactagccaggtgttttacatgagttcaattttgagaactcaagctgttttactccctctgtgcttaccctaaggcagagtttctcaactgcgacactgttgaccgcatgaacccgataacttgtggttgtgggggctgtcctgccatcacacatgtttcacagaatctctggaggagattcaccaagtggatgccaggagcaaaccacacgcccctccctagttgtggcttaattagtcttaagtgatataaattgcgaatatttcccccagcttgtcatctgttttctgacattgcttctggtgattttggcatacactcttttaatgtagtcaactttaatgatttttcctttattgtttctgagtcgtagttagaaaaactttctctattcacaaggagcaatctctttttttttaaaaaaaagaataatctctagattatagagttcactaatgttttcttctagtatttgcacagttttattttttatatttagattgctgatccctttaaagtttattctggtgtatgggaaatatagatccaattttaactcgctttcaagtgactttcagtttttccacctctgtttattgaaaaaccattttcactaatgtcttcacatgccacctatgttatatatcaaatagctgcatatacttgggtctgattctgaactttctaaactttctatttggttctgttggtcagattctttcagttatagaggttttctcttatgattcaatatctcgtacagcgcattctccttactgctcttctgcttcagattttcctggctctccttgttgctttttctcccatacaaacttttttttttttttttgagctggagtccctctctgtcacccaggctggagtgcagtggtgcgatcttggctcactgaaacctccatatcctgagttcaagcgattctcatgcctcagcctcccaagtagctggtattacaggcgcatgccaccacacccagctaatttttgtattcttagtagagatgagggttcaccatgttggccaggctggtctcaaactcctgaactcatgatccaccctcctcagcctcccaaagtgctgggattacaggtgtcagccaccgcacccggcctcacccatacaaatttaagagtcaacttgtctagctctaaagaaaaaaatcttgttggcagggcatggtggcttacacctgtagtctcagtactttgagaggccaaggcaggcagatcacttggtcaggagttcaagaccagcctggccaacatggtgaaaccccatctctactaagaatacaaaaattagctggacctggtggcgtgtgcctataatcccagctgcttgggaggctgaagcaggagaattgcttgaacctgggaggcagaggttacagtgagctgagatggtgccattatactccagcctggatgatggagcgagaccctgtctcaaaaaaatatatatataataattaaaaaaataaaattaaactgtagtcaaacaggccagatgcagtggctcacgcctataatcccaggactttgggaggcagaggtgagtggatcaccagagcgagactctgtctcaaaaacataaaataaaataaaaataaaataaatgaaaataaaaataaatcttgttggtaatctattagaaacatattgaatttacatattaccctgttataaaccaacatttgtactttgatttagttgttctagccaagaacatgctgggtctttctgttccttcaaataatttttttcctttttcctttaaagttttgttcatgtaagatttgcacatttcttgtttagtttatttctagttattttatctctttgttgatattgtatgtaagcaagttttttccattatattttccaactagcttttgtttgtggatgagaaaattgtttttatgtattaactttataacctgctgccttactgaaattttttactatttgtattttttattgattcttttaagtcatctatagctatactacatcacctataaatagaaatagttgtacttctttctccaatgttcatctctctaatcgttttctcttgtttgattgcattggctgataccttcagtggagcaaattgcctgaccacttgtggtgttagtatctacaaaatgaaagtgtgagcccatatagcttcaccaaagggcaagtcattcctaacctcaatggcttcttctcaaaataggtttactgggcagggagacctaggaaggggttctgtagtctggcattctctgccatcccacctggatttaaataagattgaagaactatttccaaattacgtaggttaataattctgagctcagcatcctcctagagagacatatctggcataaagttgtttcataaatgtttatcacattttcattatatcgtattctaacaggcttataatgagaagcaatcaaaaccaaaagtaaccaggtttctaataataagtgagatgagtgcacagttggagaactactctgatgagtggttctgatgctcatgggacaaaggcctgggttttcgttgtctataatcaaacgtgaaaaagcagtttgatgtggcaccactggaaatgcgtacaggccatttcttcccctcttcagccattttcagatgggaaagcagaggggattctggcattctccaaaaaagacccctggaaaacccgtctccagagcctcctgcctgaaggtaacattcaggctcttctatattttttctctttcccgtttttctcatttaataaggaattggtcaatcatgcaatatacgcgtggggctaacctcccgagggagagcctcaccctctctccggacccagagtgaggaaggaaagatgagcaggggtgaatcaatggacttctgagtcacactttagttttcctcagaacttttcagggactgggccttcactcaagaaatttcccaggcagctgtcttgaaaactgagttcagggtgcctctaagctatctcagtgccaggtggtggctggaggagaggtgaatgccactgttagaagacactagagagctgaaggcaggcatctcattgtccgtttgtagaggatcacagtcacaattgttattccatggaactcggtgactcattggtgtttaatgttcagaaaattcatttcaaacataagatgtcataacaaagacctgacttcagggaaagcctttttctttcccacctgcttaattggtccctgctgctaaccatgactgaaaacacatgggttttacttagcaatagcgtgacattttcttttctcagacttctccggatgggggctagttcagttttggtttgaaaggacttcagtactccatgtaaaataaaagtaaaaaaagcctttttggtgtgtaaaccaaaaagtatctgagacaagtatcaatcaatttagaagtttattttgccaaggttaaggtcgtgcccgtgacacagactcgggaggtcctgagaacacgtgcctaaggtggttggggtacagcttggtcttatacattttagggagacataagacatcaatcaatagatacaagatgtacattggttcggtttgaaaaggtgaaacaactataatcgggcggggaggctccaggtcataggtagattcaaagatgttctgatttgcaattggtttaaaagagtttatctgaagacctggaatcaactgaaggaagtgtctgggttacgataaggggttgtggagaccaaggttcttattatgcagataaagcctccaggtagaaggtttcagagaggatagattgtaaatgtctcttatcagacttaaaatgtgccaaactcgtagttaattctctcctggatcaggaaaaaacctggaaaagggaaggggattctctacagaatgtagatttcccccacaagagacagctttgcaggaccatttcaaaacatgccaaagaaatacattttggggtaaaatacttcaatttctttcagggcctgctctttgtcatgtgatgctattctaggaccaggctggaatttggtgtctgactgctacaaaaaaaaaaaaaagctgtttcattagtattaagatctctattttaacattaatgttggtcagttgtgtctgaattccaaagggaggaaggcatgtcctgccccctcttcccatcatggcctgaactttggaatgcccttggcccagagaaggggtccattcacatgcttgcagagctcagagttttattcttagtttacagctgtttacaagacagtctgaatttacaatcaggaaactggaaatagagatttaccagcttcagcatgtgtccctgaagcttaaaaaaataaaaataaaaaagatttactagggatcttcgtcatgggtactaaacacatctcatttacttttgaatttggaattgttacaagtaaatattttgtattgctgcactttattttttaaaacaattccctttcaaatgttagaaatcatagattgaggaaaacactttcaaaaagaatgtgcaaccacaaccagctcatgtaacacaaatcgggtttggtgtaagaacacagcactctaactcacccatgaccaaaccaaagaacagcaactaagagatcactctgaatgagcgcactctgttctgctgacatatcagctctaacacagaaagggagaaaagaagttctcctgaataactgtgactatttcactgtgacacttacattatgtaataccatcattctccttgtaaatttctcagaatttcatggattaacagactcataaaacttgaagagcatttctacctcgatgttaatggtaaagatggatttgaatttatttagcaatatttaaaaaaaaactaggtcacagtaaattgaaccaaggaagactcagtgtctaaatggtaaataaataataaactggggccatggatgagtaaaaaacttaccctaacagataaaccatccatgattaggtcaattgcttagtttactctatttggttaattgcatatttatcatacaactacaatgcaaacattgagattggtccagagctagaacccctgccctccaacagaggacataagttcctaggcaactacctacaccaaatttgttttccttatagataatgtaaaccaaaaataaaattctaagtaccccagccaactgaatggacctctccaccaagggcattccaaagttagtgtgaaaaactagttcaggccatgatgaaaagtgaggacaaacatgcctcgttctcattacacccacgtgcctttggaattcaggcacaattcctcatcttaacgcagacattctcttctattgattccatctgcatgataggaaccttagtctccgcaaccccttatcttaacccagacacccagacattcccttctactgattctaaatctttagataataacttaacccttttcaactaattgccaattagaacttttttttttttttttttttttttttggagacagggtctcactctcttgcccaggctggagtgcagtggcatgatcttggctcgacttcccagactcaagcaatcctaccaccatagcctcccaagtagctgggactacagtcacatgccaccacgccagactaatttttttattttttgtggagacaatgtcccactatgttgccaggctggtcttgaactcctgggctcaactgatcctcctgcctctgcctcccaatgtgctgggattataggtgtgaaccactatgcctggccagaaaattcttgaattcacctatgacctggaagcccccacttccggttgtctgcctttctggaccgaagctgcatacattttacgtgtattgattgatgtcttatgtttccctaaattgtataaatccaagttgtagcccagctaccttgggcgcatgttctcaggatttcctagggttgaggatttcctgtgtcaggagtcattggtcactcatatttggcttagaataaatcttttcaaatattttacagagtttacctcttttcatcaacaatagtaaacattgcaatgtttcctaggaacaacagaaaaattatccaaatgatatatagcaatgccaatcagcaatgtttctatacttttgtcagaggcatttgaaccagacctactccatcttgaatatgggtaggtcaattaaggctatcctttaataaatatcatggatcatcaaatatgagagctacgggactgcattcccaggaggttaggcattcttagtcacaggatgagataaaaggtcagcacaagatacaggtcacaaagactttgctgataaaacagcttgaggtaaagaagccagccagaacccaccaaaaccaagatgatgaccaaagtgacctctggtcctcctcactgctcattatacagtaattataatgcattagcatgctagaagacattcctgccagcaccagaacagcttacaaatgccatggcaatgttagggagttaccttatatgctctgaaaaggggaggaaccctcagttctgggagttgtccacctctttcccggaaaactcatgaataatgcactccttgtttagcatataatcaagtgataactataagtacactcagttgagtagctcttgcctctgctctgcctacagagtagccactcttttgtttctttacttctctgataaacttgctttcacttaactctataggcttgccccaaattctttcttgtgagagttccaagaaccctctcttggggtctggattgggacccctttctggtaacactttctagctctcatatctgatggcctatttaaaaaaaaaaaatagtagcagccactcccagtgactcgcttggtaaacctgattgggtcatggatcacttctaaaggacacctagcaggcaggcagcagagaacctgttacgaggccatgaatacagacaaaatgcatgtaacctttcctgccagtgtaaggaagtcaaggaggagagtttaaaataagatgctgttcaaagtggtgcaagacacaaggaacagagatcggatgagaccacaggcaataggcaaataaaagatgcactctcttcctctgagaggtggtgacccactttcctaagagaaaagtgttttgaagactgacttcccaattttttctgccccgggaaagcttctggaacaacactttaggggctactgacaggctgctctgcttctcaccagccatgagcatccaaccccaaagcagtccccaggcttctctgtgtctcctctacaaggacgggctggggaagaccctaagctccactccctgcaccatccctagcttatgagagcagccaccatgctccctgctcctgcatttattgcaaagagcctagcttccttccagaattttctgggactagagcaaacaacctgccttattttctgaaatatcatagtggagggttgagagacactggaacttacttttctgggtggtctctccccagctttccttccagatttgcagggactaagtgctagagcctttctcctcttacatatgagagtagacctcgaattgaggtaaagccatggtccttcaatctaggcctaatattggctttgctccctgctccctggaattttgaggcaagtccagcatggacttgcctctcccactcatacaactcaagtagttcattgaggtgggtgaaagacccagaaatgtaaccaggccacactctcctacacctggaatttgtaaaccctccccacggcaaatgcatatacttgaagtccctccctcactaagtaacggagctggaaaaccctatgagacaaactagtgactagttccccataacttcgtgcactaatctttgttgcacaagcattgtatcagatcacagagagttgagaaatagaattgcaggaagcatggtccttcctttttcaggcgctcagatggctgggaaaggcactgtgcccacagaatggcatgtgcctgctctaacagggcatgcacgcacccatgagaacagaagccaggaagaacggctctgtgagcctcaggatgtgttccctggggcctcagctgagctcagtctcgtaggaagagtaattttccagagctgagaaagaacaaacaagtgacaaagattcctagcttggccaaacattagtcaggtttctttcttttctttctttctttctttctttctttttctttcttctttctttctttctttttctttctttctttctttctttctttctttctttctttctttctttctttctttctttttctttctctctctctctgtctctctctttctttccttctgagatggagtctcactctgtcactcaggctggagtacaaggttgtgatcttggctcactgcaatctctgcctcccaggttcaagcaattctcctgcctcagcttcccgagtagctgggattacaggcatgcaccaccatgcctggctaatttttgtatttttgctagaaatggggtttcaccatgttggccagactggtctggaactcctgacttcagatgatccacccacctcggcctcccagagtgctggtgttgtgagccactgcgcctggcccattagtcaggtttgtgaaacttctattaggtctacctgtgcacttccatgtaaaatctagttttagcaaagaactccccagtttcactgtgcaatcacccttgatatctgatcaggcacctcatcctccaccgcctcccaggggctgtctgatcaccctgacctgccttccgcaagaattctgtgaggtcggtttagccagaatccctctgacccctgatgtctcctcttagtcattttccatccactgaccccaccctgctccttggctataaatccccacttcctcaggctgtatttctggttgagcccaatctctctcctgcactacaagactctgttacagcagtttctaaccctattgagttggtcctgaataaagacttctttactatgctttaataagtatcatggatcatcaaatcatttatttatttatttattaccaccggcaacagaaaggtgcagtgtgacagcccacaggggcaaagggtgagtgtgctttaagggaggagagaagggtgtgggctggggagaggcccccagggaggtagggtagggctggatggtgtgtcagggatgggctgggaaagagtccttgtgccattctaggaaatttgggttttatccctcagacattggggaaccagcacaggattttaatgagaggagaggattgctttctcttttttccctttcttgcccccttttttccatcctttcttcttttcctcctccctcccccgccccaacccccgtctcactctgtagtccaggctggagtgcagtggtgtgattataacttgcggcagcctctacctcctgggctcaagcaatcctcctgccttagcctccagagcagggactactggcatgtgccaccacaccacaccttccttcttttcttccttcccaactccagcatcaggccttaggatgggcagggtgcagaagacagtgacagcagggagctgtttagaaattggcctcaggagcccagaacacaggtaatttgggccttagccaggcactggcaatggtgatgtctgtgaggcagagagctaattagggggcagaaatcatagactatactgaacaagtggattttgagagagaagggcagagttacagttccagatggtttgtatttattctaactcagagaactgggtacatgaaagagtatatagggggaggaggatcagatttaggggtcagataatcagtttgagtcaaaaggggcttagagtgctggtgaacatttaggtgaagatgtccagaggacaggtagaaattacgacaaaggtaagagctatcgatgctaaatgaagctgggggagaaactccttgatccagcaacaaacattttaaaagacagctggaaaaggagcacatggcaaagaggacagagaaggagaagacagaagaaacagagaaccaggtcagcatccgctgctggtgctgagaggaagaggagagtcagaattgaaaagggcatttctcattcccaagtcgttagttaccaagggacgatagatgggaggagcaaaaactgaggcagatccaggcctggagacacatggagagagttgtcttagaatactctttcaagaaacttatctgggatgaatgagaagacgaactggagctggaggtgggactgtgtcttttgagataggagccttggctgtgacccatacaatgtgtaaggagaggcatcacacctcttccacccctacaagttgatactctcatatttaaaatctgagttaaggccaggtgcggtggctcatgcctgtaatcccagcatttttggaggccgaggcaggcggatcacttgcagtcaggagtttgagaccagcctggtcaacatgatgaaaccctgtctccactaaaaatacaaaaaaaagttagccaggcatggtggtgtgtgcctgtaatcccagctactcaggaggctgaggcaggagaattgtttgaacctgggaggtagaggttgtagtgagccaagatcacaccactgcactccagcccaggtgacagagtgagactccgtttcaataaataataataattaattaattagccaggcgtggtggcaggcacctgtaatcccagctagttgggaggctgaggcaggagaatcgctttaacccgggaagctgaggttgcagtgagccaagattgcgccattgcattccagcctgggtgtcacagcgagactccatctcaaaaataaataaattaataaattaaaataaaatctgagttaaatttaaataattgtgttgttctggagattttttaaaaaatatcatcactggtcataagaatttgaggaatagctaaataacaaaacagaggtttctctctctgtctctcttcctttttccataacaagagaagctcatcttcttatctggtctggaatcacttgggtgacatttcaaaatgcaaattaagagccaggtgggcaggtccccaatgcgttgggatgggccgcagctgactgggcagcctcccttgagctcccaggactttgccgaagggagtggcgtccatttgcatgaggagctcaggaaaactgctcctcaggtgccgagttagagacacctagtgagcttcaccagagtagttttgaccagggatacaacaaagctcctaaaactgaaaaagcacgaaaacaaaaatggttgtgaacagggctcagcgatgacgaggctacattcagccagtgtgtgtctggtgccatggtagacacacccctgggatcctgccgccctggcacagggggtgctctgggagacagaggctggaattggactgcattgcagccaggtggccttggagacccagaagggtgcctccttgggcaaacttaatgttccccctaaagagatccctttgaagatccgcatggctttcacacaaagggcgtggggtttagttccaaaacgtaggcttgggtattatagaataaaagcaaaagagggcacaagatgtgcattttcattatgtttacttagtgaagggtgggcagacattttcattatttttgggttttttgtttgtttgtttttgagacagagtcttgctctgtagcccaggctggagtgcagtggcaagatcttagctcactgcaacctccgcctcctgggttcaagtgattctcctgtgtcagcctcctgagtagctgcgattacaggcacccatcaccacgcctggctaatttttgtatttttaatagagacggggtctcaccatgttggccaggctggtatcaaactcctgatctcaggtgatccacctgcctcagcctcccaaagtgctgggattacaggcatgagccaccgcgcccggcccattttcattatttttaaacaaaggcgagcaattcactttctgggtgcccacctgaagtagagaatcccaaccccttaccatgaaaacagataatctgttcactgagccccaaggacaaagcagccagggtcgactgaggggctactgcagccttcctctctgactcctcccacctaaccattccctcaatacctcaatacacacactcctttctttcccaagtctattgcctcttccaaaagcaatgtaagatccgccccagaacagtggggagttcttatcctttccgttacctaagcaacctgagggcaaagacctttagatcaccggcagtgctgttctttgggtaacttgatctttgcttatcagctttaataactttattatacgaaatacccagccttgatgaagtatcgatgactcactaactgtggtgtaactaattgtttcattcattctacaaacttttttttttttttttgagacagagtctcactctgttgcacaggctggagtgcagtggcgcgatctcagcttactgcaacttccacctcctaggtttgagcgattctcctgcctcagcctcctgagtagctgggattacaggcgcgtgccaccacacccggctattttttgtatttttagtagagacgaggtttcaccatgttggtcaggctggtctcaaactcctgacctcgtgatctgcccaccttggcctcacaaagtgctgggattaccggcatgagccaccgcgcctggcctcattctacaaacttttattctgcactcactataggctgggagctacactagggcctggggacatgaagacaggcgacacggtccctgggctcaagatgccagacagatgtgcaaacaagtgaaatctgatgtgatatgtgctttagtggtgccaaggataaaaggataagtgttaagaaaaagtagcaacaatatgtctgactgggagaatcaagaaaggtgtcatagagtccctaacacttgagctgagaatgagaaagagcatgagctggccaggtgacacacagagcatattccaacctaggagactgggaaatgggccaaaatatatacgtttgaggaaacaaatagcttactatataattaaatatgaggcagtttagactgggcccttatggataagtcacacccataaattttatttcatcttacaggcagtggagagcctctggaggattctgagcttcgtggtctcatcatcagagttatgtatggcaaccatcccaacctttttggcaccagggaggggttttgtggaaaactatttttccttggacagcagaggatggtttcgggatgattcaagcacatgacacttcttgtgcactttattttcagtgggagccctgagcttgttttcctgcaactatctggccccatgtgggggtgatgaagacaacggcagattatcaggcattagattctcataaggagcgcacatcctagatcccttatgtgtgcagttcacagtagggtttgtgctcctataagaatctaatgctgcctgatctgataggaggcagagctctggtggtaatgcaagcaatggggagcagctgcacatacagataaagcttcactagctcacccactggtggctcacctcttgctgtgtgtcctggttcctaacaggctacagaccagtcaggtctgtggcccgggggttgggaactcctggtgtatggaagagactactctgcagcaatgtggacaaataggatgagggtgagctgtcaggggagacaggcacacatggcagagctatttaaaaaggaggatagatgaccaggcacagtggctcatgccagtaatcccagcactttgggaggcagaggcaggcggatcacgaggtcagcagttcaagaccagcctggccaacatggcaaaacctcatctctgctaaaaatacaaaaattagctgggcgtggtgacatgcgcctgtaatcccagctactcaggaggctgaggcaggagaatcacttgaacccgggaggcaaagattgcagtgagccgagatcgtgccattgcactctagcctgggcaacacagcaagactctgactggaaaaaaaaaaaaaaaaaaaggaggatagacagggcttggggattggtggatgggtagataaggaaggaggagtctagcatgactctcagactactgacttggaccagcaggggaatggctgtgacaataaataagattgggaaaacaagaaggtgagcaaatttagaggagaaaatgaatttcatttttggcatggtgtggaaggctcgggagagaggtctaggcaccagatgtcaacgtgaggtgaaatggatatagctgaagtcaagggtgtggtgaggttttgcagggagagcagggacctccagcaaggccagtgcataagggagaatagagaaaaaaagaaccagaaaaagacaaggagaggccagagaggtgtggaaagaaccagggaagacagttattcacaacaaacaaaagagggcagagttttagagaaggaactgagcagtttggggctccaggtggggcaggagtgggtggccacggttgaggggcagtggccttcaaattggtctgggtaggttctaatgggtcagattggtcagtcctttccaggacactgaaggctgcagaggtgtgactggatgctggtggagggatgcatggcggggaagctgagtcagatcctgaaatcctccaagcatgcgcctgaaatgaccaagggaaatgaaggcggaggctgctgtcgcctggtggcctgggaagggccaagagccagggagctggagggaggagagaacgtgcgacctcagcacggagcactgtaggggaggcggggctggagggagatggcgccgcgctcccggatgaacagagaaagcgacagggtgagtcgcagggcacagtgtgggatgagtcaccgacagcaaggcatggactccgggaagaaggggagacgagccgggaaagacttgcatcggggatgtgagctgagctgcacccagacaaaagcggctcggggctcctgaaagcagcaggcaccgccggtcctgccaaggggctacttcctgcgcggagtaggagagtaggagaccccaggccagtcccaatccccggcccgtccgggatgaggggggctgcgggagctgcgggggcctcctccagggaggacggttgcagggtccctcggccgccgcccactcccgggggcgttccttcctcccagctgcgcccggagcgcctgctgcctggcgagagcccgcccctctgcaaccagcccgctgcagcggagggcgcctgggtgccctcggccgagccagcagcccacggtcggcgccgcactgtcccctggtggcggagcgctcccgcgacccggctcgccacgcctgggaggggtccaggaggacgcggctgggacctgggggctctcagggtggggccttgggggatgaggctggggcccgcgggaaaccgggctggggcgaggaggctcgcaggacttcctgccacagaatgtttcgatgctttttttaattctgcaaatgtaagcctttccactttaagtccaagctcagcgcagaggactgttctataatacatacaatttagtttaaaaatgttgcaaatgttaacatgtgtcacaaactcaagcaatccagtattatagaaagcaaagaatgaaatgtgctgcttctttctcccccagacgcccttgcatacattaagatatgtatatatggaaatgttaccgggagtcccggttatcccaaaaagggttgtttcctgttgcgtggtgaggccaatgcacgaaaccgaaagggagtgtgtcaagcagtgcaggctgtattcaatggctatggaattggaagatctgaaatcaacttagcttgtgagagctgggaagtttcagaggtagggtgtctttaatgaaggggctgggcattaagagcacgggggggaatattcgtgctttccttgggaaagaacggagatttttcccggaatcaagaaacccctttttttctgtcccttcttggtctcttccagtcgttgtcatggcgacatgttgtttagcatgagaacaggatgatgataaagccagaggctcttcagaggcgccatcttggatttcgccagcttcagctggtttcgtcctaagaaggaacttcgaaacacaggcattctttttcctgaaaataagcagagttacagctgagtaggaatttagctctgtcccatatgctatcgcattgggcagcaaaagcagggtggggtccagcgaaatcagcaggcactgcaatgagtaacatacccagccacgtttatgcagcatttttacgaaaatgaaaccatactacctgtaaaggaagatatgctaacaaacaacaaaactggcaggaaccaagattcctactgacactacccttagttttaattttccctgacaacaaatgaggttaacagagcataattatctaccgtgaccccttcaaaaagacaggctgtatacatttgcactaagagaagaaatcgtgtaatgtcagcaaatttcccccacttaaagcttctctatttaaaaagcttcacgcacacatgcacgcatatgtcttcaagatgaccacaatttattttgcagtcattctttgcaccagttcccaatttttcccactagcttgcaagctccgtgactcgaggagaccgggggatcagagtttgtttttgcggagaagtgagtcctttatgccccaaatagtgactgacatagagaaggtactcagtaaacactttttaaaggaatgcctgcctgactgaagcttaatgatgtgaggcttctagtgggataccctaccttgttttaacctgaagtgactcttccttagctaagagagccagacggactccatcgtgactccttcactcgcagccccttacccacccccttcctcaaggacttaacttgtgcaagctgactcccagcacatcaagaatgcaattaactgataagatactgtggcaagctatatccgcagttcccaggaattcgcccggttaatagcacccagagcccctgcgtttgtgtccggttgataacgcccaaagcccggcgtccatcaccttaggatagacttaaagcctctgcacctggaactgtttactttcctgtaaccgtttatccttttaactttttgcctactttacttctgtaagattgtttcaactagactccccctctcccctgtctaaaccaaagtataaaagaaaatctagctccttcttcggggccaagagaatttcgagcgctagctgtctctcggctgccggctaataaaggactcctgaattcgtctcagagtgtggcgtttctctgtaactcgctcggttacaacactaggttaatctttttcctttaactgtttgtttaaaatatattatgtttaagaccttctaactggtcagcctccaagatagtattgtgctgggcttgctttattctggtttggtttccatgatcccagttcatgtgttacctgcttctcttttgaattcacaatgatacacaacttttaatttgttagaacacaaacataaggaatttttttttccattttaatgtgagatatgacagaggcaaattgtttcttaaagacataaaataattaaaataattacataaattgtaataaaataattattacaatgttctatctttggcattaaggcatagaacaattttttaatcctaaactaggctgggcatggtggctcactcctgtaatcccagcactttgggaggctgaggctggtggatcacttgaggccaggagttggagaccagcctggccaacatgatgaaaccctgtctctactaaaaatacaataaaaaatttagccgggtgtgatggcgctcacctgtagtcccagctactcaggaagctgaggcaccagaatcgcttgaacccgggacgcggaggttgcagtgagctgagatatagcgccgctgctctccagcctgggcaacagaatgagaccctgtctcaaagtaaattaaataaataaaatcctaaactgtaggaccaagatttgattcagaaaagagactttcttgtactaatttatacactgttcatgtcagatccaatctttctttttattagatgaatctggaaaagcaacttagaataattcaatcagtctaaaagaataacagctgatgagatgcagtcaataagcagttttgtattagtatttttataagaaattagaaaaacatgattttgggggagatcttctcatagttaacagcacatataacatataagttagaaatgtactctgctagctcataagattttaaagcagggattttagtgtcattaaacttttatttataatagtttttttaatacaatttttttttttactttggaataactttagattcacaggaaagtcagataatacaggtagttaccatattcccctaacacagtttcccctaatggtaacatatcaccatggtagtgttgtgaattcttatgttgggttgcctccacatccattttgaatatacattggactttcccacaccaaaatcaaggctcagtcaccccggacaaagttgctggttctccaccttctcccagttctgttatgtggtggatccagatatctgcctcatacaactatctcctgttgaccacttctctatggcacagctagaacctattggccacactgaccctcacaccccacctagaatgtgcagatgcgccacagggcccaccactcagtcactgtgccacctcctggaactcatgcctgcttgctgtaaacccaccgaataaaactccccatgggaaacctgtttggataacaccctggacccaataaaggtgttggcccatgggttgctgtcttggtctctctgcctgcactccctgatttccatgaaggtggcctccaagtatgccatgtgccccaggatctgtaagtaataaactatttctagcctgtgtctctcctaatcgttgtaggggtgctccgcatcttgaagatcttaaagtaaaacagatacatttgtggaaactaaggtcccaacgttgtacattactattaactccaggcttcatttgggtttcagttttttcattaatatcagcctaagtttttaaaaaatagtcagccgaaaagaaggatttaattttatgtggtaatttctgcacaaacataatattcttgagaaacatcttgtctatcaataacatgtttaactatatattatatcaatatgctcaagaaatcaggccttggtaaagatttttcttttttttttttttttttgggacggagtctcgctctgtcgtccaggctggagtgcagtggcacgatctctgctcactgcaagctccgcctcccgggttcaggccattctcctgcctcagcctcccgaatagctgggactacaggcacctgcaaccacgcccggctaattttttgtatttttagtagagacagggtttcaccatgttagccaagatggtctcgatctcctgacctcgtgatccgcccgccttggcctcccaaagtgctgggattataggtgtgagccaccgtgcccggccccaagatttgtctttactaagtaatgcatgtgaaatataataactgacaatgataatacagtgaccaggtaactcaaaaattataagtcattcaattgaataacatagtgtttttgaaatgtaaaaagataaatataaataataagtcatattaagacaaaatttatttaactgataaaagtaaaatttgttattctctctagctgtatagataagacaggatctctatagtgcattatttcaagacttacttagtaggaaaaccagtaggtttgatttttttttaaatgccactttggttttaaagcactcgctttgtccactagttttctagatctgagtattggctattaatgacatatttctaaattatacacatcaataatgtgacaatagcttcaggtcaggaactactgtgtgatttagatgtttgttccttccaaacctcatgttgaaatttgtttcatcttttttcttgttttcatagataagggcctcgctctgttacccaggctggagtgctgtggtgtgtttgtgactcaccgtagccttgaactcctgggctcaagcaatcctcccacctaagcctctggagtagctgggactacaggtgagcaccgccaagcctgacctcaagttgaaatgtgatcaccaatgttggagtggggcttaatgggtggtgtttaggttgcagggccagatccttatgaatagatgaatgccctccctcaggggtgagtgagttcttccagagctggtggttagaaacaatccttgacctccctcctttctctcttgcttactctcttgccatgtaatctctgcacactccagttctccttcaccttcctccatgagtagaggcagcctgaggccctcaccagatgcagatgcccaaccttgaactttccaaccattcagagtcattagccaaataaaccttttatctttataaattactcagcctcaggtattcctttatagcaacacaaaacagactaagacaggaacctacactccttagaagaaggccatatgatataagggtgttgagtctaagattttagtgtctacacttcgtcttacattttccattctttccattttcacaagtcctatgatacagttgaaaatctttcctacgcactagtaaagccataggaacttaaaattattaagtgtcaagcacatatgaaaatcagacaatgtgcaaagaaaaacgggctatgtgttgcatgagaacgaggaactaatgttcagtttagggatatgaactgttcagaaacttggtctgatcaaagttatgtcagccttaatagtaatctgactgataaacaactaatacttgaaagacggtactgatatggactatttcacctggagattgtttacttgataacttttttttcaagttctgcaaggtgatttaacatccaaaaatatatagtcaatcctgggtattcatggaggactgggaccaggacccctcaaatatatcaaaatccacagatgctcaaatccctgatataaaatggcatagtattgacacataacctttgcacagcctcccatatactgtaaataatctctagattacatatagtacctaatacaatgtaaatgctatataaatagttgttacactgtatttttatttgtatttttttattgttgtattgctttttctttcaaatatattccattggaggttggttgaatcagcagatatggaacacacaaatacaggaggacaactatatctaaatctagattaatgtaagcggtgagaaaatattttatctccgtctaagtaggtcctaccagaggggaaactagactcactcaaagattgctttgatcaatccacacacagttcagtgatggacagagtgtcagtatctgttatatgtgtcactatcccatgctagaggtgtcaatagattatgtaacctttctgaggaatcacaatacaataattgataataatattgatcacataaacatagacttccttgacacaggattgccacagaccttcaatttgtaaaaaaaaaaaaaatgcaacatctgtggaagtactataaagagaagcagaataaggcagatatgcctgtataagactaagggagaatcttaaaagctgcaagagatgtacaagggatcctcaataaatccatacatctgtggccagtgaatttttgacaagagtgccaagtccattcaatgatgaaataatagtttctttaatatatgctgtgagagaaatggatttccacatgcaagactaaagttgggctccacttcacaccatatgtgaaaaataattcacaacctaaatataagaactaaagccatatagaggaaaacgtaagagtaaatcttcatgatcttgtgttttgggttcttagataagacactaaaagcccaggaagaaacaacaaaaaataggtaaattggagttcataaaaaatgtgaaacttttatatcaaaggacattttcaagaaagtgaaagacaacctacagaatgggagaaaatatttgtaaatcctatgtctgataacatccagaatatgtaaagaacacctacaactcggccgggtgcggtggctcacgcctgtaatcccagcactttgggaggccgacgtgggcggatcacctaaggtcgggagtttgagaccaggctgaccaacatggagaaaccctgtctctactaaaaatataaaattagccaggcgtggtggcgtattcccgtaatcccagctactcgggaggctgaggcataagaatcacttgaacccaggaggcggaggttgcggtgagccgagatctcgccattgcactccagcctgggcaacaagagcaaaactccgtctcaaaaaacaaacaaaaaacctacaactcaacaacaaatagacaaacaacccaattaaatggtcaacaaaggacttgaatagacatttctccaaggaaggtatacaaatggccagtaagcacatgaaaagatgctcaaagtcattagtccttagggaaatgcaaatcaaaaccacaatgagataccacttcgcacttgctaggatggctataatttagagggaaaaaaaagaaacataacaaatgtgcgtgagaatgtagagaagttggaacctgtgtacattgttggtgaaaatgtgaaatggtgtagacgctgtggaaaacagtttggctgttcctcagaaagctaaacatagaatgaccatagaattgtaataccgacaattccactccaaggtgtataaccaaaattattgaacacagggactgaaacagatacttgtacaccaataatcattgcaatattattcacaatagtcaaacaacagatgagtggataaacaatgcctggtacccttccttccttccttccttccttccttccttccttccttccttccttccttccttccttcctttctttttctttctctctttcttctttcttttctttctgtcagtcttgctcttgttgcccaggcttgagtgcaatgacacaatctcagctcaccgccacctctgcctcctgggttcaagtgattctcctgcctcagcctcccgagtagctgggactacaggtgcacaccaccatgcccagctaatttttgtgtttttagtagagatggggtttccccacgttggccaggcggtatacacatttttctattattcggccataaaaaggaatgaagttctgatgcatactacaacatggatgaaactcagcaacaaggtttttgaggaaaaaaagcttagtgaaaaggccacatcttgtaggattccacttatatgaaatacatgcaatagacaaattcatggagacagaaagtagattagaggctaccaggagtggaaggaggggagaatggggatttattatccaatgagtgcagtgtttctatttgtttttgtttttgtttgagacagggtctcgctctgtcatccaggctggagtgcagtgccacgatctcagctcactgcagcctccgcctcctgggttcaagcaattctcctgcctcagcctctgagtagctgggattacaggtgtacaccacctggcaaatttttgtagagatggggtttcgccatgttggccaggctggtctcaaacttttgacctcaggtgatctgcatgcctctgcctcccaaagtgctgggattacaggcgtgatctatggcccctgacccaagtgtttctatttgggatgatgaaaacgttttgaaaataaatagttgtaatggttgcacagcactctaaaggtaatttatgccactgaattgtacacttaaaatggtgaaaatagaaaatttcatgttatacagattttgctacccaaaaaacaaaacaaaaaatccaaaacctttatgttattatgaagaagcagttttccaaaggaatagggatgctggtagcagaagggaaagaaatctcattaaataaaaacaaaagcaatgacctcttcaggaggtggctcagctagtttagctttaccttagcaccatgatggttcattttattcagaaatagaaacatggggcgttggggagaagaggagatgtgtacctgcctcacctgcctccctgcccagaatgccgactccgactcttgctttccactaaggctggggattaaatgaaaagtgagaatctggaaacccccagagatgatgtttgtcgttggagctgattttatctcattttagtagcatgacctcctcctcaaactcaggatgcaattatggtcaatctcattagtgtgcagtaattgctcagccccaataccagattagcaggaagttctgttattttccttttgaggatgggctcctactgaactgtcctggaatctaccaccattcaggttacaaaagacccagggaactaggccagtccagctcccaaccccaagcagggagcaacttgctcagtccacgttgtgatagctcctcgctgccacaaggtggtgatgttgcatcacacacgcgcatgatgggcgcgcaggcgccaatgctcccaggacctgctgttccattcctaaatgaaagttgttcccaggatctggactcacaagacaaggcagcctattccctgctggggagctcaggggcaagagggcatctcggagggagggcacattctcacctctgaagacaaggagaacatcatcagcacatagaccaatcccagcagtgcaccttaggatggggagggccactgtgagttacagcaaaatgaacgaatgaatgaaccaataaatgtctgagagggaaagtcccaacgaccctcaggaggtacaatcaagagttgcagttattttcgttaggaacgttctaaacacaggggaaaccttccttccttctgctctattgttggagtggggccatcccgggacaccagaaatcaaggaattgagtttggagaagggacttggggaggtcacagtggcaggtgactgccaaatgaggtggcagaagccagcaagcgctggaaaaagtcggcccaaactgttcaccagcaccgccccccataactccccaccggctctggtttcaagactttccgttttctaggtatttccttggccttaaaccattttcctttaaacgaactttttctgtgaagccatccggtttcccccgatagtggcatctcacaaaggacaatccagtatcccaacagcgtgttgcgttccgcgggacgcagatttccttcacaggcaccccccgggttgcgtttttatagccacacccacccgcccccctatctcctgggcactgctaatgagtcctgcatttctctcctttggtctttggataaatgaaccatccgtgcgtgacctttgcgagggcatcttgcataataccagtacaccagcggcgccgtcggtgagtgacctttgggactggtttctctcaccagcgtaactccccgggagatccgagcaagctgatgagtgtatcagtggctcattctttctgttgcaccacggaccctcattctgtaaccgggataccagccagagatggggagcgggaggcgcagggcaggggcgtccctcctctcagcacagcctccccgcgctggatttctatcaatccagtttccacctgcctggaagtcagcagggtcctccccagtcccagatcgccgggcgaggccccagatggacctcaggggcggggagtgggcggagcttaggggccgaggcgaggtgtgggtggggcgggacgccgctgtggaggcggggcctgggcgcggacgggcgcggagcgaggcaccgcaccgccggggcggggagtgggcggggctcgggggcggggcggggtgtgggcggggctcacgggcggggcgggtgagtgggcggggcctcggcgtggtaggcgcgctgcgtaaagaggcctgcagtcccgcggcgcggggcaggttccgggctgcttaggttggcaccggtccgtggtccccgggggcgcagtcgcagcgctcccgccctccaggcgtcagcgagtgcgcggtccagtgcggccggaacctggcgcaactcctagagcggtccttggggagacgcgggtcccagtcctgcggctcctactggggagtgcgctggtcggaaggtgagtgatcccctgtcggggaccgggggacttgggaaggacagttcccggactggacggccagaacgctctcagggatttcagctggccggccatatggccctgtgggtcgtcgcgcccgggccagggaccattctgtacataggatcgtgcttggctctcacggaacgcgcccacacgcagggtcccggtgtcgaatcgtctggtggaatctgccctcaaccctatggagcgggtgctggtatcatagtcatattacaagtaggaatcagcgggcccaaggtcagtctgtaaagggggtaccggggtttaggcccgtgcgctgcccagcgctgccctgaaggcgcggctgaaccactggtttgcgctgcctttgtcaaggacattgtggcactgtggaaaaaatgaaaaatcagcttctctaacctataatctctctgggaaaaaaaaaaatcagcttttttttttttccccgagacggagtctcactctgtcgcccaggctggagtgcagtggcacgatttcggctcactgcaacctccgcctcccgggttcaagcaattctcctgcctcagcctcccgagtacctgggattataggggcgtgccaccacgcctggctaattttttgtatgtttagtagagacgggtttcatgttggtcaggctggtctcaaactcctgacctcgtgatccgcccgcctgggcctcccaaagtgctgggattgcaggcgtgagccactgctcccggccctctttttcttttttcttttttttttagaagagtctcactctgttgcccaggctggagtgcagtggggcaatctcagctcactgcaacctctgccttccaggttcaagcgattctcccccctcagccccttgagtagctgggattacaggcgcctgccaccatgcccggctaatttttgtatttttagtacaggtgggagtttcaccatattggccaggctggtcttgaactcattcttcttcctttctttttcttttttttttttttttgagatggagtttcactcttattgcccaagctggagtgcaatggcacaatctcagctcactgcaacctctgcctcccgggttcaagctattctcctgcctcagtctcccgagtagctgggattacaggtgcgtgccactacacccagctaatttttggtatttttagtagaaatggagtttcaccatattagtcaggctggtctcaaactcctgacctcaggtgatccgcctgcctcggcctcccagagtgctgggattaatgaaccactgcgcccggccaaaaatcagcttctttaacctttaatctctgaaaaaataaatcagtttaacctttaatctccgaagatcacagccaaagaaatacatgaaaaggaacaagtattaaataatatatacttctagctgtgctgtttatagttttgggaaaaaaatggaaataacctaaggtcccagaaataggaaaatgggcacaaaagggtatgcaggcaatggtttagctgccgcatgaatacacactgaatacactgtgagatgttgtctgttagaatgcccagcacggggactgtccacatggaaagaggcacaggaaaaaaagtgaaaacattataaaataacttcttaaaattaaataatgtacacgtcaaaaatatcagagcccacttgacctggtatatacagtttaataaccacatggctcttttttcctgtaggcctgggtaggtgcatagtttctaaaaagggagagaactgtcactgctgtggatggggtgccaagggaagtgcctggggtcaagtgaacagtgacacaactgcaagtcaagagcctgtgttggagtctttccccactatttcaaatagtatagaaaatagagctgagtcactcaaatagagctgagttagtcactcagctcttggacctcagattcttattcttaaccgctagggggatggagacagaagtcacaaactcacatgccaccagccatatgatgtaaacatgtaaactgggccaaggaatacaaaagggagtggtgagctggggacactgaagaatggatgccctg

SEQ ID NO: 56 - DNA, 1366 bp, Homo sapiens
  source 1..1366: mol_type = genomic DNA
atttaactgaatggtatgtaacaggtgtagtttctaatgagttcttttcttcccctgtggctttagcatggcacattacacttctgtggatttaaagtccttgcccctcagatcagctttgctcctgaaattgcatccgaagaagaaagaaaggggatggtggctgcgtggtcccagaggctgcagaccatctggaaggaagagcccatcccctgcacagcccactggcacttcgggcaataactctgtggcacgtgggcatcacgtaagcagcacactaggaggcccaggcgcaggcaaagagaagatggtgctgtcatgaaataaaattacaacatagctacctggggatacttttttctttctgttttttgtttgtttttaattttagctttaaggagcacatggccagtactgtttcaggggaatattgggtggcgctggggtttgggcttctattgatcccatcacccaaacagtgagcatagttcccaatagatagtttttcaacacttcctttcctcccttccttcccgcttttggattcccagcatctattgatcccgtcttttcacccctgtgtacccaatgtttagttcccacttataagttagaacatggggaatttggttttgtttctgtgttgattcacttaggataatgacctccagctgcatccacgttactgcaaaggacaggatttcatgtttttttatggctgcatagtattccatggcgtccgtgtaccacactttctttatccagtccactgttgatgggcacctgggttgattccatgtctttgctactgtaaatagttctgtgatgaacatacaagtgcaggcatcttttcatagaatgattttttttttccttttggtagatacccagtaatgggattgctgggttgaagggtaattctatttttagcaaactagaaatatttaatgaagtacatgaatgagtgtcttcagaattgtacacagtgagatcaaatattttaataatgagcttgttatgttgaattctattctgaccatcactcactgagattttcttttctttctttcttttcttttctttcttttttaaagagacagagtttcactatgttgcccgggctggtctcaaaccccttgcctcaagtaatcttcccaccttgggcctcccaaagtgctgggattgcaggtgtgagccaccacacctggcccagattttctttaatatttgtctaatatctttccatctccctatattcaagcttcatgtaattttattttctggtaattctctgagcatagagctggatttgctagtttttttattttatgactcaacatgacagtttctatttttcatagaaaag

SEQ ID NO: 57 - DNA, 7227 bp, Homo sapiens
  source 1..7227: mol_type = genomic DNA
tgggttcatgactttaagaattatttgaagcaaaatttgtaaaaacaagagggttttgcctccaatttatttacttatttattttattttcatcttttattttaaattcagggatacatgagcaggatatgcaggtttgttaacacaggtaaacttgtgccacggtggcctgctgcacagatcatcccatcactaaggtattaaacccagcatcaattagctattcttcctgatcctcttcctcctcccaccacctgccctctgacagaccccagtgtgtgttgttccctgccttgtgtccatgtgttctcatcacttagctcccacttacaagcaagaacacgtggtattttgttttctgttcccgtgttaggttgctaaggataatggcctccagctccatccatatccctgcaaaggacaaatgagataattctcattcctttttatggctgcatagtattccattgtatctatgtaccacattttctgtatccagtctatcattgatggacatttaagtttatttcatgtctttgctattgtgaatagtgctgcaatgaacgtatgcgtgcatgtgtctttaaaacagaatggtttctattcctttggttgtatacccagtaatgggattgctgggtcgaatggtatttctgcctctaggtctttgaggaatcgccacactgtcttccacaatgattgaactaatttacactcctaccaatagtgtaaaagcattccttttgctccacaaccttaccagcatctgttgctttttgactttttttttttttttttttgagatggagtctcactctgtcgtgcagtggcgtgatctcggctcactgcaagctctgcctcccgggttcacaccattcttctgcctcagcctcccgagtagctgggactacaggtgtccgccaccgcgccttttttgactttttaataatagccattctgactggtatgagatgatatctcattatggttttgatttgcatttctctaatgatcagtgatgttaagctttttttcatatgtctgttggctgcgtgtatgtcttcttttgagaggcatctgttcatgttctttgcccactttttaatggggttgttttttcttgtaaatttaagatccttatagatgctggatattagacgtttgtcagatgcatagattgcaaaatttttctctcattctgtagcttgattaccctgatgatagtttcttttgctgtgcagaagctctttagtttaattatatcccatttgtcaatttttgcttttgttgcaatggcttttggcatcttcatcatgaaatcttcacctgtgcctttgtcctgaatggtattgcctaaattttcttccagggtttttatggttgtgagctttacatttaagtctttattccatcttgagttgatttttgtatatggcttaaggaaggggcctagtttcagtttttctgcatatggctagccaattctcccagcatcatttattaaacagaatattcttcccccactgcttgttttttgaggtttgtcaaagatgagatggttgtaggtgtgcagtcttatttatgccttctctttctgttccattggtctatgtgtctgttcttgtaccagtaccatgctgtttggttatgctgtttggttactgtagccctgcggtataaagttgggtcacatgatgcctctagcttttctctttttgcttaggattgccttggctattcgggctcttgtttggttttatatgaagtttgaaatagtttttactaattctgtgaagaatcttaatggtagtttaaggggaatagcaatgaatctataaattgctttagatagtatggccattttcatgatactgattcttcctatccatgagcatggaatatttttccatttgtttgtgtcatctctgatttctttgagcagtggtttgaagttctccttaaggagaactgttcacttcccttgttagctgtattcacaggtattttactcttcttgtggcaattgtgaatgggagttcatttgcgagttggctcttggcttgtctattgttagtgtatggaaatgctagagatttttgcacattgattttgtatcctgagattttgctgaagttgcttatcagcttaagaagcttttgggctgaaacaatagggttttcaagctataggatcatttcatctgcaaacaaagatagtttgacttcctctcctcctagttaaatatgctttatttccatctcttgcctaattgccctggccagaacttccaatactatgttgaatgggagtggtgacaaagggcatccttgtcttgtgacagttttcaaggggagtgcttctggcttttgcccattcaatagaatattggctatgagtttgtcatatatagcttttattattttgaggtatatttcttcaataatttattgagtttttaatttgaatgtatgttgaatttatcaaagggcttttctgcatctgttgagataatcatgtggttttggtctttagttctgtttgtgtagtgaatcacatttactgatttgcatacattaaaccaaccttgcattccagggacgaagactacttgatcatgctggataaactttttgatgtgctgctgtattcagtttgccagcattttgttgagaacttttgcattggtgttcatcaataatattgacccgaatttgtcttattgtcaggttttagtatcaggatgatgctgacctcataaaatgagatagggaggagtccttcctttttaattcttggaatagtttcagtaggaatagtaccagctcttccttgtaactctggtagaattcagctgtgaattcacctggtcctgggctttctttggttggtaggctacttattactgccccattttcagaactcattattaatctattcagggattcaattcttcctcgttcagtcttgggagggtgcatgtgtccaggaatttatccatttctcccaaattttctactttatgtgcaagaggtgtttataatattccctgagggttgtttgtgtttctctggggtcagtggtaatatcccccttgttgtttctgattgtgtttatttcaatcttctctttcttctttattaatctagctagcagtctatttaattagtttttttttcaaaaaaatcctagatttgttgattttttgaaggcttttcatgtctctatgtccttcagttcagctcagatcttggttatttcttgtcttctgctagctttgaggtttgtttgctctaggttctctagttcttttagttgtaatgttagattgttaacttgagatctttctagcttttagatgtgggcatttagtgctataaatttctgtcttaatgctgctttagctgtgtcccagatattctggtatggtgtatctttgttctcatgagtttcaaataactctttgatttctgccttaatttcattatttactcaagagtcattcaggaggagaaggttgttcatttccatggtgttgtgtggttttgaatagatttttttttttttttggagacagagtctcatcactctgtcacccaggctggagtgcaggggtgtgatatcagctcagtgcagcctcctggattcaaatggattcccttgcctcaggctcctgagtagctgggattacaggtgtcttccaccatacctggctaatatttgtatttttagtaaagacagggtttcaccgtgttgcccaggatggttttgaactcctgaactcaggcaatccacccacctcagcctcccaaagtgctgggatgacagctgtgagccactgtgcctggccttgaatagatttcttaatcttaagttctaatttgattgtgctgtgctatgagagactgttattatttcagttcttctgcatttgctgagagtgatttacttccaattatatgatcaattttaaagtaagtgctgtgtggtgatgagaacaaggtatatgcctttgttttttggtggagaggtctatagatatctatcaggcccactttatccagagttgagttctggtcctgaatatttttgttaattttgtgtctaaattatctgtctaatattgtcagtggggtgttaaagtctcacactattattgtgtgggaatctaagtctcttagaaggtctctaagaacttgctttatgaatctgggtgctacagtattgggtgcatatatatttaggatagttagctcttcttgttgaattgaaccctttaccattatgtaatgcccttctctgtcttatttgatttttgttggtttaaagtccattttgtcagaaactaggattgcaacccctgctttttttctgttttccatttgcttggtaaatttttcttcattcctttattttgaacctatgtgtgtctttgcatgtgagataggactcttgaagacagcacactgatgggtcttggttctttatccagctttaaaagactctatgtcttttaattggggcatttagcccatttatatttaatgctagtattgatattgtgtgtatttgatcctgtcatcatgatgctagctagttattttgcagacttgtttatgtggttgctccatagtgtcactggtctgtgtatttcagtgtgtttttgtagtgactggtaacagctttttgttttcatatttagggcttccttcagttcttgtaaggcagatctggtggtgccaaattccctcagcatttgcttatctgaaaaggatcttatttcactttcagttatgaagcttagtttgtccagataagaaattctaggttgggggccaggtgcagtggctcgtgcctgtaattccagcactttgggaggctgaggcaagtggatcacttgaggctagaagttcaagaccagcctggccaacatggcaaaacctcgtctctactaaaaatacaaaaattagccaggcatggtgatgcatacctgtaatcccagctacttgggaggctgaggcacaagaattgcttgaacccaggagacagagttgcagtgaaccgagatcacaccactgtactccagcctggggtacagaggaagactccatctcaaaaaaaataagaaagaaagaaaaagaaattatgtgttggaatgtcttttctttaagaatgttgaatatctacccccaatctcttttggcttacagtgcttccattaagaggtctgctgtttgtctgatgggcttccttttgtaggtcacctagcctttctctggttgcctttaacatttttgcctccattttgaccttggagaatttgatgagtatgtgtctacggaatgatcttctcatggagtaccttactggggttctccgcatttcctgaatttgaatgttggcttgcatagctaggttggggaagttttcctggacgatatcctaaaatatgttttccaaattggtttcattctccctgtctcaaagcaagagttttatacaaattggtttatatctgttccaacctatagcacactcaaccaatattcagctattaaacctgattgtacaaaacaataaaattggttgaactaatgctttctctcatccacagagtactcacacatacacataaaagtatgatagtaggtgcttttagatgtatttctcagctaaaatatgacaagtacatgaagttttaattatacccctttcagaagaaattttccctttcaattgccctaccaactccaaatgtaccaacaaatttcccatgaatcacagacagactattataaccacttgagaacaggaacacagctgatgttctcacttttattttctcaggacctagaagaataatatttaacccataatagatggtcaaaattaacaccacacacacacacacaagcacacgtgtgtacacacacataaattccaatagttatctaaggaaaagtatagaatgaagacaataacagaaacattagtcttatttcttttggtgccacactcttcactttgaaattccctggattcatctctccattttttcttctttctttctttctttcctttcccataatgtgacaaattttgaggtggtaggaatttaaacatgagtaagtcatgtttcccaccatcagatgaaaacaggtatatatacaaataaataatgtgatatacttgaaatgatgacatactttttaattacatggaggttgactctgtttttattcccagctgcttcaaactggagtctatcaatgtgtctattataagaaaattctgctaaaataaaataagcacatgccatatagagatttttataaaggcattctccttgtatcacaataataaatatttcagctagttacatgagcaaaagaattcaccctaacgtaccctccagagcagatcatctgcaggtctaaactgacaaatcctcagctacaatgacacttgcagaggatttctctcttttgaggagtggaaagctggcatctatgtgccacattctctagaattaacatcctttccataaaattactcaagatatttcagagcaatcactcagaaatagttatttatacaacttacttaataatataagtgatggaccacctctaatttaagtgtgttccagtgctttccaccgtgtcctgccttggctacagatattccaccctatcctgtcagtgaccaatctatcctacttgagagaatcagcactggcatatggagggaaccatctggaatttctgttgctcaatgggtggctgatgggggagctgatctggaaagaggctccaaaaagaattaatgagttccagatgtaattaaagactgcttttccccccaaaggggctcaggactagccatggggtggtgcctcttggttccgaattacaccctttaaccacttgttcatccatcaagcactaaacaccaccatctttatcctagtgtgttttgccaagcagtgttttggctttttggtctttttttcctgaaagtgttctatttttacaattagaacactaaagctttaaaaataatatctggaaagttaacaataaggagaaacccctgaatttatccctgcaccaaatgcaacaacaacaacaacaaaaaagactcagtgttttattagaaatgcattaactagcctcaagaccagaaaacctgagccagactgaaagacagatgtctctgaaagagggctgg

SEQ ID NO: 58 - DNA, 17162 bp, Homo sapiens
  source 1..17162: mol_type = genomic DNA
tcctttcattctcctctgcattgctaatattctcttcctaggaaaattaacctcactcattcattctctctctgtctttctccctctctctctcctcctcctctccccccaacacatagtcacccacacatacagtcacccacctgacctgcctcccacacacacttagaatacacagagtgtagagcttagaaaagagctgactccagtgcctagagaacaaagtccaaattcaaataagtatctaatcctctaccctacaagtggtctcccagcctcatccctcgcttctccccataattctgctggatcatgtgccatcctcaagctataccaaaagccacagtgtcccctaacataccctgacttgtatgcacgtgttttttctctcctgagcagtccagttgttttccaaggactgtctccatttaaaatctctccagaatgatcttcttggaccctggagaagctatcttctctcagtgctgccctgcgctcagtgcccactgcttttgtgctccatatttacatcaatgtttcaccttgctagagtgtgagttttaaggacaaggactatatggtagtcacatgtatattacaagtcactagcacctctcctggtacataatgagcacttgccaaattaattagaccaaattcatgaattagacccatttattacccgtatgtaacaagcaacaaacaaatgggggatgtcagtgacaccaaaatgctttctcttgcctgaaagtttataatttctttgcactctgttaaaactatttcgtggtttttttcaaatattatagaaaatattcatcaaggtataactcaaactcctgccaccatgtctgccagcagaatgtcagtagacctgcttcaataaattgatagcacttatttataatttgcagcccccatttgcatgcaaataatgtgctacagttcataaagttgatttttctcttaagttaaatattctacctacaatgttgttcatgtatcaattaatgaagttttactatattcaacccataaacatttattgagccaggtactgtgctagacccttaggataaaatgacaaataacataattccctgctctcaagaagctcactgttgaaaaaaaccaacacacaagccaagcattacaatgagacaggcttgtttcttttcttacaagggcaaaatgtggacgtttacaagagaaggtagagaaaatgaaagctaaaaggtagcagttgtaggaatacttatcagactatgatcttacttgcagaaatatctcattacttggcttttaaaagcaatcatgcaaacttttgatactctgaacagtacagactactcaacatgatccctattataaccctttatctgtgagccaaatatcattgaaatctatgaacaataacaatacagtccacttgaagaaagtaactagattcctttaaatatcaagatggtagaatgtttacaattaacagcctttagtagcatagcaatatttgtccaaatcagtcagctttttaaaatgtctaaataaactgttggaggaaaaaataaaaagttaagttcctatattttggtcaaaaatgggaaaaagctacagcgtttataacctatttggaacacatgcctgcctctaaaaaggaatcactataaaccctcacaagaaacctctgacacaagatcccctgataaacactcaacctgcatgctcttcccactacactctacctctactccgattgcacagagtcttgcaaaaacctctgtgcaacccaagctcaaattcttcaaaggcactgcggtacagagcccttttagagaggctccaaagctcaagctctccctctccctctccctctccctctccctctccctctccctctccctctccctctccctccacggtctccctctgatgccgagccaaggctggacggtgctgctgccatctcggctcactgcagcctccctgcctgattctcctgcctcagcctgctacgcctcactggttttcgttttttttttggtggagacggggttttgctgtgttggccgggctggtctccagctcctagccgcgagtgatccgccagcctcggcctcccggggtgccgggattgcggacggagtctcgttcactcagtgctcagtgggtgcccaggctggagtgcagtggcgtgatctcggctcgctacagcctccacctcccagccgcctgccttggccccccaaagtgccgagattgcagcctctgcccagccgccaccccgtctgggaagtgaggagcgtctctgcttggccacccatcgtctgggatatgaggagcctctctgcctggctgcccagtctggaaagtgaggagcgtctctgcccggctgccatcccatctaggaagcgaggagcgcctcttccccgctgccttcccatctaggaagtgaggagcgtctctgcccggccgcccatcgtctgagatgtggggagcacctctgccccgccgccctgtctgggatgtgaggagcgcctctgctggccgcaaccccgtctgggaggtgaggagcgtctctgcccggccgccccgtctgagaagtgaggaaaccctctgcctggcaaccgccccgtctgagaagtgaggagcccctccgtccggcagccaccccgtctgggaagtgaggagcgtctccgcccggcagccaccccgtccgggagggaggtgggggggtcagccccccgcccggccagccgccccatccgggaggtgaggggcgcttctgcccagccgcccctactgggaagtgaggagcccctctgcccggccacgaccccgtctgggaggtgtgcccagcggctcactggggatgggccatgatgacaatggcggttttgtggaatagaaaggcgggaagggtggggaaaaaattgagaaatcagatggttgccgggtttgtgtggatagaagtagacatgggagacttttcattttgttctgtactaagaaaaattcttctgccttgggatcctgttgatctgtgaccttatccccaaccctgtgctctctgaaacatgtgctgtgtccactcagggttaaatggattaagggcggtgcaagatgtgctttgttaaacagatgcttgaaggcagcatgctcgtcaagagtcatcaccactccctaatcttaagtacccagggacacaaacactgcggaaggccgcagggtcctctgcctaggaaaaccagagacctttgttcacttgtttatctgctgaccttccctccactattgtcctatgaccctgccaaatccccctctgcgagaaacacccaagaatgatcaataaaaaaaaaaataataataataaataaaaaataaaaaaataaaaaaataaaaataaaataaaataaaataaaataaaataaaataaaaaaaagagaggctccaaagtatccacatcttaaccacatcggacgcctttgcccagcctccctgaggctcccacaacacattctgaaatctcagacattgcttaagcagggcccaggaagcctttgcaagacaaaggaaggaaacacagtgaagtgtaccgttaacaaaacccaaaatcaaaaggaagtccaagtcgttgtcaaatttgtaattggtagctccattattaattaatttgtcagagaatttaacacagcaggactatccacagtcataactgcacaagtaaattgagactaggttaaacaaaatttttttaaatttaattttctacgtacctacagaggtgagaactgcctagactacaaaaaataagggggcttgcttgtattgatattttaatctgaaacatcattattgtgtaaacggaatctccttttacattagttttcagagacaagactggaaacagcatatgagcacataatcatatcacagtgtgtttctctctcaaaagccgaaccttctgccttaacactttcacagactcctccaggcctgcttcaaacagacaaaacactcctcctaaaactcaaagaaacatcgcaacacctttgtaataggcctatttcccaagagggggcagataaaaggacaaagcaaattaagggaaatgcggaatataaacttgaaacctactgtcaataaaacccaaaacaaactcgaagcggaggtgaagaaagcagggggaggaaaagcaatgttaaatggtcatctttcttctcattttatttgaggaagttaagtttgcacagctccttacaagctgtctttggctaaaatcactattaatgagctttgacgtttgaaatttaactgagcacaagctaacagcttccagcactgcaccacccatgaagtcaactggaaatattttgctagggcctaacggtgtgtttattgaaaaggcacagctttcaagagaaagtgtttatagcaaccactttacctgctatccctgctctgtgatgtctgtttggttttagggtttggggggtcctctttaactctttctagtcacactgttctaattgttttcaagtctagcaggagaatgttaatgaagttctttgctctacagcaacctggattataaggacagatttgaaaactctgagttatgacaaaggggcaggccacaaggcaaaaagaaaaaagcccatagagaggcttcagctctagcattcgctcattagaaagacaagataaaaacacgtattctttatgggtaatgccattaaaattatcctttcccaaaagagaacacagtgactagatcaataaacctgaaagattgcatggattcttcttagctaaaatcctggttcattgaatgaaagtgaattcattattaaccaagtagtttccccaagagaaaggcatggaaggaagctattcactttactcctcaacaaagaaggctttaggcattctgacttgtttaagaagtaaaatgaaaaagagggattgagtctgaaagaaaagcatactcacacataccctgctcttgcacaaaatttacatgttgtcagtttctacctctaaaatttattaaaacaaagagggagcattattttgaatctcatgccacagtcctaagaacaatggtctgtgttcagtgatcctgtacagattcttgaccttgaacacacctggatgccaatatcagtatgaaattcagaactgctcccctttccctgaagccagtgttacactggagaatgtaggagtatcctttgcctgaggcattcctggaccaagtaaaagtaaaagcagaaattataacctaatctggaatgcctctaaggaatggagaggaaatctcagttacaaagaaaaggaagttcagaatctgcgaactagaaataacataatttcaaggtttttattcaccaaattaacgttgggttacccctacaataccaaggagaaaacgtccaaggatggtgctaaatcaatgaagacaattcagacattacaactagagaaaaaataaggagaaagcaagaaagttggattctttgtccaaagatatttttgtcattactagatatttttccatagaaaaaaaaaacaattactagatcatcaattattttaaaattaaaatgaaatcttcatatgttccttttttaatggaaatgtgtaaactggtacaactatattattttgcaatatgcatgatctgtgaaaaaaattagaaaaaaactacatacaattgaaggctatctctgagtttcatatactttctcaaaatatgtggaaagataaatgtggaagatgtctgttgcagtattgtttgtagaaatcaacttcttgaaatatttattgcaaaacaattaacacatgtttattgattctttattttggcctactttgtaagaaaaatccaatagtgaataaacaatagtttctgggtttatggaacattgtttaagaaatatacaacaacgaaaaatttaagaggaatgaatgttataaaaaagaaagcaggccgagcgcggtggctcatgcctgtaatcccagcactttagaaggctgaggcgggcggatcacttgaggccaggagttcgagacccacctggccaacgtggcaaaaccctgtctgtactaaaaatgcaaaaattagccaggcatggtggcagatgcctgtaatcccagctactcgggaggctgaggcaggagaatcgcttgaacccaggaggtggaggttgcagtgagccgagatcgtggcactgcactccagcctgggcaacagagtgagaatccatctcaaaaaaataataataataaagcatatgctaccctaaatgataagacacagggatatcttttaaaatagaaaggtttcttttttactgatacataataattatacatatttaagggatacatgtgatattttgatactacattctcacatgctatatgagttatttatttctagaagttatacaatggaaagtaatttttaaaataatttatgtaaccatttgtgaataagaatatatttgtgatagttattaattcacaaatggtaccggtcatattaacaacttatttataatcagcatatttccagttagcaaagtgagaatgtaaggtaaaaacgtaatgggattaataggaataattttgctatggggatctgtgtagttataatgatttcaagttaaaaaaacagaaatgtaagtaatatatagcatttgtctctaatattatagaaatgccatattcagacctgtcgtggagagggacatagctgttctcttcacaatctcagtcatgaatatgactaatgagaaatgaaggggagaggtggggaatttatcacaatatccacacaccaaacctcatgtacttcttcaagatgtgtctttcaagactgcactcagaatcgtatatatctattaaaattttgttatcttgtcagttgctgaagaaaacaaaaggatcaattagaaggaagtaggggctactgacagcatccagatgtgagacttgcagtctgacagcaaaggaagggacgaaatacatcaatacagtcatgggccatttagcaatttcaatagcaccacctgggatagagttattatttttttaaaaagtgaaacaactgaagtttgtgctgatgatccagaggtatcaacaaaatatttgatactaccacctatgttcaagtaaaaggacagaaaagccttcgcaatgttttagaagttaatatcaaaaataaacatggcttggtattttgacggaaatgtttcagttgcctagcaaattaactcctgtggtatttctcattccccaagcaaaatagaaaagtgagatattaggaaactttaaaactggaaaaatatatgacaccgccaggagttttgtccagaaatgaaatttggaaatggcctttatccaacaaatagcgtggcagcatttgctaaaccccaggcacagcagtaggtgctcagactacctctggcacacacataatctagcaggaaacaagtataatagccgatactaggtagagcacataaatagcatggctttaaagaaagcgtgggtacagacgtgtagaaatgctaggtgtggttgattaatgccgattgtgactactattaggtacacaggatatgaggacatcaagatagaacaccaaccagcaaggctgagagagccctccagggttgagggcacagcagaatctcagagtccagttgttttctcactcacttcaatacccccattttggtagcacattaaataaattgatctggatttggaaaatagcaaactgaaaaccagaacaacaattaaaatattcaaagctgaaggtatgaggctgggagaaatgataataataacaagaataataatgataaacactgaatgagcatttattagatgtaggacactgcataaaaaccttcacttctataccctgtttgaacttcacaatgaccttccaagagtctaccttattagccctatttatgatgagaaaactgagaaatgcagagggaaagtaacatgaccaaaaacaaaacgctggaaagtggtggaaccaaggctttgagaatctgttttcagactttagcagcccatgcccttaagcaatattaaaaacttgtctcaaaaataataaaagtttcataaatctgaaatgatgaggaaaatatagcctcagaaacagaaaggttaaatcagactgaatctccagtcaaaaggtgagcccaatcagttttgtcctctcacaggaaagaagttctttttctaagaccttttttttttttttctgaaactgaaactgtgaacttttggtattctctgattctccagaagaccctcaagtccctaagccctagcaattgttttattttactagttgaataaaatgggctctggaggcagtaacacaaattcaaatcctaactctaccacatagtcactctgtgacctttggtagtcacctaatttccctgaagctcaatctcttatcttaaaatggagattttttgagggctcttaatgagttaattagtatacataaaggctaactcagtgcctgacatataacaggtgtttggtaagtatcattgttcacttcttgcctttctcaacttttccttaaactaaaacaaggaaaagatagatttcttaagatttagttgttgcatcaccatttatggaaaaacaaagagaaatgaaaacaaaatcaactttccttggtgatgaaaacgccctatgtcttcaatttgattctgggcttcacagtatatacatatattaataagctatacacttaagatctgtacatttcattataggtaatttatgcctcaatatataagacaaattcttgacaaaataaatttttattttaaatataatatctcaaacataataattaattctattggcaaaccaaattatccagcatatattttatgtcgccaattagaaacttaaaagtacaaaaaacacatactacatatttttcatctagccctaatatttcattcccccaccttgctcccactttaaacaatcctaaggaaatttccaacagccactgttttatttctgtactctgcaagtagcacgttccagttttctatgcgagccttttggccacattacagccaactaccaccaccatatgccactggagtccacattgataaaagatctaagagttgaatggcactttcatacttagagagggctttacacctgtagatccatttaaaactcaaaaaccttgcaggaagatatggttaagcactatcaccatcattgaggggaaatgatggctctgagaaattaagtcaaggacccaggaccttggcgttgttagggactaggacccaagtcttccagcatcaagactcacagcttttccattactcttatacctttgacagaggaagagatgacaagacaagtcctccaacttgtgccaactaacgatgagcctgcacagcactagctatagaaaatcaacaacataaggccaggggctcacattgttaaagtctgtggctttagaaaaggatgaaatctgcctaaaaaatatttctctactcttcccagagttgcttttggaagcgatatctttatatccaatacgatccttctcaaaggtgagtattcatgctgcgaatccactccagtctccagggcctttgccctggtactgacattttaccttctacaaaaacttcatgagagaaaggaaaaaaaacaaaaactagatttttccaggtcaaataaaaagaaaaaacttatactaattaaagccatactcttttagacaaaaacactatttcagttctcccttctttgctttttctgctgcaaaacatgtttcaaggctaaaaaggagccaattaaagtttctattatcatgaaatacaattctgttggtgcagtgatactgagcaaaagcaattttattcctgcctttccaaaaatacgtataggtacatgtgaaaacaactatgcatgcaggcacacctgcaggggtgtctctatgtgcacgtgtatgtgtgtagaaaggaagaccagagagttatcacagaattgaacctgcacaattcaccacaaataaattaataatggcatattatgaagatatattttcccattatctagaggaactttgttttgcctgtttttgttattatttttcactcgagtcatcattatcctacagagaggaaggctaacaaaggcctttgatttcaccacttctagagatttaaacaaaagacttaacaatcccaattagaccattaaaatacctcaagagaaaaacaaagaatatacagctatatctgctgaactcccagtaataactcaaggtctgtcttaattttttttaaaccagaggaaatgaagggatagggggagggaggaaacaagggagaaaaggaaggaaggaaggagggaggaaggaaggaaggaaggaaggaaggaaggaaagaaggaaggaagaaaggaaggaaagaaggaaggaaggaaggaaggaagggagagatacagcaatttcactattccacccatgcacctagcagctgcgtttattgttatttatttatttcctcccttttgagctagatcctttttttctcatttagtccaacagagattgtcctcctggtgtgaccttttattcttcccttttccttcacccctccaggctattgccctcatgccagtaactagataacacactctatcaaagatttttttaaaaaatcattgggaaggcactagggctgatagtggcatcaatcgtagcctgacacgagctggggtcaaccatttatctctttacatagcctgtggttactgcagtggccatcttgacttgctacatcttaacaaccttgtgcagatgttgcctctcccaacactgataatatctgctcccccagtccttttgctttccttgtttggcatatttctttgttttattctggtggacatcttttcataataaatcagggcaagaataagtgaagcccctcccgtgtttcagagcccttccatatttcagggcaagggagataattatgggctatacaaagaatcttgctctttgtaccaatattttcaaactaaaatcaaaacacttttgttccttagtaaatagtcatatccttgaagttaaagtgaattcatgtagcattgctcttatttcactggatatgagattttatcaaaagttttttatgaactcatttattttccattctatcccactcttttcccatctctctctctctctctacccccaaaataccattcactagcttttttttttgtaacttattcagcaggcagcatcatgattaagagaaagttgaaagttaggcagactacatttcaaactcatagctccaacattattagccacagggcctagggcaagtctcctaacattttgaagcatccgtttccttatctgcaaaatggagctaatactatctactcagagtgctatgaaaataagtagaaaaaatacttaaatgccatgtgtctgtcacatataaatgttcaatgtatttgagttgccacttactgtcttaaagttaatgaagagttagttgctcagacaatggaatctggtgccaagcatcatggacaaccctatatacaaaactcatctttactgccactttttctaccactgtaacttcacttatttgggtctccaagaaatctgtttaaaaatggaaatacacttgggaagttttagaccttataaacataaactttaaataagactggaatggaagatagaaacaaaagaaagagaaaataaaagagactcaaaggaaaacttggtttatgtgtattgtgctctaatttttaatacaaaccctagatgcctcacgccttctagaaattcaaataaatgtaaaatatagccactatgagagatacccaagttaaaactcaccttcacccttaaaattcccattagcagattcttcttttcaaaggataacctacataacatagtcctcacttaaaaaaataaaagtaaataagctgatagctgttgaaggtagacaatgggtacacagggctcattatgctattctctctattgtcacatatttaaaattgattattttaaaagttaaataaaataggccccaataaatacattgccttaaataggctaattgtgatgtatttccagttgtgccaaagcccagtaaagaatagggtcaatatcccctgatgctgaaagggattgtttcttaagacttcacagagaaatcttaaattgtactttaatgatggactttatggataaatatatagtcatagaaataaatatatcactccaagcattgccaatgttaatcttatgaccattccagatttattcactcaacatacagatagcatttttaaattatttcatcatattcctatacttctacacccaatgcctgtagatactgaaattaggagttactatctctaaactctccagcttgaagattatggggcaagagtgccaaagagcacaggctctggaatcattatgtctcaatttgagtccctgctctgccactttccagctgtgggtcctgagacaagcttctaagcatttctgaatggttatcaacctgtaaaattgagatgataatagtcatcactttaaagtttcattctgaggattaaatgggcagttcaagtaaagggtttcacacagttcctgacaagaagcaagcattcaattaatgttaccccttcccattattattagtagtagtagtagttctttacaataaaatacagaaatatgcttctctaggtggcatcatagcaagtattgaataccctaatatgtttttctttccatttttctcaatcttcccaaaacagcgattacatacttggttgtttcattttaatgtttgaaaagtatcaatttatccaagtgaagttatgaattctgtgagcagaagagatgaggcaaagaaatcaagaatcactccctgattcagtggtgcctggatttgaaagggtgcagtatgaagatgagtttaaacgctggcatggctctcccaatttccacacaatttccttgtggagaagccaccagtacagggaaattttagaacaattttaccaagagaaaagaacccagacccctgctttcttagtctcccctcaggcgtgggcactgaaggcttcaatgagaggctggaagactctaactgtggcccaaatttcatgccacatggcagagcaaggcttttttccaggagcagtgcattgttaacttatcagacacattaataaattcctatctcaaatgtgcagaaaactcacacaaaaagagaagcaagcttgtcttctttctgctccattccagctctgggttaagaaggtactaccttcagtattgctggtacaagggtcctggttcaaaccttcagtccctgcccccattaaaatgtaaaactagattcaaccatcacggagtggcaccagaggattgcaatttcatccagcatgatttttattagccttgcaatttcttaatgggctcccctgagggctggctggtagaatcctgcactaccagtccggatttgctacaggcagcttaataaacatggtatcttccccgtgacaattgtcataacatctgaccagggtgcagaaggcagagctaaaggttaacaaaaccactgctcaggtggcagggaggtgagtggggagaatgttggaaattgtaatctgaaggcaaaggctgcctgctgggttggtgattcttccagcctggccagagctcccaggagccgagcaggcagcttgctgccttctataatcagcatcttttacacatctcatcagtgtcactgttcctgacgtctcattatgcaccagaggtggaagtggacaggtaccgaacacttgaacttttacttttcttattatttccatggagcaccatgaagctgggagttaattaagtcccgtgggacaggcaatcagtgtcttttttgctaagttaaattacattatacacagatgcaaaaaagaggagaaaaaataatccctcagctgtttcctagttaatagagtaagttagaaatatgatgatgccaaactggaagctgaagttgatagctccttagcatacgaggtgtctaatgaagtcatatgacaaatccaccagggatctccttccttaaaggatctcaaagcacttttacaaacacttttaaagaacttcctgcctcaactctgacaaagttaattgggggatgatagtcaattcgatagtttagggaggaaattgtactcagccagactggagaagaaaacttccttggatgtataagatgttagactgaaaagaaaccttcagaggtaagacagaatcagacagtgtcaaagtggaaagggagctaaaaatgacctagcccaaaatttcccaaagtgttccacagagagccaataggtgttgtatggaagaaaaaaaaataagatttttatgaccaaataagcttaggaaagactggtttcaacagagtaaaactgccttccttcctgcaggactctccaagcttttaatgtctgactggacatcgatagaatcgagtctgcagcattcaccaaacttacttcactacagaacactttttttctttcttttttttttttttgagacacagtctcgctctttcgcccaggccggagtgcagtggcactatctcggctcactgcaagctccgcctcccgggttcacgccattctcctgcctcagcctcccgggtagctgggactacaggcgcctgccaccgcgcccagctaatttttttgtatttttaatagagacggggtttcaccgtgttagccaggatggtctcgatctcctgacctcatgatccgcccacctcggcctcccagagtcctggggttacaggcgtgagccaccacgcccagcccagaacacttttttttctaatgagacatgtttctttactaattgcttacagaattcacattggaacatgttgattttgtccagttacagatggggaaactaagaggttctttggttttgtttttttgggtttgttgttgttgttgtttgtttttttccttgagacagagtattactctgctgcccaggctggaatgcagtgcagtggcataatcatgactcactgcagtctccatctcctaggctgaggcgatcctcccacctcagactcccgagtagctaggaccacaggcacacgccactatgcccagctacttttttgcattatttgtagagatgaggtctccctatgttgcccaggctggtctcagactcctgggcacaagtgatccaactgcctcagcctcccaaagtactggaattacaggagtgagccatctcgcccagccatgaggttttccccagacgtgcctccaagcacacaggtaggtaacacccaagccttgaattaggacttagatcagccaatctcagaccactatatcataccacctccctctgtaacttaccaggaatctaaaacaccctacaagaatcaggtatgctctctggtcaccctgcgtttctttgtattactttcagaatactcatccttcatcctttttcacctgcagtcttaagacacctcatttccttatgttctcacccctcgtggaagcactgcctgtcatgtaatggcatctgagctccaagagaacagcagctacatgttttagaactcaccttacctgccatcaggccacagctcagcaagactagagttctgactctgatatgggatctaaggagcattttatgagacacagtggtggcaacaaaatttataaagcctctaacagctttattttcctcctgaattaaatctacactccttagtttggcactcaagattgtacatgatgttttccaacctttgtttctagtaactgccttcctggttactttctttcaaactttacactccagccaaataaaatcacttaaacgtaaaccatgttttcccatctctgggactctgtaagactagtctcttagctagtagacctttgttccttatcttcccttatccacatcctggtaatccttttaggccctaataaaatgccacactctctagggagtttccaggtaatttttccacccagaagatttctttgccttcactgattttccataacaaaatacacatatctttattatcacatgattatattttgcttatagcacagttagtgagtttttatatctcccctattaaatagtacattctacgaggtaggagttgtattttatttctctgtagacttaaagcaacctcccaaagtccaaagggatggactagttctaacattctagatattgaatgcataattttatctaggcccttcataacttcatagtttttggttgtctctcaaaacaatcatctgaaaatccctgggagggactcagacaatgcctgggaccctctgagtgatctgtaaatcatgtttcagaaggattaaagaacggcaatttttttttttttttgaaatggagtctcgctccgtcgcccagactggagtgcagtggtgcaatcctggctcactgcaagctccacctcctgggttcacaccattctcctgcctcagcctcccaagtagctgggactacaggcgcctgccacgacgcctggcttttttttttttttttttttcagtagagatggggtttcactgcattggccaggatagtctcgatctcctgacctcatgatcctcccgcctcagcctcccaaagtgctgggattacaggcatgagccaccgctcccagttgggaagtttaattaatgtttgtatagtatttggggagatgaattatgagaaaccgacactgtaacagactatttctttccctagattgctcttttctttattattagaggaaggttctcttgcatagaactgagtgatcagccatccccgttgggagctggtacatcataaaaatagctgctgtcattttgaaacaggaagacgcacatcacaaaagaaacacctaactgactttaaagtcctgcgggccactgaagatatgtgtgttttatgtagtcattatgctttctcatttggttgtttgtttgttaaa

SEQ ID NO: 59 - DNA, 12248 bp, Homo sapiens
  source 1..12248: mol_type = genomic DNA
cagactatgatcttacttgcagaaatatctcattacttggcttttaaaagcaatcatgcaaacttttgatactctgaacagtacagactactcaacatgatccctattataaccctttatctgtgagccaaatatcattgaaatctatgaacaataacaatacagtccacttgaagaaagtaactagattcctttaaatatcaagatggtagaatgtttacaattaacagcctttagtagcatagcaatatttgtccaaatcagtcagctttttaaaatgtctaaataaactgttggaggaaaaaataaaaagttaagttcctatattttggtcaaaaatgggaaaaagctacagcgtttataacctatttggaacacatgcctgcctctaaaaaggaatcactataaaccctcacaagaaacctctgacacaagatcccctgataaacactcaacctgcatgctcttcccactacactctacctctactccgattgcacagagtcttgcaaaaacctctgtgcaacccaagctcaaattcttcaaaggcactgcggtacagagcccttttagagaggctccaaagctcaagctctccctctccctctccctctccctctccctctccctctccctctccctctccctctccctccacggtctccctctgatgccgagccaaggctggacggtgctgctgccatctcggctcactgcagcctccctgcctgattctcctgcctcagcctgctacgcctcactggttttcgttttttttttggtggagacggggttttgctgtgttggccgggctggtctccagctcctagccgcgagtgatccgccagcctcggcctcccggggtgccgggattgcggacggagtctcgttcactcagtgctcagtgggtgcccaggctggagtgcagtggcgtgatctcggctcgctacagcctccacctcccagccgcctgccttggccccccaaagtgccgagattgcagcctctgcccagccgccaccccgtctgggaagtgaggagcgtctctgcttggccacccatcgtctgggatatgaggagcctctctgcctggctgcccagtctggaaagtgaggagcgtctctgcccggctgccatcccatctaggaagcgaggagcgcctcttccccgctgccttcccatctaggaagtgaggagcgtctctgcccggccgcccatcgtctgagatgtggggagcacctctgccccgccgccctgtctgggatgtgaggagcgcctctgctggccgcaaccccgtctgggaggtgaggagcgtctctgcccggccgccccgtctgagaagtgaggaaaccctctgcctggcaaccgccccgtctgagaagtgaggagcccctccgtccggcagccaccccgtctgggaagtgaggagcgtctccgcccggcagccaccccgtccgggagggaggtgggggggtcagccccccgcccggccagccgccccatccgggaggtgaggggcgcttctgcccagccgcccctactgggaagtgaggagcccctctgcccggccacgaccccgtctgggaggtgtgcccagcggctcactggggatgggccatgatgacaatggcggttttgtggaatagaaaggcgggaagggtggggaaaaaattgagaaatcagatggttgccgggtttgtgtggatagaagtagacatgggagacttttcattttgttctgtactaagaaaaattcttctgccttgggatcctgttgatctgtgaccttatccccaaccctgtgctctctgaaacatgtgctgtgtccactcagggttaaatggattaagggcggtgcaagatgtgctttgttaaacagatgcttgaaggcagcatgctcgtcaagagtcatcaccactccctaatcttaagtacccagggacacaaacactgcggaaggccgcagggtcctctgcctaggaaaaccagagacctttgttcacttgtttatctgctgaccttccctccactattgtcctatgaccctgccaaatccccctctgcgagaaacacccaagaatgatcaataaaaaaaaaaataataataataaataaaaaataaaaaaataaaaaaataaaaataaaataaaataaaataaaataaaataaaataaaaaaaagagaggctccaaagtatccacatcttaaccacatcggacgcctttgcccagcctccctgaggctcccacaacacattctgaaatctcagacattgcttaagcagggcccaggaagcctttgcaagacaaaggaaggaaacacagtgaagtgtaccgttaacaaaacccaaaatcaaaaggaagtccaagtcgttgtcaaatttgtaattggtagctccattattaattaatttgtcagagaatttaacacagcaggactatccacagtcataactgcacaagtaaattgagactaggttaaacaaaatttttttaaatttaattttctacgtacctacagaggtgagaactgcctagactacaaaaaataagggggcttgcttgtattgatattttaatctgaaacatcattattgtgtaaacggaatctccttttacattagttttcagagacaagactggaaacagcatatgagcacataatcatatcacagtgtgtttctctctcaaaagccgaaccttctgccttaacactttcacagactcctccaggcctgcttcaaacagacaaaacactcctcctaaaactcaaagaaacatcgcaacacctttgtaataggcctatttcccaagagggggcagataaaaggacaaagcaaattaagggaaatgcggaatataaacttgaaacctactgtcaataaaacccaaaacaaactcgaagcggaggtgaagaaagcagggggaggaaaagcaatgttaaatggtcatctttcttctcattttatttgaggaagttaagtttgcacagctccttacaagctgtctttggctaaaatcactattaatgagctttgacgtttgaaatttaactgagcacaagctaacagcttccagcactgcaccacccatgaagtcaactggaaatattttgctagggcctaacggtgtgtttattgaaaaggcacagctttcaagagaaagtgtttatagcaaccactttacctgctatccctgctctgtgatgtctgtttggttttagggtttggggggtcctctttaactctttctagtcacactgttctaattgttttcaagtctagcaggagaatgttaatgaagttctttgctctacagcaacctggattataaggacagatttgaaaactctgagttatgacaaaggggcaggccacaaggcaaaaagaaaaaagcccatagagaggcttcagctctagcattcgctcattagaaagacaagataaaaacacgtattctttatgggtaatgccattaaaattatcctttcccaaaagagaacacagtgactagatcaataaacctgaaagattgcatggattcttcttagctaaaatcctggttcattgaatgaaagtgaattcattattaaccaagtagtttccccaagagaaaggcatggaaggaagctattcactttactcctcaacaaagaaggctttaggcattctgacttgtttaagaagtaaaatgaaaaagagggattgagtctgaaagaaaagcatactcacacataccctgctcttgcacaaaatttacatgttgtcagtttctacctctaaaatttattaaaacaaagagggagcattattttgaatctcatgccacagtcctaagaacaatggtctgtgttcagtgatcctgtacagattcttgaccttgaacacacctggatgccaatatcagtatgaaattcagaactgctcccctttccctgaagccagtgttacactggagaatgtaggagtatcctttgcctgaggcattcctggaccaagtaaaagtaaaagcagaaattataacctaatctggaatgcctctaaggaatggagaggaaatctcagttacaaagaaaaggaagttcagaatctgcgaactagaaataacataatttcaaggtttttattcaccaaattaacgttgggttacccctacaataccaaggagaaaacgtccaaggatggtgctaaatcaatgaagacaattcagacattacaactagagaaaaaataaggagaaagcaagaaagttggattctttgtccaaagatatttttgtcattactagatatttttccatagaaaaaaaaaacaattactagatcatcaattattttaaaattaaaatgaaatcttcatatgttccttttttaatggaaatgtgtaaactggtacaactatattattttgcaatatgcatgatctgtgaaaaaaattagaaaaaaactacatacaattgaaggctatctctgagtttcatatactttctcaaaatatgtggaaagataaatgtggaagatgtctgttgcagtattgtttgtagaaatcaacttcttgaaatatttattgcaaaacaattaacacatgtttattgattctttattttggcctactttgtaagaaaaatccaatagtgaataaacaatagtttctgggtttatggaacattgtttaagaaatatacaacaacgaaaaatttaagaggaatgaatgttataaaaaagaaagcaggccgagcgcggtggctcatgcctgtaatcccagcactttagaaggctgaggcgggcggatcacttgaggccaggagttcgagacccacctggccaacgtggcaaaaccctgtctgtactaaaaatgcaaaaattagccaggcatggtggcagatgcctgtaatcccagctactcgggaggctgaggcaggagaatcgcttgaacccaggaggtggaggttgcagtgagccgagatcgtggcactgcactccagcctgggcaacagagtgagaatccatctcaaaaaaataataataataaagcatatgctaccctaaatgataagacacagggatatcttttaaaatagaaaggtttcttttttactgatacataataattatacatatttaagggatacatgtgatattttgatactacattctcacatgctatatgagttatttatttctagaagttatacaatggaaagtaatttttaaaataatttatgtaaccatttgtgaataagaatatatttgtgatagttattaattcacaaatggtaccggtcatattaacaacttatttataatcagcatatttccagttagcaaagtgagaatgtaaggtaaaaacgtaatgggattaataggaataattttgctatggggatctgtgtagttataatgatttcaagttaaaaaaacagaaatgtaagtaatatatagcatttgtctctaatattatagaaatgccatattcagacctgtcgtggagagggacatagctgttctcttcacaatctcagtcatgaatatgactaatgagaaatgaaggggagaggtggggaatttatcacaatatccacacaccaaacctcatgtacttcttcaagatgtgtctttcaagactgcactcagaatcgtatatatctattaaaattttgttatcttgtcagttgctgaagaaaacaaaaggatcaattagaaggaagtaggggctactgacagcatccagatgtgagacttgcagtctgacagcaaaggaagggacgaaatacatcaatacagtcatgggccatttagcaatttcaatagcaccacctgggatagagttattatttttttaaaaagtgaaacaactgaagtttgtgctgatgatccagaggtatcaacaaaatatttgatactaccacctatgttcaagtaaaaggacagaaaagccttcgcaatgttttagaagttaatatcaaaaataaacatggcttggtattttgacggaaatgtttcagttgcctagcaaattaactcctgtggtatttctcattccccaagcaaaatagaaaagtgagatattaggaaactttaaaactggaaaaatatatgacaccgccaggagttttgtccagaaatgaaatttggaaatggcctttatccaacaaatagcgtggcagcatttgctaaaccccaggcacagcagtaggtgctcagactacctctggcacacacataatctagcaggaaacaagtataatagccgatactaggtagagcacataaatagcatggctttaaagaaagcgtgggtacagacgtgtagaaatgctaggtgtggttgattaatgccgattgtgactactattaggtacacaggatatgaggacatcaagatagaacaccaaccagcaaggctgagagagccctccagggttgagggcacagcagaatctcagagtccagttgttttctcactcacttcaatacccccattttggtagcacattaaataaattgatctggatttggaaaatagcaaactgaaaaccagaacaacaattaaaatattcaaagctgaaggtatgaggctgggagaaatgataataataacaagaataataatgataaacactgaatgagcatttattagatgtaggacactgcataaaaaccttcacttctataccctgtttgaacttcacaatgaccttccaagagtctaccttattagccctatttatgatgagaaaactgagaaatgcagagggaaagtaacatgaccaaaaacaaaacgctggaaagtggtggaaccaaggctttgagaatctgttttcagactttagcagcccatgcccttaagcaatattaaaaacttgtctcaaaaataataaaagtttcataaatctgaaatgatgaggaaaatatagcctcagaaacagaaaggttaaatcagactgaatctccagtcaaaaggtgagcccaatcagttttgtcctctcacaggaaagaagttctttttctaagaccttttttttttttttctgaaactgaaactgtgaacttttggtattctctgattctccagaagaccctcaagtccctaagccctagcaattgttttattttactagttgaataaaatgggctctggaggcagtaacacaaattcaaatcctaactctaccacatagtcactctgtgacctttggtagtcacctaatttccctgaagctcaatctcttatcttaaaatggagattttttgagggctcttaatgagttaattagtatacataaaggctaactcagtgcctgacatataacaggtgtttggtaagtatcattgttcacttcttgcctttctcaacttttccttaaactaaaacaaggaaaagatagatttcttaagatttagttgttgcatcaccatttatggaaaaacaaagagaaatgaaaacaaaatcaactttccttggtgatgaaaacgccctatgtcttcaatttgattctgggcttcacagtatatacatatattaataagctatacacttaagatctgtacatttcattataggtaatttatgcctcaatatataagacaaattcttgacaaaataaatttttattttaaatataatatctcaaacataataattaattctattggcaaaccaaattatccagcatatattttatgtcgccaattagaaacttaaaagtacaaaaaacacatactacatatttttcatctagccctaatatttcattcccccaccttgctcccactttaaacaatcctaaggaaatttccaacagccactgttttatttctgtactctgcaagtagcacgttccagttttctatgcgagccttttggccacattacagccaactaccaccaccatatgccactggagtccacattgataaaagatctaagagttgaatggcactttcatacttagagagggctttacacctgtagatccatttaaaactcaaaaaccttgcaggaagatatggttaagcactatcaccatcattgaggggaaatgatggctctgagaaattaagtcaaggacccaggaccttggcgttgttagggactaggacccaagtcttccagcatcaagactcacagcttttccattactcttatacctttgacagaggaagagatgacaagacaagtcctccaacttgtgccaactaacgatgagcctgcacagcactagctatagaaaatcaacaacataaggccaggggctcacattgttaaagtctgtggctttagaaaaggatgaaatctgcctaaaaaatatttctctactcttcccagagttgcttttggaagcgatatctttatatccaatacgatccttctcaaaggtgagtattcatgctgcgaatccactccagtctccagggcctttgccctggtactgacattttaccttctacaaaaacttcatgagagaaaggaaaaaaaacaaaaactagatttttccaggtcaaataaaaagaaaaaacttatactaattaaagccatactcttttagacaaaaacactatttcagttctcccttctttgctttttctgctgcaaaacatgtttcaaggctaaaaaggagccaattaaagtttctattatcatgaaatacaattctgttggtgcagtgatactgagcaaaagcaattttattcctgcctttccaaaaatacgtataggtacatgtgaaaacaactatgcatgcaggcacacctgcaggggtgtctctatgtgcacgtgtatgtgtgtagaaaggaagaccagagagttatcacagaattgaacctgcacaattcaccacaaataaattaataatggcatattatgaagatatattttcccattatctagaggaactttgttttgcctgtttttgttattatttttcactcgagtcatcattatcctacagagaggaaggctaacaaaggcctttgatttcaccacttctagagatttaaacaaaagacttaacaatcccaattagaccattaaaatacctcaagagaaaaacaaagaatatacagctatatctgctgaactcccagtaataactcaaggtctgtcttaattttttttaaaccagaggaaatgaagggatagggggagggaggaaacaagggagaaaaggaaggaaggaaggagggaggaaggaaggaaggaaggaaggaaggaaggaaagaaggaaggaagaaaggaaggaaagaaggaaggaaggaaggaaggaagggagagatacagcaatttcactattccacccatgcacctagcagctgcgtttattgttatttatttatttcctcccttttgagctagatcctttttttctcatttagtccaacagagattgtcctcctggtgtgaccttttattcttcccttttccttcacccctccaggctattgccctcatgccagtaactagataacacactctatcaaagatttttttaaaaaatcattgggaaggcactagggctgatagtggcatcaatcgtagcctgacacgagctggggtcaaccatttatctctttacatagcctgtggttactgcagtggccatcttgacttgctacatcttaacaaccttgtgcagatgttgcctctcccaacactgataatatctgctcccccagtccttttgctttccttgtttggcatatttctttgttttattctggtggacatcttttcataataaatcagggcaagaataagtgaagcccctcccgtgtttcagagcccttccatatttcagggcaagggagataattatgggctatacaaagaatcttgctctttgtaccaatattttcaaactaaaatcaaaacacttttgttccttagtaaatagtcatatccttgaagttaaagtgaattcatgtagcattgctcttatttcactggatatgagattttatcaaaagttttttatgaactcatttattttccattctatcccactcttttcccatctctctctctctctctacccccaaaataccattcactagcttttttttttgtaacttattcagcaggcagcatcatgattaagagaaagttgaaagttaggcagactacatttcaaactcatagctccaacattattagccacagggcctagggcaagtctcctaacattttgaagcatccgtttccttatctgcaaaatggagctaatactatctactcagagtgctatgaaaataagtagaaaaaatacttaaatgccatgtgtctgtcacatataaatgttcaatgtatttgagttgccacttactgtcttaaagttaatgaagagttagttgctcagacaatggaatctggtgccaagcatcatggacaaccctatatacaaaactcatctttactgccactttttctaccactgtaacttcacttatttgggtctccaagaaatctgtttaaaaatggaaatacacttgggaagttttagaccttataaacataaactttaaataagactggaatggaagatagaaacaaaagaaagagaaaataaaagagactcaaaggaaaacttggtttatgtgtattgtgctctaatttttaatacaaaccctagatgcctcacgccttctagaaattcaaataaatgtaaaatatagccactatgagagatacccaagttaaaactcaccttcacccttaaaattcccattagcagattcttcttttcaaaggataacctacataacatagtcctcacttaaaaaaataaaagtaaataagctgatagctgttgaaggtagacaatgggtacacagggctcattatgctattctctctattgtcacatatttaaaattgattattttaaaagttaaataaaataggccccaataaatacattgccttaaataggctaattgtgatgtatttccagttgtgccaaagcccagtaaagaatagggtcaatatcccctgatgctgaaagggattgtttcttaagacttcacagagaaatcttaaattgtactttaatgatggactttatggataaatatatagtcatagaaataaatatatcactccaagcattgccaatgttaatcttatgaccattccagatttattcactcaacatacagatagcatttttaaattatttcatcatattcctatacttctacacccaatgcctgtagatactgaaattaggagttactatctctaaactctccagcttgaagattatggggcaagagtgccaaagagcacaggctctggaatcattatgtctcaatttgagtccctgctctgccactttccagctgtgggtcctgagacaagcttctaagcatttctgaatggttatcaacctgtaaaattgagatgataatagtcatcactttaaagtttcattctgaggattaaatgggcagttcaagtaaagggtttcacacagttcctgacaagaagcaagcattcaattaatgttaccccttcccattattattagtagtagtagtagttctttacaataaaatacagaaatatgcttctctaggtggcatcatagcaagtattgaataccctaatatgtttttctttccatttttctcaatcttcccaaaacagcgattacatacttggttgtttcattttaatgtttgaaaagtatcaatttatccaagtgaagttatgaattctgtgagcagaagagatgaggcaaagaaatcaagaatcactccctgattcagtggtgcctggatttgaaagggtgcagtatgaagatgagtttaaacgctggcatggctctcccaatttccacacaatttccttgtggagaagccaccagtacagggaaattttagaacaattttaccaagagaaaagaacccagacccctgctttcttagtctcccctcaggcgtgggcactgaaggcttcaatgagaggctggaagactctaactgtggcccaaatttcatgccacatggcagagcaaggcttttttccaggagcagtgcattgttaacttatcagacacattaataaattcctatctcaaatgtgcagaaaactcacacaaaaagagaagcaagcttgtcttctttctgctccattccagctctgggttaagaaggtactaccttcagtattgctggtacaagggtcctggttcaaaccttcagtccctgcccccattaaaatgtaaaactagattcaaccatcacggagtggc

SEQ ID NO: 60 - DNA, 8544 bp, Homo sapiens
  source 1..8544: mol_type = genomic DNA
tgggtgaagtggtaatgtctttccataattcattaaaaggagatcttcaacatagaggagtagctgatgatcttaaagcactcgctagtcatgagatggtccttctgaatttaactgcagcgtgcaatgaagatttttatttctctattttttttttttttgagatagagtcttgctctgtcgcccaggctggagtgcagtggtatgatcttggctcactgtaacctccgcctcccaggttcaagtgattcttctgcctcagcctctcgagtagctgggactacaggcacacgctacgacgcctggctaatttttgtatttttactagagatggagctttgccatattggccaggctggtctcaaactcctgacctcatgatccgcctgccttggcctcccaaagtgctgggattacaggtgtgagccaccgtacccagcctatttctcttcttgtagaaatttctgaatcagaattagaactatatatgctatcataattgtaaaatccacttattgtaagaatgaaatcacatttctacctataagtactgactttttcttggttggataactgagaaaacatttgaactgcaactcttgcttgtccagctcagatctccttcgacatgactgccagcataagctatctacaatgcaaatctgattctgtcacttcgagcttacaaatacttcatggcatcccagtgcctaaaggataaaggctaagctccttagggaggcacagaggaccctctgtgacctgacttccagctgttcctcctcctgctgttttttgcctttaccttatgcacgagagcaacacccaacagccacatttcctagaaggtgtcactctctctctagaagatatcactctttctctcaggaaagtgagaaagaaaaaaagcagtcaggccgggtgtggtggctcccacctgtaatacaagcacttcgggagatgaaggcgggcggatcacctgaggttgggagttcgagaccagcctgaccaacgtggagaaaccccgtttctactaaaaatacaaaattagctgggtgtggtggtgcacacctgttatcccggctactcgggaggctgaggcaggagagtcacttgaaactgggaggcggatgttgcagtgagctgagatcgtgccattgtacttcagcctgggcaaaaagagcaaaactctgtctcaaaagaaaaaaaaaaaaaaagaaaaaaagcagtcctgggctgcggtaagctaaactgtcctggttctaacatctaggcctggggttgtcctgttgaaccgaaaccaggccactctatgagcatgctggagcaagacaaaaataagaccactttacagtgagctgagatcaccccactgcatgacagtccgggagacagagcgagaccctgtctctaaaaagaagaagaaaaagaaaaaaaaccactccacagtcatgtctgagcacagacaaaaacacaaatgccataaactacaaaaaatgcgaaacatcttcctctcccagctaatatgagtgactgctgtgcccttactaatcacagctttaccccaccttctagataaaaattcatcatagaattatcaaatccagagcaaaatattgattctttaaacccttcccaaagtcacctactgcaagtctaaactgcaacaagttcctctcaactctgcactaagatgccccatggttcttcatggtgtgctttcttcctcactgcaacgaaccaagaaacccaacttgttcaactacaagtgtgttcctttggccaaaaggcactgacacaaggaagcttttcctgtctgccccaggctggctgaggactgccaccttctctgttccaaagatgtcctgtaccttacagcactgcattatgcaggctatattgtattgaaattctgtccatccatgtctgtctccctctggagaccttgggccccacaggaaccatgttttatttttttcctcttattcatttttaagtcctcagctgacaaagaacctaggtcatagtaaagtttcaaaaaaaaatgtttaaagaatgaatgagtagatgctgcacatttcttgggtccaagatttaaagatgcagcttcacgtaacacatcattttacaacactgtcaactataacgtcatgtgctttaagaatgcagtctggttgtacaaggtgactcatgcctgtaatcccagcattttgggagtcttaggcaggaagactccttaagcccagcagtttgagaccagcttgatcatcatagcgagactccgtctctacaaaaaataattagctaggcatggtggtgtgcacctgtagtcccagctactcgagaggctgaggtgggaagactgcttgaacctgtagggttgaggctgcactgagctgtgatggtgccactgtactccagcctgggcactgagctagactcaaaaaaaaaaaaaaaaaaaaaaaggaatgcaatctgggcttctcctcctaactctcttgcctctgaatattcctttttccgaagtgtgtcgagaaacaacctaagtttggagagattaagacacatatcgatgtagagaaagcttttttttttttttttttttttttttaagacagggtcttgctctgttgcccaagctggagtgcagtggcacaaacacagcttactataccgttgacttcccaggctcactcaatcctcctgctgcagccagccgagtagctgggactacaagtgcataacctcatgcttggctaatttttaaattttttgtagagatgaggtctcgtcatgttgcccaggctggtctcaattcctgggcccaagcaatccttccatcttggcctccctaagtgttgggattacagatgcgagccaccacccctggccaagggaaagctttttaaaaaatttaaacaaactcaaaagttttatcagttctggaagatcatgataaaaatgaaatattggagaaagcaagctgttacccatcaatgttgagaaaatgacaaaacatatcaagttttacatggcaacatctgtttataatgtgttaaattttttttacctgttccttaaggggaaaaaagtgggtaactcaattaacatcaggtaggactctaaactttcaaagtaacttaacttatttatttgagacatggtcttgctctgttgcccaggttggagtgcaatggctgatcatagttcactgcaaccttgacctgctggacttaagcagtccccttgcctcagcctcctgaggagctggaactgcacttgtgtgccaccatacccagctaaaactttcttttttacttgtattaattttttttttttttttttttgctgggaagactcagacccaagtaaccttggatatgagctctccacctggttaaaactttattacagtgctgatttcttctgtttctaagtttttgccaatctttggcaaagatcaagacaggtcataattcttaaagttcagctgcttgtagagacatttatagcaaaataaaaaacttaaaaagaaatgttaaagagtacatttttccttctttttagagatggggtctcgctatgttgtccaggctggtcttgaactccagggctcaagaaaactgcctgccttagcctcccaaagtgctgggattacaggcgtaaatcaccatgcccagccaagactaagtttttaattttactgcctggttatattgtatataaatatttaaaatatcaatcttgggctaggcacagtggttcatgcctgtaatcccagcactttgggaggccaaggtgggaggatcgcttgaggccaggagttcgagaccagcctggccaataaggtgaaatcccgtctctactaaaaatacaaaaaattagctgggagtggtggcatgcacctgtaatcccagcaactcaggaggctgaggcaggagaattgcttgaaccagggagatagaggttgcagtgagctgagattgtgccactacactccagcctgggtgagagagcgaaactccgtctaaaaaaaaaaataaataaaataaaataaaatatcaatcatgacaatttaataggaaaagtcttaaatattttatgttcttaaactaataaagtgactttgaagccaacaagaatgctgaaaacaaactgtgtatattttaatctttcctaatgtttttatgttcttcttttattctactcaaaaggcaaacattttgtttccatggtttgagaatttagtatattgaattattatagatttttatttgtgatttgcctttgtgctcgattaagtgattgaaatctggttttaataagatataaacttttttctaaagacctactctagaagagcaaacagatgtatatcatattataatattatatcataataaatgtgctgttctctttctttaatgacactcatttaaaatatagatacaggtccaatatcccttgtctgaaatgcttggaaccagaagtgttttggattctggattttagaatatttgtatcacgtaccttcccaattaagcatcctaaatcttgtttttcttttcgagatggagtcttgctctgtcacccaggctggagtgcagtggcacgatctcagctcactgcaacctctgcctcctgggttcaaggaattctcctgtctcagcctcccgagtagctgggactacaggtgtgtgccaccatgcccagctaatttttgtatttttagcagagatggggttttgtcatgttggccgggctgatctcgaactcctgacctcaggcgatccgcctgcctcagcctcccaaagtgctgggattacaggagtgagccatcaggctggccaagcatcctaaatcttaaaatccaaaaatctgaactctgaaatgctccaatgagcatttcctttgagcatcatgtgggttctcaaaaacttttggatttcagagtattttggatttagaattttcagatttgggatgtacaactgtataaacacactagttggttttctaacaactaatggtcagaatgagaatcctttcatgaataacacattttattttctactaatcaagtggaaaaaacaaacttaagactcatttgataatcactacactaaaaggttttaaaatgacttaaaaatattttttatagtttataaaactatactttctataaaaaatgaaagaactgaaattcttcagacaatactttgttcatatttatgtatttaaaatttttttttaaatattttaaatgttttgtagagaaagggtctcactatgttgactaggctagtctcctgacctcaaatgatcctcccacctagacctccccaaaggactgggattacaagtgtgagccactgcacccagccagacaatactttggatgttcatttcatttgcctattctactttgtctagagcatgcacaataggaatatatatttttaaaaactgatatcttaattctgaagaaaaaaagtttctgacattatttttaaaatgtgtcaaagtccatacctgatttcttaatgatgaaagaatgtattccttttcataatgggaaattctcttgtgtttttgtggtgtgtcactaactaaccagatccacaaaagaaaccaaaatattccaatagtaccttaaaatagaaaaataatagttagataaaattagaatgtaccaaataacaaacaaaacaaaacaaaaacacaaaattagaaagcaccaacaacaatttttacatgtcttgaaaaaattatgtaactataaattcaatgtaaaactgacttcagtttggattcaatttcaagtttctctcaattctttaatgggataattgctataactgtattattgcttatacattttgaagaaaacaacttttttttttttttttgagatagagtcttgctctgtctcacaggctggagtgcagtgacgtgatctcggctcactgcaacctccgcctgctgggttcaagcaactctactgtctcagcctcctgagtagctgggactacaggcacgtgccaccacgcctggctaatttttgtattttgagtagagatggggttccaccatgttggccaggctggtcttgaactcctgacctcgtgatccacccgcctcggcctcccaaagtgctgggattacaggtgtgagccactgcacccagccagaagaaaacaacttttaaccacatgactttgcctatcagggtctaccagacaaatctttttgaagatacatttccacaatctacatatttccaaaggtgtctgtttttgttagttgagttttaaattttgattgcagatatatttcttgcatgacatgtctatgtgaaaatctaatttattaaaaatgtgtatcatgctgccaaggaaattgagcaataaaatgccttgggactaagtaaaaagaaaaaaaaaaaaaaaacattaaaactaccaagtgagaacatcctactttgcttgagaagaaattcaaaatacctaagatagtgattttttgatagcaaatgtactatttaagtacaggatcaacagtcatttctactgagaaatattccaaaactaacatcagctcgtaactcaaataggtcaagtaaatcataccaacttgaaaaacaggttatcaggaagtgtttcagaactgtggttcagtgatttggaagatatatttttaaaacattattaggctactattattacattttgaatttgttacattataatttagttaaaattttaaacttaccaaaaaagtagaagacataagtccaattcatatagtagcaaattattccagaaagaggaagagaaattactgtcccaagctgtgctcctagaacaacacataagactattttataaactttggagagagaaacaaggataggacagacaagtctactgcttacagaggatgggtaacaggctgggcacagtggctcattcctgtaatccctgcactttgggaggctgatgtgggtggatcacctgagcctaggagtttgagaccagcctgggcaatatggcaaactcctatctgtactaaaaatacaaaaattatctgggtatggtggtgatgcacgcctgtagtaccagctacttagctacttgggaggttgaggtgggacgatcgcttcagctgttgaggctgcagtgaggggcgattgtgccactgccttccagcctggagtgagaccctggctcaaaaaaaaaaaaaaggctaaaatgtggtcccatagaaacaagattagaaaaaagatatagaggtagtataacaggacaagcaaaggaatggaagtagtaaagcagagagtaggcttgggaacttcatttgggtaaaggaaaggaaaagcagataaagctggaaaaataggttggacagttgaacagttactgagtacctactccatgctaggcactatctgccagagatataaggctagctgcaacaaagtagtgaagactgtaaagaatcttgcccctagttcaaggagtttgggatttattcaataggtaaaagggaaccttagatagtacctgttcttgaacctatcatcagatttctcatgtcaatctcaacatagctgcaagaataatcttcttaaaatgtaattgaatcatgcctcttaaaaaacaatctacattttttcctgtagcctgtaagacctgatataacccggctcttatctctttctctaacctcatcttatgccatcatcctccttactcactgagttctagccatccaaggtagttttccacttcttttaacccttatgttatttcttgcctgagtgccctcgtacatgctgttctgattggctgaaatgctcttctccctgcatgaatggtttgttcttatccttcagattttagcttaaaagtaccacagagaggccttttctcaactactgtatttaaaaagcagtccggtggaaaaattttaatttagtcaatgaaagaaaggctagaatttcttatgcaatctgataaaattataattcacatatataaaactcatgttatctcacctgtagatcaaaatgatggcaaataaagatgcaatagaaaaaagatgcatgaagagaggggttgagaatcatgatacattcattagttaatcaaaacagaaatcacaatttaaggacaaaaacactcaattttctagctactggcctttttttttcttttttttaaatagcatctctaaacaaacaaaaataaaatttaaaacccccaaaaaagtaaacagaaaaagaaaaaaaatagcatctctataccaatatctgaaaacacaacatactttgaaatagatgatggcagatggggaaaatgacattagtcaattaagctgcattactataagttgttgagccaaagagaaaaattggtaataaagttatactaccgaaacttaatgttctccccaaaggggcatccaatccaacattgcatcgttctggtatgcaggccctttttcccaaaggttgatatatacataacatattacagcaaaatt

SEQ ID NO: 61 - DNA, 2116 bp, Homo sapiens
  source 1..2116: mol_type = genomic DNA
tgggtgaagtggtaatgtctttccataattcattaaaaggagatcttcaacatagaggagtagctgatgatcttaaagcactcgctagtcatgagatggtccttctgaatttaactgcagcgtgcaatgaagatttttatttctctattttttttttttttgagatagagtcttgctctgtcgcccaggctggagtgcagtggtatgatcttggctcactgtaacctccgcctcccaggttcaagtgattcttctgcctcagcctctcgagtagctgggactacaggcacacgctacgacgcctggctaatttttgtatttttactagagatggagctttgccatattggccaggctggtctcaaactcctgacctcatgatccgcctgccttggcctcccaaagtgctgggattacaggtgtgagccaccgtacccagcctatttctcttcttgtagaaatttctgaatcagaattagaactatatatgctatcataattgtaaaatccacttattgtaagaatgaaatcacatttctacctataagtactgactttttcttggttggataactgagaaaacatttgaactgcaactcttgcttgtccagctcagatctccttcgacatgactgccagcataagctatctacaatgcaaatctgattctgtcacttcgagcttacaaatacttcatggcatcccagtgcctaaaggataaaggctaagctccttagggaggcacagaggaccctctgtgacctgacttccagctgttcctcctcctgctgttttttgcctttaccttatgcacgagagcaacacccaacagccacatttcctagaaggtgtcactctctctctagaagatatcactctttctctcaggaaagtgagaaagaaaaaaagcagtcaggccgggtgtggtggctcccacctgtaatacaagcacttcgggagatgaaggcgggcggatcacctgaggttgggagttcgagaccagcctgaccaacgtggagaaaccccgtttctactaaaaatacaaaattagctgggtgtggtggtgcacacctgttatcccggctactcgggaggctgaggcaggagagtcacttgaaactgggaggcggatgttgcagtgagctgagatcgtgccattgtacttcagcctgggcaaaaagagcaaaactctgtctcaaaagaaaaaaaaaaaaaaagaaaaaaagcagtcctgggctgcggtaagctaaactgtcctggttctaacatctaggcctggggttgtcctgttgaaccgaaaccaggccactctatgagcatgctggagcaagacaaaaataagaccactttacagtgagctgagatcaccccactgcatgacagtccgggagacagagcgagaccctgtctctaaaaagaagaagaaaaagaaaaaaaaccactccacagtcatgtctgagcacagacaaaaacacaaatgccataaactacaaaaaatgcgaaacatcttcctctcccagctaatatgagtgactgctgtgcccttactaatcacagctttaccccaccttctagataaaaattcatcatagaattatcaaatccagagcaaaatattgattctttaaacccttcccaaagtcacctactgcaagtctaaactgcaacaagttcctctcaactctgcactaagatgccccatggttcttcatggtgtgctttcttcctcactgcaacgaaccaagaaacccaacttgttcaactacaagtgtgttcctttggccaaaaggcactgacacaaggaagcttttcctgtctgccccaggctggctgaggactgccaccttctctgttccaaagatgtcctgtaccttacagcactgcattatgcaggctatattgtattgaaattctgtccatccatgtctgtctccctctggagaccttgggccccacaggaaccatgttttatttttttcctcttattcatttttaagtcctcagctgacaaagaacctaggtcatagtaaagtttcaaaaaaaaatgtttaaagaatgaatgagtagatgctgcacatttcttgggtccaagatttaaagatgcagcttcacgtaa

SEQ ID NO: 62 - DNA, 14549 bp, Homo sapiens
  source 1..14549: mol_type = genomic DNA
taccagaagccacagagtatataccagtaactacaaaaagaacagggataatgtaaacccaaacaatggtttttatccaggtattcccatcctaatctgaatggagttccagaataagagcaatctttcgttgttcagatttcaagatgattcattgcacaaaaaaagaaaactattgtgatagttgttttcactgaacatgtccatcatggtgtatctgaaagctcttttccagggtgactccacccaaagctcctgctaagggagcagcctaggctgtcttactctgcaacacccactcatccttgccttgccacaactaattggaccagcatctggcaccagaagattcctatagaaaaaaaaccaaaggtagaatcagtgtcatgaggagggagttagagctggggctatgagaggtcatgtcaaactaagttataagacaacagaaactataaataagcagggcccaggatgaatttggagaagttagcaggaagccagattatacagggaagtcattgaaagatttcaaatatttaaaattagtgtttagggcaaggtgtggtggctcacacctgtaatcccagcactttgggtggctgaggcagatggatcacttgaggcaaggagttcaagaccagccatggggaaacctcgtctctactaaaactacaaaaattagccgggtacggtagtgtgcgcctgtaatcccagctacaggagaggctgagtcatgagaaccacttgaactagggaggcagaggttgcagtgagccgagattgtgccactgcactccagcctgtgcaataagagtgagacttcatctcaaaaaataaataaataaacataagatgaaataaaattagtatttagaactttagaaactgaatagttattggaggttgaggacagaagtggcaccagatgaggggtggcagttacttggactaaaggtgttgtgaaggaaatagaagtgggcatattcacagtgtattttcaaatatagtttgccaaagatttaatgatggactgaaagtagggagtaagggagcaattgggtggttgtttgtaacactgactgagctggaaaggaagggagagtaacagatttcaagtttgtgtcagtgaggaaacaatcagggaagcaaaatcactataagtattatgaaataaaggttttattacaggaataagaatttatatgagatgagagaagctgagaaagtaatgatccaaaagggagacttggagaatgagcagtgtcactaaccagtccttcacaaggctgggtgaatggggagagcttacaggacaatctggaagccagccatgtctcgttcctggagtgagaccatgaaaaggaactatctagaaggctgttcttcgccaggcatggtggctcacacctgtaatcctgggactttggaaggctgaggccagcagatcgcttgagcccaggagttcaagaccagcctaggcaacatggtgaaacccccatctctacaaaaattagcagggcaaagtggtgcgcacctgtagtctcagctacttgggaggctgaggtaggatcacttgagcccaggaggtcaaatctgccgtgagctgagattgtaccactgcactccaggacgagatttttgtctcaaaaaaaaaaaaaaaaaaaaaaaaggctgttttgtggctggtggcaggcctgtggtcgctgttggttcacaattgggtaaaagaactggctacagaccaggggagagcaagatgaagatgaaaacctaccagcacttctgcatgtgcttctcactacatttaaccaagttcacacattgcattttgttgtttcttcagtttcttctaaactagaatgaaaatgtccaaaaccatagcaactagctacatgtggccacttacattaattaaaatagaataaagtcggccaggcatggtggctcacgcctgtaatcccagctctttgggaggccgaggcgggtggatcacgaggtcaggagatcgagatcatcctggctaacacggtgaaatcccatctctactaaaaatacaaaaattagccagtcgtggtggtaggcgcctgtagtcccagctactcacgaggctgaggcaggagaatggcgtgaacccgggaggcagagcttgcagtgagccgaaatcgagccactgcactccagcctgggcaacagggcgagcctccgccttaaagaaataacataaaacaaagtctaaaattcagttcctcagccacactagctacatgtcaagtgcccagtagctacatgtgacttgagatgaacacatcaatgtagaacttttccaatctttgcagaaagttctacttaacatgtttccttaaaataaataatactccctccctttatttggctagattgaggtctttaatctagcacaaaaggacccaattagaatagagccacttgagacttaaccacttatataaattaattgcattattgtgtctattttttcaactcagctgataaaatgtgactagttcttctctccctgtatttgcatagagattagtgaagagatgaaaagccagcaagaagcatatgaggaaataaaagttctagataactcaatcacagatttctccaagaagacaaggacaatcatatagtttatcagattactaacttgtatatctgtagtcctacttttattttctatattttttgttataaaagataatacatgctccaataaaaaattcaaccattatataaacatataaaatagaagtaaaaatgtcctgtaatctcattgccaaatagagctactatataaaaatatgtgtatttctttcagtttctttctctctagatattaatattattttcacatgtttaacaagaatggtttcatatcatacatgtcatcttatgactataactagctttttcacctaatatgtatatttgggcacgttctcttgtcagtatacttcatacttcatatacttcaattttcaatagttgcatagaattttactttatagaagtttcataatttctatagccatactattactggttggattggttttttttttaatccattagaaacaattccataataaaagtctttgagtatttctgttatataagcatattttgatctacctcctttttcatgatcttgacaattatttaaatttattgttaaattggcaattttatatagaggaattttcatataaataaatgaatagaacttttacaatattaaatcagttgctaaactgattcaatcgtgtgtgtatttactttgtgtaaatgttggttagggaaaagagtacaaatacaaaccccaaagtctaaaaatgctcaaaacccactctataactggaaaagacgtacaagtgttaaagtacagaaagggtagttactgggcagaaggaaaatatagccttagggatgggaagaaataaaactgcatgaaaaggaaataaaagtgccataggagattttaatactgcattttactaggctaaggctgacaataaataaagaaggacaataatattaagtaatttaattagtttaaagtagtattttatatatatgttgaacttggtactttacagaaagtacaacttttcaagcatttaaagaatactgacaaaaggccgggcgcggtggctcacgcctgtaatcccagcactctgggaggccaaggcgggtggatcacaaggtcaagagatcgagaccatcctggccaacatggtgaaaccccgtctctattaaaagtataaaaattacctgagcatggtggcgggtgcctgttgtcccagctactcgggaggctgaggcgggagaatcccttgaacctgggaggcggaggttgcagtgagccgagatcacgccattgcactccagcctgggtgacagagcgagacgctgtctcaaaaaaaaaaaaaaaaaaaaagaatactgacaaaaatcatgctctaggtcacaaaaaaaacctgcaacaaatttttttttctttttttttttttgagatggagttttgctgttgttgcccaggctggagtgcaatggcgccatcttggctcactgcaacctccgcctcccgggttcaagcgattttcctgcctcagcctctcgagcagctgggattataggcgcccgccaccacacccggctaattctgtgtatttttagtagagacggggattcaccatgttggtcaggctggtcttgaactccttacctcaggtgatccacccgcctcggcctctcaaagtgctgggattacaggcgtgagccaccgctcgcagccaacaaattttaaaatgcaaaattgaatagcctaaatcttctgaattcaatttcatacctctacaaattaaccacaaaaggttagtcaaaaactatgccccagttagaatatttaattggattttatttatttatttatgtatttatttatttatttgagacggaatctcgctctgtcgtcaggctggagtgcagtggctggatctcggctcacttcaacctccgcctccgggttcaagtgattcttttcagcctcccaagtagctgggactacaggcacgtgccaccacgcccagctaatttttgtattttttagtagagatggggtttcgccatgttggccaggatggtctccatctcttgacttcatgacctgcccgccgcggcctctcagagttctgagattacaggcgtgagccactgagccgggcccaatttgattttaaaacaaaaattaaaataaattattctaagtatattttggattaaacaaaaaattaaagatcaaaatagaattgcaataaacatttatttgggctgaataacaaaagctgagcattaaaatcaacattcaacaagaccaaggccaaatatgagtatcataatgataaaataaacttctagaacacaaaaataaaacctgatattttatttttttaacttaaattattgccaggaacagtggctagcacctataatctcagctactcggaaggctgagacaggagggtctctggagcccagaaattccaggctgcagtgagctatgatctcgaactgcactctagcctggggaaaagagtgagttccatctctaaaaacaatttaattattattgcaattctatcatcaaattataaatgcctaagactagcatagaggaacacaaatttctcagcactgttacctgctagactcctcctgcagaaatctgctgcatgtttgccataccaaacagatgtttgctttcaattaaggcagtctgtactgggacctcaagtctgaataggcattatctaggtgaagaggtagggaaagaggaatccaggctgaaggaacaacatgtgtcaaagcagaggggtaagataaatatgggggcttctagaaatggaaaaacgttcattgtagtcagaatgcagagtgggcaaaaggcagggctggggaaggagaacttcttgcaagatgtgatattggagaggtaatataccgtcatattaggaaacccttgcacaccacctggagctgaggctttcgcacttttttgaccatgactaaaagaaaaagatatatttcataataccaccagcttacacatttcatgtatatgtatataagaactatatttcatgcgaatacttttactatgtccaaagctcttttgtattttctattgcatgttcacttttacttttaaaaaattctgtctgtcttctactagactacactgagcctttgtgtgaattagaaataagtattctctttaggcagatatagcttagagattgtgaagaccaggccttgaaggctggaaggggcagtggaaagtgactttatccaaaaaagatgccccttcctcaagttggatgaagctccacatatttgcccccaacatttggagagcgtggggcaagagtgcaaatggaagcctacatacccttaagtctatttaaaaccgtagaccaatctaacaaaccaataaataaaatgtgttctggccgggcgtggtggctcacagcagtaatcctagcactttgggaggccgagtaaggtggttcacctgagtcaggagttcaagaccagcctggctaacatggtgaaaccccatctctacaaaaatacaaaatatttgctgggcattatggcaggtgcttgtaatcccagctactcagtaggctgaggtgggagaattgcttgaacctgggagggggaggttgcagtgagccgagatggcaccgttgcactccagcctggatgacagagagattccgtctcaaaaaaaaaaaaaaaaaaggtttctacccttctacctcaacttatataacttcatagtgacctcaaagattcaggttccaatttagaattcttggactcagaattcaatgtaggcacataacttcaagcctgctccccttcttttcccaccctgaattccaccctatccaaaaagggctttttgtccatttacatctgaacactctgtcctactaatctcacagtcctggagagtagaagtctgaaatcaaagttggtagagccatgctccctctgaaacctttcttgtctcttctcagcttctggtggtattcaggcaatccatggcattccttggcttgcagctgcataactccaacctccacctttatcatcacatgatattctttctgtgtctctgtcttttttatggccctctgttataaagactgcagtcatattggattaggacccaccctactccagcatcacctcattttaactcactacatctgcaatgatcctatttccattctgtggtactagggattaagacttcaacatatcttttttgggaagacataattcaacctataacaaactagtaaattctgtatttgttgaatgaatgaatgtgattcagaacgctggaggagaaatttgccttactccagaggacaccatactattgtagtgagagggaatgaaaaacagtggatacaaatgaaagctggtgtaaggaaattgtgtcatctgacaacatcaaaattctccatgaaggaggtaaaatcatatttttaggtgaggaaagaattgggataggggagaaaggagtgaagagatgtggaggagaaaggaagtctgaggaacgaaaactgacaaagtggctgggcacggtggctcatgcttgtaatcccagcactttaggaggctgacacagatgtatcacgaggtcaggagttctagaccagcctgaccaacatggtgaaaccctgtctctactaaaaatacaaaaattagccaggtgtgttggcacgtgcctgtagtcccagctactcaggaggctgaggtgggagaatcactgaacctgggaggtggaggttgcagtgagccgagaccatgccattgcactccagcctgggtgacagagtgatactccgtctcaaaaaaaaaaaaaagaaaaaagaaaaaaaaagaaaactgataagggaaataagaattgcctgtagtattgagagcccggttgagttggagactataaatttatggtggcataagtctgtgctgccatgtgatttaggcagcaaggctcagtaatactggcatgttattgggaaaggcaactggttgaatcaatccatagctggggtttttccaggtagtgttacagactaatgggttcttcttgcccactgcacagaaaagccaatacaatgagatagcagtgttgcagcagagagtttaattatagcaaggcaactgaatggaaggataggagatatttctcaaatctgactccccgagaactcagaggctagggttttgaaagataatttggtggactgggtttagggaatgaatactgctgattggttagggatgaaatcatagggacattgaaattgtctttgtgccctgaatcagtttctgcatggggggtgtcagggaatcacaggacccacagagtcagttctttggcatgggtcacaggtacagttagcatctgccaggatgccaaagtctgaaaaatatctcaaagaccagtcttagattttacaatagtaatgttatttataggagcaattagggttacaaatcttgtgacctccagctctgtaactcctgaagagtaaacaattatagaaaagcaagctagggaacaatggcttgttatcgtttaactgtatctacatcttcacagaattcaggccactcccataattctaaccttgtggactttcattagctttagggaggtagttttggttcctgaacaataagggttagttttaagaagggactgctgtcatccttgctttaaactataaactaaagtcttcccatagttagcttgaactatgcctgggaatgagcaagagtagttaggccttgtgaagttagaagcaagatagagtcagttatgttagatttctctcattgttataatttttgcaaaagtgatttcagtagttgcccaggaaagaagacagggtaaggaagttgggaatattgcacgagagggccaccaataaacctcgaaattaggctggataggaagggaagttaaaaacaagtaggatttgatatgaaatgcagaggtccttaacttttcatgccatagacactttgccagtctggtgaagcctattgaccccttctcaaaacatatttaaaaatgcataaaagatgctcttcaatttacaatgaggttacgttccaataaaccccattgaaaatactgtaagttgaaaatgcatttaatataactaacctactgaacatcatagttttcttagtctaccttaaatgtgctcagaacacttactttatcttataattagacagaatcatctaacgcaaagttaaaatcttgaatatctcatatgtttattaaatactgcagtaaagtgaaaaacagaatggttgtatgagtatttgacctacagtttctactgaaaatgtattgctttcatgccgttgtaaagatgaaaaatcataagttgaaccattgtaagttggggaccatctgtataagattacaaatgaaaccctttacattaaaatacaactatcaaaatatttaaacaaaccaaaagtgtcccatagtaatatatgtgcttctttgcattaaataacaaaatctgtgacaggcttaaagagtatcataatttctacatagaaataatgtagaggtttacatatttgtatctgatctgaactgtaagatatataaaaatagctgtgggtctcagttcctctgggaaggtaagagcctaactctggtgggcaagtgggcaccttgctccagtttgcaataattgcctttctaatttcatggacattagatgccacatggatgaaagaggcaaacaccatatccacatcccattctaccccaaacttcagatcctggatgtccttttctgacatggcaagcaggtccacagtcaccaggaaggtctacaccctttttgctgcccaaggagccataattttccattgctatcaccaggaggtcagtacctttctgctccaactgcagagaaataagttattaaatctatagatcttgctgcccctttccactaccttacaaatgttcttgtagtccagctacaggaagttctcatcataagttttccatgtaggcattatccagtgtgatctgaaggtggctcccttcttcagctccacctccatggggacactgctctgtgtgagcccagttcagatctcaggcccgttagtgtccagagccacagcaactagccgctagagattggggtcagaagcaaggctttccatagttgtgcacacattcctgatggtctctgcgtggtactcgtaagttcagacaagccatattaattccagacttaatcatcaacatttccaccaatcaggaaactaggccgatagtacagatgatgccagtgctctgggctgtgggggtggccagtgagtgttcaggcagcacacatgctacagcagtgtgtcagccaccaccgtgggcagctgctgagtctgaaatgaaggccctcctggcttcactgtggggcttccacttggcttctgaggtctttcagcgttttctggctcagactacttgcaaatgcagagaggtcaggagcctagggacattcactcctgtccattatatatgttttatttccagaatgtctatttgattgttttcatgtcatccaaattatttttgatggtcttttatttctgtatcatataccaatgccttcctttatttctttaaacattttaacatactcattttataatttttatttaaaatttctgtatctgaagtccttgtgagtctggtcttgaggtttgaagattttgctaattcttattcgtgctggctcagttccttgcgtgttttggatttttttttttttacttttaaatgtgtttaagttgacatataattgtacatattcatggggtacatactgatgtttcaatatatataatgtatagtcatcagatcagggcaattagtacatccaccatctcaaacatttatcatttctttgtgttaggaacattcaatatcctccttcatgttacctgaaagtatgtattattgttaactatagtcatcccacagtggtgtagaacactagaacttattcctcctacccagctataattttatatgccttttttttttttttgagatggagtttcgcttttgttgcccaggctggagtgtagtggcgcaatctcggctcatggcaacctccgcctcccgggttcaagcgattctcctgcctcagcctcccgagtagctggaattacaggcatgcaccaccatgcccagttagttttttgtatttttaggagagacggggtttctccatgttggtcagtctggtcttgaactcctgacctcaggtgatccgcccacctcggcctcccaaagtgctgggattataggcataagccaccacacctggccttaattttaaatcctttaacaaatctctccctaccttcccatctcccatacccctgctaatctctagtatccttcgttctacattttacttctatgagatcaactttttttttttttttttttgagacaaagtctcactcttgtccccctggctggagtacaatggcgcaatcttggctcactgcaacctccgcctcctgggttcaagcaattctcctgcctcagcctcttgagtagctgggattacaggcacccaccaccacatccagctaattttcgtgtttttagtagagacagggtttcaccatgttggccaggctggtctcgaactcctgacctcaggtgttctacccacctcggcctcccaaagtgctgggattacaggcgtgagccaccatgcctggcaagatcaactttttttagtttccacatgagtgagaacatgtggtgtttaactttctgttcctggcttatttcacttaacatagtgtcttccagttccattcatgttactgcaaatgacatgatgtcatcttttttatgactgaatagtagcccattgtgtatatatacacaccacattttccattttttttctttttgagacagggtcttgctctgttgctcaggttggagtgcagtggtgctatcatggctcactgcatggctcattgcagcctcaatctcctgggctcaagtgatcctcccacctcagcctcccaaggaactgggactacaggcacacactactgtacttagctaattttttaaatttttcatagagatggaatctttctatgttgcccaggctggttttgaactccttggctcaagcaattctcctgcttcagcttcccaaagtgctgggattgcaagtgtgagtcactgtgtccagcctaaattttatttacccatttatctgttgttggacacctaggatgatttcatatcttagctattgtgaatagtgctgcaataaacatggggatgcagatgactctttggaaaaaaaaatagctgtgctttctattggtgacaaacccatagatattgctagtactattgtggtgtacagtttacatttgttattgaaagaaatgctaaatttcagttagtgtttagtaaaagtatacatattttcccctgtccaagttcatagacttcttgaattttatccatggttctctatgggacagtggaatcccaggtaaaaaggactgaagtggagggagaaagtggaggaagtcaaagaactgataaaccaaattgtatggacattgacatgtaaatattagaaatagatattacagaatagagccatgaacctggtcccaaactcttcaaaattaataaggggcagtaaccacaaagtaagaaaatgatagcctcgaagtaagacaaaaggtgacaggccaagtggccatgaacatgaaaagatcagggggttttacataaagatggaggagtaattgttaagaagtggcagtagggaggccggacacggtggctcacgcctgtaatcccagcactttgggaggctgaggcgggcagatcacttgaggccaggagttcaacactagcctggccaacatggtgaaaccttgtctctactaaaagtatataaattaggctgggcatggtgtctcacgcctgtaattgcagcactttgggaggcagaggcaggtggatcgcttgaggtcaggagttcaagaccagcctagccaacatggtgaaaccccatttctactaaaaatacaaaaattagctgggcgtggtggcacacgcctgtaatcccagctacttgggatgctaaggcagagaatcgcttgaacctgggaggtggaggctgcagtgagccgagagcgttccactgcactccagcctgggcaacagggcaagactccatctcaaaaaaataaaataaaataaaaaataaataaaaatacatacattggctgggtgtggtgacatgcatctgtaatcccagctactagggaggctgaggcataagaatcgcttgaacctgggagccggacgttgcagtgagccgagattgtgacactgccctccagcctgggtgacagagtgagactctgtctcaaaaaaaaaaaaaaaaaagtggcagtacggagcaaggaagatactaaccttaacttcatacctgagggaggaagcaagctgcagcaagagaaagcagtaccctaaggaaggaagaatcagattttaattagggcaaggacgtggaagaaatgcatgcacccaaaaaaaatggtggaggatataggggtagtttcttatccctgtagactgtgcaatggaaggattgagagagagagggccatgttggggggtagtgtagactagaatggctgcaaatggatatgagaggatagattaccagagaggtttaattttttaatggtaatataaacccactagctagagattattctactgtccagagataaccagtgtaccattaaacatttggactatttattgctataaactttgtcatcaggataaaattaaaggcaacctaaatttctaaaattgattaaataaccgtttaatatctacaaaaataaaatgcagccaggcgcagtggctcacacctgtaattgtagcactttgggaggccaaggcaggtggatcacttgaggtcaggagttcgagaccagtctggccaacatggtgaaaccccatttctactaaaaatacaaaaattagctgggcgtggtagtgcgcactgcagcctgggcaaccaagtgagactctgtctcaaaaaaaaaaaattaaaaaataatccaggcacagtggctcatgcctgtaatcccagcactttgggaggccaaggtaggcagatctcaaggtcaaaagattgagactatcctggccaacatagtgaaaccctgtctctaccaaaaatacaaaaattagctgggcatagtggcgcgtgcctgtagtcccagctactcgggaagctgagacaggagaattgcttgaacccgggaggtacaggttgcagtgagccgagatcgcgccactgcactccagcctggcaacagagtgagactctgtctcaaaaaaaaaaaaaaaaaagaataaaaaaaaatgctctcaatattgccaatgaaaagaatgagtagaatttttaataatgttgaaaattgtcatgatagaaattaaatgagctgggtgtggtggccctcgcctgtagtccgatttattggggaggttgaagccaagaattgcttgaacactggagttcgaggccagcctgggttacatagcaagatcctgtgtctaaaataaataaatattttttaaaaaagaatattaaatgaaaggaatcaggatgacaaactgtatataattcaaattttattaaaatttatatctgcatagaataatacatcaaaaattgtataacagttacctctgagtggtgggattataggttattttaatcttcatatcttccttatttttacatttcatatcttttatatatctttttataatttttgtaggttaaaaaatagagcctttaggaaattagata

SEQ ID NO: 63 - DNA, 3848 bp, Homo sapiens
  source 1..3848: mol_type = genomic DNA
ctatgatcagacacaaatccaatcagaaatactccatgttactcttctcttccatccctgcttgtcttaagtgccaatgatatgtcaggtattttgctggtttttacattcctttattccctgacaacttgagttggcttttcctagttagtacataagatgatttaatcttgcgtatgttcataaaacttggttctgtgactgccaaatatcttttgaagtagtattgtcactctgttcctcttttaggaggaatatggaggtgtagagtaggtcagttttattccttggatattggtgtcaggttgggtgtaaatattttccaaccaagccctgcaatccagtgcagtagagctaaacggacagtgacccatgttcagtggctgaatgtttgctgtggacctgggatgttaactttgcaaaacaaggtataagtggaacttttccaaaaatgttttttgagagtatagtgttgaaactgccactggagcaaagagcctggacagataggattgcaatatggagtccctctgggcttcgttcatctgcttttacttgtctgagccggtaaagggctgggatcaaatgtggatggctttcctaatgatagccaagatttactgaggacttgcgatgtccatccgctaatcagtgctaagtgctaggcatggcttatctcctttactcttcaacaacagtcttatcggcaaggttctagtattatcctcattttactgataaggaaatgaagccttagaaatattaagaaatttgcctaaggtcaaacaccaaatgagtgccgttcttcattctgtaatagagcttcttttacattgtatacatttaaggaatataacatgatattttgaaatacatatacatagtaaaatcatatctacagtcaagctaatttacatatctttcacctgacattgttacctttttaatggtaagagcatctaaaatctaaacttttagcacatttttcatattcaatgcaatattactaattatagttctcatgccgcatattagatctctagacttattcatcctatgtaacaacaactttgcaccctttggcctacattttggtccacatttccccaattcctccttcgcccctctatgcacccagtgacccctattcactctgtttatacgtatttcacttttttttagattccacatgtaagtgagatcatgtagtatttttctctttgtgtttggcttacttcacttagcataatgtcctccaggttcatccatgttgtcacaaatggtagaatatcctacatttcagggctgaataatattccattctctctccctctctctctctctctctctctctctctctatatatatatatatatatatatagatatagatatatacacacacacactatatatatacacacacatatatatacacatatatatatacaacatatatatatatacacacacacaaccagccgatataagaactcattccttcaataggcactctctctctctccctctctcatatatatatatgaatggataaagaagaaattgtgtttttatatatgtataagttccacttatacctatacatacctctctctatatatacacctctctctatatatatgtgtatctatacctctctctctatatatattcatatatgttctctatatgtacatatatatagagagaggtgtatatatatataccttcttcttaaagaagaaattgtgagagagatatataatatatatatcgtatatgtataaagtatatatatatatatacacctctatatatatatctatacctctctatatatacatatatgtatgcatacatatatacgtatatattcatatatacgtatatatgtatgcatacatatatgcatatatattcatatatattcagctcctttgcccatttttaaatttggttttttttttttttttgctattgagtcatgtgagttccctctatattttaattatcaatgccttatcagatgtatggttggcaaatattttctcctaaatctgtaggctgtcttttcattttgccaattgttcactgtgcagaagctttttagtctgatgtagtctcagttgttcattgttgcttttgttgcctgagcttttgttatgatatccaaaactcattgccaaggccaatctcaaggagctttcctcctacactttcttctaggagttttatggtatcagggcttatgtttaggtctttaattttgaattgatttttttgcatatggtgtaagataaggatccagttgcattctttggcatgtgaagatccagttttcccagcaccatttatggaaaagaccaacatttccccattgcaaccttttggtggccttgttgaaaattgttctcactatatatggttaggcttccgttccattggtttatgtgtccacatgttttgattactatagctttttaacataatttgaaatcaggaagtgtgatgcctctcacttttttttttttcttcagattgctttggctatttgtgttctgttgtgacataacttctaagaagggatttgtataaaatgtgtacaacacgttatggtttattaactttctttcactggccttgtttaattttactctcaccttatctttttagggttggtgacattattctgattttgcagatgaggaaacagaagcacagagacgttttgtggcttgctttgctgtccttaggcagagaggagtctgatggagagttaactatagtattctccgtggcagatggctgtgcctcctgtccagggcaatttgccttagcaggctggagaacaaagagcactgagccaagagtccttggccccaccaccttccatataacctgaggacttctgtttcctcaatatggttcttggggtcgtttttaggatgaattgggttttgtgagaattgtgtattgccatgcaaatatatgttatgaataatacctttgaacagtcattcttcagcttatggaagcctatccatttaaggtagaaacttaagatgtatctttctcctccctgtatttggtaaagttaggagctagggcagcatagttgaaatgaattaaaagaacttttttttccatttttctaatttctatttccataatataagtacccattcatggaaaaataaaaattaggtaagtgatagaaattacaaagaaagttacaaatattcaaaatgcttcagtctaccaaccttgaagaataaaatattttcctattcaagaacaaagaatcttgtggttatgttgatagagaaaatatctttaagccacactttttaaaagtcatgcaaaaataagctctgaggtttatttgttttagtgggctgtgctccactggcatccttcctgggaacatcattcttctttccttttgttttcccctgaatttttgagcataggtttacagtttgaagggggaaaaatattttcagcttacatttactgttttttttttttcagtaataagaccacataaggttgagatccaggtatgagaaagcttaataaaacttaatgtcttggttcttgatgaccagccagtgcacatgccactaagtaagtgagattcatcctctaaggattcacagtgaatctttaaccctgcccttgagaaagtattaaagaagatccagagacgggagcaaaacaaaatacacaaccagagacactgtgtgctgtcagcagcaggcatgtactggtcaaggaattagatgactcaaggtggtgactcattcagcaactatgtagtgtttgcggttgaagagaaaccttggccag

SEQ ID NO: 64 - DNA, 8239 bp, Homo sapiens
  source 1..8239: mol_type = genomic DNA
gctcctctattcctagtaacagaatcattatctcaccaaacctcaagatttttaacctcatttctcatttagtgttaaagaatatatgtcacatctaggctgtttttcccttttcttgacaagatgtcttaggtaaagagatcagtgaatagcaaattatggtggtttcctttttttttttcctgctgtttgctaacaaagtcaccattcacgtaaactttagggctattagacatgattcacccctaacataccatgtagctttattcgaaaagtaaatggctccagcctgggcaacagagcaagactctgcctcaaaaaaataaaaataaaaaaacaaaaaaaatacagctgcttaatccttgattttagttataatttacaataatcattacctgcttaacctctggatcaaatgcctgctcctttgctgaaataactgtgtacagtgtatatacaaatatatacagatacatatccacaccccaaaagtttcttcattggctgtctatgagtttaggctgtttaaataatttgcaacacattattgtagtaaatagaataaaattatatgcagattagctctttcttttcttacaaaatacagcaacacatacatgctaggacaactttgcaaaaacttacttattctgtgcctttccagttctgtcactgtactatagtactacaaggcaggttaggcaacaattaggaaagtttcagaaccattagtctcacaaactttcatctaggatgcctctggtggcctctgaagagatcttctccaaaccctcatctgatgctattgcaactaagtagacgaactacggttctcagaatatacacattaataaggctctttttagcttcacccttttcacttctgtgctttatgatggactacaatactcataatgcaatactacagcccctatcattgacactatcatttccatcaaacacaaagaaacctccttctggattaccaaaaactaagaaatctgggccaggcgcagtggctcatgcctgtaattccaatacgttgggaggcggaggtgggcagatcatgagggcaggagctagagaccatcgtggccaacatggtgaaaccccttctctactaaaaatacaaaaattagctgggcgtggtggcacatgcctgcaatcccagttactggggaggctgaggcaggagaattgcttgaaccagggtgtcagaggttgcagtgagccgagatcaggccactgggcactccagcctggcgatagagcgagactctgtctcaaaaaaaaaaaaaaaaaaaaaaaaaaaaacttaagaaatctcttagttctagtgttatgagaactaggagtaacctgaactcagaagttgtttatgagagtataaactggtacattcactttagaaagcattctaaagataaacatgtgcacatccaacaattacgctcttgtttttatatcctcgtgacatgaacaccaaaagatatgcaaacatatttataacagcatttttcataatattaacaaatgcaacaacccaaatgttaattacaagatgactgtgaggcccggcgtggtggctcacgcctataatcccggcactttgggaggctgaggtgggcagatcacgaggtcaggagttcaagactagcctggccaatatggtgaaaccctgtccctactaaaaatacaaaaattagccaggcatggtggcgggcgcctataatcccaggtacttggggggctgaggcaggagaattacttgaacccgggaggtggaagctgcagtgagccgagactgtgccactgcactccagcctgggcaacaagagtgaaactctgtctgaaaataaataaacaaacaaaagatgactatggtatattcacacaacagaatttcacacacagtaaaaacctaatgaactacagttaaacacacaacatggatgaatctcagaaaccatgaattttaaaaaggaagtcacataaggtcatatgcaataaactatcatatttgtacattgcaaagaaaccagtaaaatgaaacattattatttagaaaaataacaatgtaattttacttatttcattttattttgagacagggtctcttgcccagacaggtgtgcagtggcacaatcacggctcacaacagccttgacctcccagctcaagcaatcgcaatcctcccaagcagctgggactacagatgtgcatccccacgcccaactaatttattttattttttgtagagatagggttttgctatgttgcccaggctggtctcgaactcctgggctcaagcaatctttctactttgcctcccaaagtgctgggatcacagacatgagacaccacaccaggacccctggtaattttgaaaaggaaaagtgtttaaaaacagtttagtgggagtcagggagatggactgaggagtacacatttagcttcaacaggactggtaaagttacaattcttaagttgggtaatagtaggcttattcgtttcattaagctttaaacatatgtgtatgtgttttgagtgtgtatcatctagaatctctggaaaactaacattccagctaatcataaggtgacattcctgataactgggaacgatgccaaggaataaaatcactttattattactatttgataacttttgtagtaagaaaatgacaggtgcctcgaaaaattaaagcaaggggtgggtaagggaagtgagtgtggctaaaaaagcaacatgaggaatccttatagtgctgaatatgttctttatcttaactgtatcaacataaataccctgcttatgatattacaccatcgtttcaaaagatgttaccattgggagaaacagggttaggtgtatattagatttgtgttatttcttccaactgcatgtaaatctaaaactacttcaaaatagaagtttacttttaaaaacaacaatagaaaaaggtccttttagtcctggatttctccaccttggcactactgacattttgcagcacctaattatttcttgtgggtctgtcctgggaattgaagggtagcatccctggcctctatccactaaatgccagtaatgtgcctccattcgtgacaaccaaaaatgtctccatacatgccaaatgtcctcagggggggaaaattgccccagttgagaaccagtgctctagtcataaaagccaagaagagatatgaaaatgttcctaattgaagaagatgaaagagatataacaactaaacgcaatacttgatcctggactgaatcctgtcctggagggtaaagaatgctataaagaacattattaggccaattaacaaaattgaaattaaatggtagattaaataaaagtattgtatcaatattaaatatacctaagttggtaactgtagcgtacttacgtaggagattactgctatgcttaggaaatacatactgaagtatttaggggaaaaggatcgtgatgtatgcaatctaccatcaaatgattcagaaaaaaatatatagaaagatatatacacgtgaatagtatatatatctgtgtgtatatgtatttaatgtatatattgacatatatagacatatctacgtagcaggtggatctgattaaagagtatgcaagtgtgttctttgaactatattatttttgtaacttcgctgtatgtttaaactaattacaattcaggtgtggggtttaagtggaagaaaaaaaaaaaacttttggccgggcacggtggctcacgcctgtaatcccagcactttgggaggccgaggcgggtggatcacgaggtcaggagattgagacgatcctggctaacacggtgaaaccccgtatctactaaaaatacaaaaacaaaattagccggacgtggtggcgggcacctgtagtcccagctactcccgcctgggcgacaaagcgagactccgtctcaaaaaaaaaaaaaaaaaaaacttttataaatcctaaaggcaggtttcacagcagtagtacagcataagtgataaacatcccaagaagataatgactactaacgggataaattcctacttcaaccccaagacattcgttggaaagaattatctaccttcagcctctctctctctccttgcctactttctggaggtgaccccctgaacagtgcgggacagaaaattaatctatcccattaaaaaaaaaaaaaatttctaggaagtgactcaataaacctacatctccgctcgatttctccacaaatcactgaggcatcttcatcctcaacaattaagaagcaaaatcgaggaaagcatacaagtgtttcaaagaaaaccacttatgcactcagctgagcaagaacgttaagtggactagagaagagacaacacggaatgtctaggaggagtgagtaaaaaggaaggactaaaaagagataaatcaggagccagtctgagagagctagaatgcgtatgcccgccagaaaaaaaagtattccaatgagtgcgagtgtgtcagcgggagaggggtagctcacctggctgtggtaagcagagggtgctgagtgcccaccagcttccgcacctgcatagcgatgttgctgagctcgtcgctcagcaggcagcgaaggctcatgaaggacgtggggtaccccacgatcttctccgcctctgacactacctgattccagtgggccggggacttggaggaccgaccacgccaagagcccaccgaggagatggtgtcgagggacggggaccaccacaggcgacgcggggaacccgaggctccaagataacgtggcaagtgcaacagcagctgccgaaagttcatggtttgagtctggaagggtctgggacctgggggtatccagaagtgccgcgggaaacaaaccaggggcagaggaggaacttacagtaactaaaaggaagcggcaattcttgaccctcagagtaaggtggcttcctggagcagtgaccagaaacgaactttaactgctgctttctgcagcccaggctgggcaaacaacagtcccagctcagcactgcccccggccacccggggtagaaaccacagccactgcctatgtggaggacgccatattggaggcatggaatgcggcctgccgtaaagacagaggcgggttgttaagtatactctctactttacggcgtacccgagaacgcccccgcaggggcggtgctttggaggtgaacccgggttgggaggttcagctcctcccaccccgccgctctgggccagcaaaggtcgtcagtgacagggatcagttgtgggcggcgagtggtccctctgcacacggtatctgggccgagtctggattcattagagtccccggcgcccagcactgagtggcatgcataagtattggtgtcacgaacaacggtcagcccccggcttgcccgcaaggaagggcgtcgggcggaggcaccagttcctcccggaagctttttgtcgctatcgccaccagcccctggcagtggcagtggccgtggccgggcgtgaaggcggcctctcgggctgcatgcctcctggagctggggccacgtctcagtggtggaacgcctagtcggggcgtggggctgagccctcgtgtcctcagggcccaaccagacataaggcagcgtggtgcggcggaaaggggtcccaaggaaagtcctcggatccaacttcgaattaccggcctcctcgctgagccttgggagaaacagcggtgcctccttcccgcgggtgcggagaggaagaatgaaacgttgcctactccctgcctcttatcttcctctttatgcctagcctggagctcaactccaggattgaagactatcgctgaccggagtgcttttcacgtactagttcatgtattactttatttaatcctcagaacaacctcattaagtagataatattagtattctccgtgttttgtatgaggaaactaaggtgcagtcgagtcgcgtaagttccctaagaccacactagacagggatgtgagcccagacaatctggtttcagaatccgtattctaaccgaaagattacaccgtctaaataataggctcccatccactcttttctccttattgctgagaggaaacagtcaatatgattatcttttaagtaatgctacctatttttttttcaaatgtgcctaagatcttacctcctttcttatcacctaaaacaggtgttaaccgttcttaataaaggatatattatccattttttacactcttaaaaatagcttataaaactctctaaaactttcaaaatccttccaaattcatggtattttatttttattttttatttattttttgagatgggtcttgctctgtcacccaagctggagtacagcggcgcgatttcagctcactgcaacctccgcctcccagtttcaagcaattcttgtgcctcagcctcccaagtggctgggactacaggcgcctgccaccacgcccggctaacttttgtatttttagtagagactgggtttcaccatgttgaccaggctggtctcaaactcctgacctcgagtgatccgcccacttcggcttcccaaagtgctgggattacaggtgtgagctaccagctaccatgcccagcctgtcagtattttttaaatgagcatcatgcataatactgtaccagcctcttgagctacaaataaagattgggacttaaagagtagttgttcactttgcaaaacaagatgattttctctacaaaagatttagcttcatactctccctttggcaagttttccttgtgatttaaattttttatttacaaaaattcagtttaggtgtaacttttcaggggcacattttatttaacatgaattgtgattataagtatcaaacacagtctatgcccttaaagtaagtaagctgaagtttgaaaataattcctgtgaaagagataaactcttggcaacaaaattcaggtctgttaggagatgaaaataaatatggagagtgagatactttaccattccaggagatgaaaataaatatggagagtgagatactttaccattccaaaaagttccaaggccagagcttctgggttatccaaggtgaaagaagtcatgaaaatacaaagatagatagagactaatgtgatatattgtgcacctgaggctgtttcttcagcctcatggtaccttaagggtaacttttcacgcaatttcctcaatagcaattcacagcatgtactttaatttctccacagaagccaagtgcattattctctggtcatactctattaaccaagtttttgattattcatgggactttgggtcccatttactttaaataatcagcattttcctttatacttacagttaaaaggttgcattatacttaatgataatcagtttttagaaggttaaaatggtatttgttctttaatctcccagataaatatataattccttagagtctttatgattaaagaaatttctgaattgctagtgacttttggagaaacagggagggggagtatctgtgattctgcccttcctctgccactgataatagttatattaaagatgtctgtgaatgtgtgcataaagaaagaatacagcaggatttctcagccttggcatttttggcgttttggaccagataattctttgttgggggaaggggggcagtcctgagtattgtacggtgttgagtagcattcctgacctctacgtactagatgttaagcagcacccctttccaagttgtgacaacgaggtatgtctccaaacattaccaaatgtctgtcaccctggagtgcaaaattgcccactgggaaatgggagatgctgaaagaaaaaaacagtgtccatccatgacatttactcctacaaagcagcaaaaaagaagtcctgggtgtgagtagccctgcaggttagagagtggtcactccacaacctatggaaactttcagccacactcagggacttccccttggcatcggagttgttttggagacagcacgctgacaaaaaatgatcacagttcctcctctacctttttcaggattctgaagcttataccagtagaactcactgggcactctgcattctactgaccttagaaagaagtaaggtcatatttgatgtccttttctttggctggaaacccgagccagccttggaaaatacaagctcttaacaaggatagtgctgtgggcgctggcatttccatgattaggtgagtggaaatagatagagatattgcagccaccc

SEQ ID NO: 65 - DNA, 3876 bp, Homo sapiens
  source 1..3876: mol_type = genomic DNA
aatctaactgctattaaacatgcaatatattctgcccttacatttttcagccatacctcatattcataaatgggcagattctatggctgacaggaaagtgacagatcattcaaaacatacactttaaaaataacaagtgattctacagacctgctgcttatgaattagacaggcaagccacttatcctacataaatttgtttatgcatctgtaaatttagaatagcaagtgctgacttccagaataagggttagaaacaataatgaatatgcgagcaatttctaaattttaaggttatttagaaacacaagcattttattataaatgctagtcctggaaaattgatgtcatgtttgttatgggacttctattacctcaaagtcctttccatgtcctatcctaaatcgaagagcctccagtgacatgtcttcccgaaccttctatttttctttttctttctcgtctgcatctgtttctaacagatgatgtaacacttacatctctttaagaattctgctgggctgcttagcaggctcctctgaccaattttattgactgttgagacagatttgaaaaaatctgagttttagaatcaatattttaaaacgcagtacctttccaaaactctgtaagctggcccacagctattatggttgataaagtgctgactcacacctttttttgtggaagaaagaaggccgtatgttttaagagacacagccattagattttttcataaatgcaggtggaatctccactttgaaaagtaaatacctccagcatccccccaaaccaatcatttcatataactggccatttttacaagactccaaatacacattcagggacaatttagaggtggaaacctgtgattgttcaaaccatttgatcgctttttcttttaaggagaattaaggcagagaaatctgctctgtcccaagctcaggtgggataccacgctcagagtgggctctttaggaggactccatgcctgcaacagctgccaacagggagcacgcaaaacaggtcatccaacagccacatttcagggaatcaggggctcgctggcggtttccagactgttctgtactctcacaaaaagaaacacaaaccaacttactgtggattcgagccagtcgaagatatgcttccaagagccagagaaaggcaatgaggtgatggcgggacttccagcagtgccacagctgggcgtgtgctcacttaccagcttacatactgcctgggtattgtttatggccattgcttttctatgtgaacgtatgatgagggttgatgtaaatctatgtcaaccatataatccaataaagcaggagctgtgttttattaaaaaataataaaattaaagtactttagggataagctcatggtcttgggagaaaatatattttctcagtgcctcaatttctcagtccatgaaatgggtgaccagataccatgatgttataaggtgttgtaagacagaaaaaaaaataaaaattcaaatttaactggcattcaaatcacctgagtctcttgttgaaaagtaggttctgattcagcaggtctggggggagatcagatattctgcccctctaaccagctccctggtgatgctgaggctgtattctggggaccacacggtgagtagcagggagatagaggagaacgctattcctaggcagcatagtgttttatgcttcctagggttgcctagtcagataaattgaagaaaaggaactttacagtgaaatataatccaaatgccataagggctatcaaaaggcaaagtgcattaaaatattttattagaaacaagatagaacaatgggaagacttgagtaattgtttccagtctactttcaatgtgtttcctgatgaccaacatccaactcatttctcctggctcagttcagctagtgaggactaagcagaggtgtgttattcacacctatttagatgctgtgtcctggattgtcgagcacagccctcattttaaagttctgcttcatcgctccttttagcacattctattggatcataaatccttagttctggttcagacaacatggccactatgttagtttaggctgtctcactgctctaacagctacggtttcgccttatgctggctggcgtcgagttggggctgcacactgtccttcggggcccagctctcttcttcctagtggctctgctgttccctagagtctcaagttccttgggtcctctgcatttgggtgatgttttagagaccaggcctgaaagtggcagacatcgcctcgtctcctggtgggagcccagccccatgactcccctgactgcagggcacgcagagccagacacagggccaggagggaaggaaacacagcattctctctgcccggctgcccatttagcactaggtggattattaactctctaaacaatgaagaacacactggacttgaagagtgagtgccaacagggaagggaagggatggcagcggaacgtgagctcaggacaggctctaagctgggccttgggacccatctcttgcccagggaaagggggtctttggagaactgttagctccctcagaccaaatgcattcccaccacagccgaaaggcctcccaggaactagagcagtccacgagtgaggcccgggaagaggagtacaggacagtctgcagatacagggggtctcaggtgcagctcagaccttaggaatctgaatattcccccaaggcccattccaccccatccatgcctgacaaaaacactccgcttcttgatgaggaaggaatcattacccggggcccaactggactgcccccaggggtgtgtgtagggggtggggggtgagtgtggttgtgtgtgtgttgtgtgggggagtgtggttgtgtgcggggtgtgtggttgtgtgtggggttgtgtgtggagtgtttgtgttgtgtgtggtttgtgtgtgtgtgttgtatgtgatggtgtgggtgttgtgtgtgatggtgtgtggtggtgtatgggatgtgtgtgtggttgtgtgtgaggtgtgtgtgtggttgtgtgtgggtgtgtgtggttgtgtgtgtgggtgtgcgtggttgtgtgtgtgggtgtgcgtggttgtgtgtgtgtccgggaatggcaggagagggccgtcacagttaatgtatatgttacactcagagaagactcttaccaccaaagctcaattatttttcaaactctaaatgcagacaatgtagccatatggaaaaattggttgatgacaacaaaatggtttgttgttgttgttgttgttgttgttgttttgtagtttggtagatcatctctatctggccgagtattgttcaaaccccctcctgagcctcagccagggactgctctagctcctggaaggccacgtggctagcgttggaatggatttggcccgagagagctaaagattctccaaagagaatctttgtcacaaatatgttcctttagcaccaacttacatgacatgactttcgggtcaaatgcaggtgacaatgaccggtctgtgcgtcacacagggttcccaccgtctgcttaggttttaaggtgaaactgattctaatgatgttttcagtctgtgtggttttgtgtgtgaaactaaaggcttgctctaagaaagcacatggggctgaggcaggagaatggcgtgaacccaggaggcggagcttgcagtgagccgagatcgtgccactgccctccagcctgggcgacagagcaagactccgtctcaaaaaaaaaaaaaaaaaaaaaaaagcacatgggcgggctaatgatgattttgtctctgagtttgaaggaattcagccagtgggcggagggaaagtcctcattgtagaaattaaatttatatcccaagga

SEQ ID NO: 66 - DNA, 27445 bp, Homo sapiens
  source 1..27445: mol_type = genomic DNA
ctcttcaccctagtgataggtgttgtgttcatccttatagaccacttggagcggattgtggagatcgcccggctgcgtgcggtccagcggaaggcccgctttgccaagctcaaggtctgtgtcttcaaggaggagatgcccatcaccccctatgagtgtccgctcctcaactccctgcgatttgagcggagtgagagtgacgggcagctttttgagcaccactgtgaagtggatgtgtcttttgggccctgggaggctgtggctgatgtttatgacctgctgcactgcctggtcacggacctctcggcccagggtctcaccgtggaccaccagtgcatcggggtgtgtgacaagcacctcgtgaaccactactactgcaagcgccccatctatgagttcaagatcacatggtggtgagtagccccggtaggcgagagtcccatcagggaggatgtccaccttgcttggtggctctgggagtaagatccctgaaggggctgctgactgccccagaatctgccgaggtgagaacagcatcctgaggcacagctcccaggggacagaggtgtagctccaatctccctgactgcacctcagggttgggctcagggcttgcggcctgcaggcactccagccagcgctcacctggcctttcctcaaggcatggtagtctttccttgaggctgatagctagggcttgaccaggaagtcccgagaagttttgtcaccttcttgaccttgcaagagagtttctgcccattttagagccacgttaccaaatcgatgtaggcctaatcacttcctcaaccctgttcaagcgtccctcccttgtgctcagtatattggtgtgaacacggaacatgatgggggatttacctgaccagccaccccatagcccctggctgaagaagaaagagcatcttctctcccactgcaccccttctcctccaagaatagttgcccacattcccaaaatgtggaaagacttttcttttccttccggaacatgttcttcaccaccttttggagatttaaccatagctgccaaagctatgcacccagttggccttagaaaaccacaatgtttacagccctgtcttagggccgcggcttctcttatcttccaccaccttccttgcttgcagggttatcttctcacagggctggaatgcaaatttcagaggcttcttttgaagattccccaagtcaagcaggcaagatgcctagatcttctgttatctttgacatgtaacatcctttttagaggctcagaacacctccttggctgctatctcatgtgttagaatccagtttgtggtgaacctctttggaaggggaccccctctctttaaaccctgttcctctgtcctggtaacattctccttctaggagagcctctcttctgagaaggtaaaggaagggctgggtgagacacacagctatcctaggagccgtaggaagacaaaacttcccttttgttttactcctcactcctctatttttgttttactcacttctttatattttgttttactcctcactcctgtatattttggtttacttactcctctatttcagaaattgaaaaagatccccaaggatctgttactactgcatttccttcttgctctgtctacagcctaggccaactagtcagggtctggacatgcatctcctaaaggaagaactgtgtagcaccattgatcacaatgtaacatttccatgctgcattaagggtgtctctctctaatcatgattgtacctgtctcttcctgggtaaagggagatttttttttttaatgtgtaaagaattgatgcgagccaggaacatgtctgtagtcccagctacttgggcacacgcctgtagtccaggccactcgagcacacacctgtagtaccagctactctggaggctgaggcaggaggatcacttgagcccaggagattaagactgtagtatactatgatcgtgcctgtggctagccactgtgctccagcctgggcaacaccatcgtaaaaataaataaataaataaataaattggggaggacagcctcactggtatcagacttacaggaccagatagacaagatgggtataaggggagctgaagtctgtgttcatatgaggaagagaagaccaagccctgggactttggctgaattcctccgtggggctggacggcagtgatctcctgttccctatgtgtaaacaaagattccagggcgtggttttgcactcctgttgtactcttttagaggtggaaaagaggtggatactgagatctaagaggaaaggatagtcattcacgttctgagatatgcgctctctctattgttctcgtacacaaagggatagtctcttttctggagctgatgtccctgcttggaggttagccccaaaacatggctcttgtattgttctaagagaaaaggctttcattttggttcttctgattggtgttacctactgcctaatatgtgttcattttttgacagagaggcagactattgaaaaagtctgtgtgaacagagagcagttcattaagcccattgctttcagtaatgtggccttgaccccttctgcttcccccttctcccatggagcatggcagggcttggttatttagagtccatacatgcaagccattgagagacttgtttgctcaaatgcaagtttgctcaaaaacaggtcctgaaggcttgcttaggattacagggatgctgggtaagaacaccgttcctctctctcgctggagaaatccctgtttctctgactccctttgtgatcctcacagtaatgtattctgtgccactgtaggacacaaggctctgggccagtagaacaggcagagaggtgacactgggcagcaagctgagagctctttctaaatggagtgaaggaattcagtggcctagtttcgccattctctaatgagaaaccaaggccaggctgaaaagtgcaattagatgtggtggattgtggtaacggcctccagataaaggggttatccctgtggaagtgacttttccccatttgatcccttttcaactctaaatggccaggcccagaacagaagaagggttgggtctggaaggaaggctccaaaggatgaaagcttctccctgatcataaggaagtgcatctttatagaattgttgtgcataatgtcagtaaatccctctcacttgacaagggactggattcatcttgccttgagacgggccagtagttatcagtgagtcaaagcaaagtgaaagtttcaggagatgggaccaatggtgcaatgctcgccataacaaaattccttaaaaataaaaaagctaatgttatagcaacaaaaaaagactgaagcaaaaccacactgaaatgcatcccactccaggagaggaattcttagcgtaacactctaaataaatggaaggaatcatcaccttccttattttacctctgccttgttcaccaggctgcccagtgcttaccatgcagaaagcagtcagctgtactctggaagtttctgttcttctttcctggggcttaggatattctgggagctgtctgagccttgtgcctaaggcttatcaggtgatataatcttcctgttctgggctgcttgctggaggaataggaagtgacatttataagacacaggcggtgtgagcatccatgtgtggtcttggtctaaaccagctcttgaacaggttaaagcaaacagcaataacaaaacaaaaactactgatgctgagcgttttgatcctagtaatatttcaaatattgtccttctgcatatgttctatccatatttgattccaatatacattattaagctttcttgggtactattttgctggggctcttgcgtgaaggtggtacctgtctcatgatccttaaaagagagaggcttttttcatccaaagctgtagtgttgggaactggggtgggagaggcactttttggaattctgaaagaatcatatctgtgtatatacatactgagtggggaaggatgggggttggcaggggttgagggaggtgggaacaaacagtgagtatgggaacaggcagtcacctcgagtgtgggaggtcacctgggtccgtcgtcttccttctgtatggtgttgggtttatgtacacactataacacttcctgtgtgagttcatgtacctgtctgtgagtgctttggtgtattgagcctcagtacactccaagggcattaaagtcaagaactagaacctgggtgctgtgcctttcttttttagagatgtgctctcatctcttctctgacccccactttgccagcaaatattttttatttctgcttaaaatgtggtgtgtttggggatgccccacacaacaagacaggcttttccctgagaccagcagctgaatttctgccctgaaagggaggtgggcctcttgaggacccttctagagttactctagacttgtccctgtttcatgtaggcatgtgcccaccccagcctaggcaaaatctctgtcctcttcttttgggagttctccaaggaaagaagagactgcaggtgcagtcacgtgtgtggctcacaaccatgtcaggtagttctaaaataaattcctcctgtcatattaccacttccttttcaatgggggaaataagtagctctaaatttatgtaagcctcagtggttaagacccttccttaagaaaaatggacgtaagttgcccttcctttgaaagcagagcttgacaccttcctggctaatgagtgtcctcatcaagatgccccctggagtcacatcatggattaacgcagaaaggtgagttctgaggctctgagtagcttcataccctccaactgcttcccttaaacctctgattattctggcttttaaacaaaagcactgtatcatctgtgccaaatgtattccctgactaattactgagtacagtcacatagttatagtacactaataatacaggctggaaactgaagctcatagaagtatgtagtttccccaagagtgcagagctagtaagtggaagagtcaggattcaaacccagagcccctttctgaaatcctcagaggtgttcaacagcatgatcctcccttcctcttgacagctcgtatcctcctcctgaggtttagggcttcactctacctgacctgtgaagatttgaaagcacatatctaggacaagtattagaaagtcttcatacttcaggaaaggattttaggaaaaaaggaaaaaaaaaatctcccatagatgttgtattagtccattttcacactgctgtaaagaactacctgagaccggttaatttataaagaaaagaggtttaattgacccacagttcacatccctgggaggcctcaggaaacttataatcatggcagaaggcgaagttcagaagcaaggcacatcttatatggaggcaggagagagagagaatggggaggccaggcatggtggctcatgcctgtataatcccagcactttgggaggccgaggcaggcagatcacgaggtcaagagattgagaccatcctggccaacatggtgaaaccccatctctattaaaaaacaaaatacaaaaaaattagctgggcatggtggcgtgcacctgtagtcccagctactcgggaggctgaggcaggagaatcacttgaactcaggaggcagaggttgcaataagccgagatcatgccactgcactccagcctggaaacagagtgagactccatcccacaaaaataaaaaaagagtggggaaatgctacacttttaaaccatcagagctcgtgaaaactcactatcacaagaacagcataggggaaatctacctccatgatccaatcacctccctccaggtccctcccctgacaagtggggattacagttcaacatgagatttgggtggggacacagagccaaaccatatcaaatgtgtagtccttatgtagcccctgtgttaagggggtagatggggctcccgatttactgaccttcttagtgagggacacatatccgctaggtgaaggaggccctgttcacaggatgatgtatggagtatgacagagtaggtgagtcatggctccttggctagaccccaagggtgggatgatctggaaccacctgagttaatgacactcctgaagccttgcaggtatccctgcatagacaagctggatagcctacttccaacatcaaaagcataacagaatgggagactccttagtgtagttcaggggatgccatgtgcctggcttgggactcatggcccttggacttagatctctatactgccaagtgtcccgtcttcattcttgtgtagatgacctcttcactacttaattttggtttgttgaacttatagcctgttcccttagcttttatttacttacctttagctttcttttaattccttaccacattgtttttcctatcatgtactttagcttaatttctctgttttttaaacataattttaaactttctttctttctttcttttttttttttttgagacagtcttgctctgttgcccaggctgcagtgtagtggtgcaatctcagctcactacatcctccaccagctgggttcaagcaatcctccttcgtcagcctcccaagtagctgggattacagacgcgccaccaagcctggctaatttttgtatttttagtagagatggggtttcaccatattggccagactggtctcaaactcctgacctcaggtgatgtacccgccttggcctcccaaagtgctgggagtacaggcatgagccaccaccacaccgagcctagtagtttttgttttgagaaagaatagttaggtgcttttcttttcccttccccagtcatgtctacagtgatcttattagctgtgaacttaggtacctcattttttctcagatgaatacctgcttctaaaatctaaatgcaaagtaagagtgacagtattactataaaattcatagatgttcattatctaggtatattcaaaggacagaattttatgtcttcttccaaagtgtacccctgaccctccaccacaccacacacacacacacacatgaaataataaacagagcagccttaggaagagggcagttcaattcctggactgcaaaggacttcttctctcacacacttgtttttcctgaggaatgacatgatctggaaatcctaggtatcccccttctccaaccacttgacaccaggtggacacagagctgttgtacaccaggagaagatccagtcaactgtgggaaagactgaaccatgaaccatccagaaatactccgtaacaggggcctgtcatcagattatgatgtaccttttctagccacctctggcctctatgtcaaccttattcacacctcaacaaaccatgacttctgaggattctctttttttttttttttttttttttttgagacggagtctcattctgctgcccaggctagaatgcagtggtgcagtctcagctgactgcaacccccgcatcccgggttcaagcaattccctgcctcagcctcccaagtagctgggattacaggtgctcgctaccacacccggataatttttgtatttttagtagagatggagtttcaccatcttggccaggctagtcttgaactcctgaccttgtgatccacccacctcagcctcccaaagtgctgggattacaggcgtgacccatcgcacttggccaggattctcttaatgtaatacagaccctcatttcttccccgtatcatatgatcctggcagatggcccagccccagtagatttttggaatggaggtatccatacttttctcagtcattattaaaatcaagaaatagaatcacatagcaacacaaaacttggagcttgaccctcattaaaagaaacttacaggttcagagtccagttgaagaaatctttgtatctccagtatttttgtaaagaggtcagggtggtatcatgagtaggcttaagtccctacagtctttgtgaacttttataaatgccttgggtatccagtttctcaacatagcatcttcatcaccaactgtacctcagctgactgccccaagggcccacccgtgtgtgcacacgttgcaggtgtttactgtccctctcaccatgtcctcctccacctctcccctctgtttgtaactgtcctgtctttgatatttaaaagctagttggccacttctggccatgccttatctggtacctgttagccaaccatgacagtgatgccatacccaggactgtctgcttcttgttctcaggcaggtaggtgctctcagcactgatgtctcttgctttccaagtcagcttttacatctggcctgctaggaactggagagcattttcagtcttcatagcagcagcataggatcctgcaggctctgtatccacctaagttaaggtaaggtggatacacatcctggaaactctgtatctacctccacaacagctgcagaggatgcctgcaggatcacactgagcagacacactagtttcatcacactagtttcatcttctgcaccagaaaggaagaatctattttgcctggccaggcatggtggttcacacctgtaatcctatagcactttgagaggcagaggcaagaggattgcctgaggccaggagtccaggaccagcctgggtgacatagcaagatcctatgtccaaaaaaacaaaattcaaaaacataagccaggcagggtggtgtgcacctgcagtcccagatacttgggagcctgaggtgggaggttcacttgagcccatgaggttgaggttgcaatgagccgtgattgcactactgcagtccagcctcagtgacagaacaagaccctgtctctaaaataaaaagtaaaataaataaatattttgcttggaaaccgagttcaccatgagtttcttaacaaaaatatgaacttaactaatgagctgaccacatcgctattagatgaaatgagggtggcattatttactcagcactcccaggagtcaaggcagaatgtaattgcttccagacatattcaggggatattccacccaattatctaattttattcttcaaaggcggctgtatttggaaactcccattggtccagagagacagaacaatgagaagaaatcccctgtccagttgcctgcaggagtattccaacacttcatgggctagaggattccattgagatggggtttacgtcttgattttgaacacctgtcagcactgttctctgtttgcatggcaattctgacccttttatggcaacaacacccctgggacaacccagatttgtagattgagatccaaaggtagaatttccagacagtccaaccaaggtatcaagtgatgtttccagagtggaaggctctcaccgtgtcccaggatttctggggtttgtaagcagtactggccatttgtgaccctgttttttacctaatcattctgtctttttaggacatggttttacccgatccctggcaaaggatccagaattccaatagctgaaaaccctgttatagcttttctcctattctgccttacccaagacacacttgaacccctcagtaaggctatagagagggccatgagcaggggcagcctctcccttgtttctacagctccatgatgaggggttgactgaggccagcaatccttgtaggtgtgacagttgcaatataattaacagtttcaagatctagaggtaccttttgaaagaaccccttcagggatatctatccacagtagcctggagcagccaaggtgaacctgagattttgacccacacaataagggggggccattctttttcaaatattttggcttcagaatacacttcattacacatgcaaatattgagagattaacagaaattccagctcttatgcctaactgagaagagccactgcaagttgcagttaggtacccatgtgcagcagaggccagctgaatcccagagcttcccaaagtggacaccagcggggactattcctgatgtcccacccaagagaggaagatgagctgaggcgctgttgctctgcccaaatgcatcccatgtgcattcacgtgtcacccattcaaaataacatggcattcttggaaccttgtatctgacatgtaagaccagcctacacattggggtgggtgcaggggctcacacttgtaatcctagcactttggaaggctgaggtgggcagattgcttgagcacaggagttccagaccagcctgagcaacatggcgaaatcctgtctcttcaagaaataataataataataataattggctgggtgtggtggtacatgcctgtagtcccagctactcaggaggctgaggtgggaggattgcctgtgcccaggaggtcgaggctgcagtgagttgtaataaggccactgcactccagcctgggcaacagagtgagacccagtctcaaaaaaaaaaaagtctacaccgtcattggtcattgtctccttgggtcatctggcctgtattgtatttaggatcatttgtattaggagatagaaatcacagagtaatttgaataacttatacctttaattagagaagtgagggatcagcaaataaagataactataaagaaataggcaggtcaagaaaggggctggagtaaactggtgacattttgggctagccattgtgggagtgagagagaggaaactgcatgaggacaaacagagtaactgccaagcagcactgaggacctggatgaagtgagaaaaccagctctgatgagttgtagtaactcagatcagatcagcttttcatttgtctcacaaggctcagcgatcagcatgagagagcgagaaagccagatagctggggggtcctggcaagatgacgagtagaggcagtgctcaagcagtgagcatcaaaggatggggctaacctgcaggagtgtggttggaatgatgggacctggatgaagtaaagaagaaataagacgggccagtttctggactcagcaactgggaaaggtgtacaggtccaaagcctgatagggtctgaaagcaagcttatgacacaagggtgttgagggagtgagatgatggtcatcagatgcggattctacaagactggattttggatgggatcaactctatctaactctatgaggggaggtggcagttagaacccagaaggtgagaatatcaaatgggccattgttagctgggcgtgatggtgtgtacctgtaatcccagctacttaggagactgaggcaggagaattgcttgaacccagggggtggaggttgcagtgagccgagatcacgccactgcactctaacctgggcaacagagctagactttgtctcaaaaaacaaacaaaacaaaacaaaacaaaatcaaatgggccattgtcatggatgtccagcatggagacccactatgtgccaagtgcccacaaactattggatttgaggagcaacctggaggtcagtgggtgaccaaaatgaggaagggaatggctggaccacaccactgttggctagaaatggccgaggagtaattgtgaactttatagtgaacttgagtccaagctgctatttaactgtccaaaaaatgaacaagcatcatgagctgaaatagaatgtaaagaaaaataagaggcagaaatcagacttttatttcttctagtttaggctccaaagcttgagagaagtaatacagagggcttgatttttagaaaaccttagaaatgattaaataggtcaggcgcggtggctccggcctgtaatcccagcactttgggaggctgaggtgggcggatcaagaggtcaggagttcaagagcagcctggccaacatggtgaaactccatctttactaaaaatacaaaaattagccgggcatggtggcacatgcctgtaatcccagctactcgggaggctgacgcaggagaatcgcttgaacccaggaggcagagcctgcacaactgcattccagcctggtgatacagcaagactccatctccaaaaaaaaaaaataataataataataataatgcttaaatagatatgatcatattcagagctaaatttaaccagaatctaacattgttttccagatgaagagtttgagaaagccgactaactagcccagttgagtccctaggctagtgggtagcagagtggggacgtgtctgtgtcccgagcctcggcatgtccctgtgctgaagcccagggcctggttctgcactgtcaggttacccagatccagttacagaaaagaagccaaaacaacttgcggaaaataagtctacagaaaagataaataatagtactctaatgaatgaacagacttgtgacatctcttccctggggacagaacaggaggatacaggtttatatcccagcaatagggattctacattacaaggaaagtttctaactgggagatatgagatgagctacacaagaagaagccaaaacatttgcactcgtgctgcctttttatttttttgagatgggagtttcactcttgtcacccaggctggagtgcaatggcgcaatctcagctcaccgcaacctctgcctcccgtgttcaagcgattctcctctctcagcctcctgaatagctgggattacaggtgtgcactaccatgcccagctaatttttgtatttttagtagagatggggtttcaccatttggccagagctggtctcgaactcctgacctcaggtgatccatccacctcggcctcccaaagtgctgggattacaggcatgagccacccgccctggtgctggatttttgcttagtcctatcattttctgagtcccgagagttttcatatttggatgagtgaccagtctcaaagtcatttaagtcctgcctaacctccaggactgtctggcatcttccttctcttcttccttcccaggtggcttcaccctcacagtcccttatggtgtcaacttggtgccatcttaccaggttctccctaggctcccaaaccctcgctcctgcctgcttattctatatcaccatgttatttattttttaagtaactatgattatgttataggcttaattgtgatccccaccaaatttatatgttgaagtcctaactccaatacctcagaatgtgactgtatttaggaatagggtctctaaagaggtgagttaagatgatgccattagggtgggccctagtccaattcgactggtgactttataaaaagaggaaatttggacacacacacagacaccaagaatgcatgttcacagagaaaaggccatgtgaggacacagtgaaaaggtgaccatttataagccaaggagagaggcctcaggagaaaccaaacctgccaattctgtgatctgattttggatttcttttggtttttcatgcctgagttttgtattttttgtagagacggggttttgccatgttggccaggccagtctggaactcctgacctcaggtgatccatctgccttggccttccaaggtgctgagattacgggtgtgagccactgcgcccagcccttaacttggatttctagactccataaccaagagaaataaatttctgttgtttaagcaccacccccccacccaaaaaaaaagagaagaagaatataggccatgagcggtggcatgtgcctgcagtccaagctactcaggcagttgaggtggtaggatcacctgagcccaggagagattggtagaatgatttaatgaaaaggtggatgacagagccttgggaaatgtaaaaaaaataagtaaaataaaatacaacatgatccatccatatactgtctataagagactcactttagatacaaagaaacaaagagattgaaaacaaaagaatgaaaaaataaattccatgcaaaaagtaaccaaatgaggctgggcttggtggctcatgcctgggatgctgagacaggtggatcacctgaggtcaggagtttgagaccagcctgacaacatggaggaaccccgtctgtactaaaaatacaaaattggcggggcgcagtggctcacgcctgtaatcccaccactttgggaggccgaggcgggcggatcacaaggtcaggagatcgagaccatcctggctaacacggtgaaaccccgtctctactaaaaatacaaaaattagccaggcgtggtggcgggcacctgtaatcctaacactttgggacgccaaggggggcggatcagttgaggtcagaattcgaaaccagcctggccatcacggtgaaaccctgtctcgattaaaaatacaagaaaattagctgggcgtggtggtgggcgcctgcaattccagctacttgggaggctgaggtgggagaatcccttcaacctaggaggcaatgatccgagatcgcaccactgcactctagtatgggccacaaagcgagactcccccaccaaaaaaagacaaaaattaggcaacctgtccaaaaacacagcagcgataattagcaaagctgggattccaacccaggcctatctcacagccacagcatagtattttcttttttttcttgctgtgactgcaccttacgccatagatggcatccaggacgcagagcagtcagtatttaggtactgtttttcacattccttacatgggaatcacgtcaacaggattcaatttgtgactcaaccattaatactttgtgacactggctaatttattgcacttctgggtctcggttatgctttttgtggggggaggggagggcagggtctcgctctgctctgtcaccggagctggagtttagtggagggatctctgcagcctcaacttcctgggctatcaagcgatccttccaccgcagcctccccagtagctgggaccacaggtgcgcgccatcatgcctgggtgatttgtaaaatttgtttgtttattttaaacagagtctcgctctgtcgcccaggctggagtgcagtggtgcgatctgggctcactgcaagctccgcgtcccaggttcacgccattctcctgcttcagcctcccgagtagctgggactaccggcgcccgccaccacgcccagctaattttttgtattttttagaaaagacggggtccctgtgttagccaggatggtctcgatttcctgacctcgtgatccgcccgcctcggccttccagagtgctgagattacaggcgtgagccaccgcgcccagcaagtaaaatttcttttgtagagacagtgatcttgctttgtggcccaggctggtctcgaactcctggcctcaaggaatcctcctgcgtgggtcttctaaagattcagctgcttttggatcaaccgatcgccttaagaccctttaactcgaacaactgtcacatcctcggatccgcgaagggctgaaactcaaagagtttttgaagcgtccctcggcgcagtggctccgctccacctcccattcgcgctaccaccgcggtcgcagcgccaggatcgccagggggccagcgtcgctctcccgctgctgcgcgccggaagccggaagcagggactgagccacagactaggaaaggcaggcttctccggggctccccagtgccctagctttagcctggaggccgccctcttctatttgctcttagacgtcacgggggcaccccagtcccctcgaccctttggatccggctcacatttcctccggtgaagagccaaaggccccggaagtgacgtttgcacggcttgcgtatcgtgcgtgcgcaggccgcgccgggggcggggctagcaggagggtgtgtgtggggcgggagcggacaacggagaccagacctactgcagccacgcgggcgagcggctgtgtggatgtcggcgaagccgcgggcgaggtacggaacggacggactggtgtaagagcgtcgcggctctcagctacgggagcggggcggccgggcgtctcgggccgtgggcggcggggcggtcggtccgtgccctccgcgcggctggggcagttgcgcgtcggtgcctcccgctgtccttcgtcccacattccagccccgtcagctccgccttcccagttccaggccgccctcggctcccttaatcctcacagtgcgcggcttctccgtctaacgtgctcgttgccggcatctccagcgcccggacaagcccttgaaggcctgacgcggagcatttcccggccgcctccctcttcggcggctcccctcgtcccggctctcacttccccgtccaggacgctggctccgaagcaacatttgtggtcgcgcggggcccctcccatgacctctctggaacgcgcctagctgggacgctcggacccagaccacagctcttggccgcgacaggggcgccgggacttgatcccccgtcgccctggggggacagaagcgtcccggagttgggaggggatttgaagcctgtggtcctgacttccaccccgtggctgagggcgaggctgcagggctggggttaggagcagaagtccctacttccgaaccgtctgggaggagagccgagagatgtccatcacggcagtttagggagagagagggagggactctgccgctttggaggctaggtcataggcagctggcggtgtctcagcgcgggtgaccagtccttgcggttgggaaatgtgtcgtgggcgcccgtggactcgttttgcctttgagattaaataggaaattttcccaggacgagtttaccggagcaccttgggagttggtttttggcttggagagctactttccccccctaaacctagaactgctttgtttttctttattatattttttgagatgggatctcacaatgttacccatgcaggtgtcaaactcctggccttaagcgatcctcccgcctcggcctcccagagtgctgggattataggcgtcagctatcgcgcagctttaactgctgttaaagagtccgttccttaaaattgttgtaccaagaaacttgccagagatgcaagaaaatgtgattatattgttaatatttaatgataaataacattttgcttttaagagttactgattcatatctgcaggattaagaaatgttcaggatttgaatttttaatgaccttccaagcagtcatgtttctactctctagaagttagccagttgaggagaagggacagtcaagatactttcaaaacagtgtggtaaggagtgtgagctaagatggagcaccgaggagggagtcgggcatttaggccgtgctgtcgggcgtggagcctggaagggatcggggaatactttctgcatgtgtcttgaagaatgagtaacattcagactaacagggtggaatgaggggaatcaaaggagaggaggccagtaactacaaggaggtgcttatttatttatttattgagagagagggtctcactttgtcacccaggctggagtacagtgacacgatcacgagtcactgaagtctcaactgcctgtgctcaagggatcctcccacctcagcctcccaagttgctgagactgcagatgcgtgccaccacacccagctgatttttaaatattttgtaaagatggagtcttggtgtgttgcccaggctggtctcaaactcctggactcaagcaatcctcccgcctcaagtctcccaatgtgctgaaattacaggcatcagctactgagcctggagggtcgttattaaagtgaaaaagtgcaggacagagatctagaagcttaggctttaatctgatggtgacagaaccagggaagggtttttagctgggtccctgtgtggttaaaatgggtctctctggctgggcgtggtggctcatgcctgtaatcccagcactttgggaggccgaggcggtcggatcatgtggtcaggagtttgagaccagcctgagcaacatggtgaaaccgtgtctctactaaaaacagaaaaattagccggctgtgatggcacctgcttgtaatcccagttactcaggaggctgaggcaggagaattgcttgaacccgagagacagaggttgtggggagtcaagatcacgccattgcactccagcctgggcaacaagagtgaaactgcatctcaaaaaaaaaaaaaaaaaaaaagtaaccaaatgagaccaggagtggccacatgttaggcacaataggttttaagccaagaatggttatgagagacaagggaattctatactgataaaaagtttaatccaacaagaaaatataataatttaaaacatatgtgcctaacaacagagcatcaaaacatatgaagtaaaaaaggatagaattaaagggagaaatagagtttcaggatgatcattggagacctcactacctcaatgttaataatacagagaccagatcaataggaaagagagcacttgaacaacatgataatccaattagatctaatggtcatatgcagacaccaacccaacaacagcaaaatacacattcttttcaagagcgtgtgggatattgtccagagtatacagtgtattaggctgcaaaacaaatattaatgttttaaaagtttgaaagtatgcaaaatactaagtattttctaatcacgatggaatgaaactagaaatcagtaacaaggaaaacttgaaaactcacaaatatatggaaaataaacacactcttgatcactggttggagatgaaatcatacaggaaattagaaaacactttgagatgaatgaaaatgaaaacacaacataccagaacttatgggatgaagttaaagcagcgttcagagggaaatgtttagctgtaagcatctacctttaaaaataagaaagccagcagtggtggctcatgccaacatcccagtattttgggaggctgaagcgggaggatcccctgaggtcaggagttcaagaccagtctaaccaacatggcaaaagcccatcgctactaaaaatacaaaaattagccaggcatggtgatgcaggcctgtaatcccagctacttgggaggctggggcaggagaatcgcttgaacctgggagagggaggttgcagtgagccgagatagcaccactgcattccagcctgggtgacagagtgagactctatctcaaaaaaaatcaataaaaataaaaaataaaagtaagaaagatctcaaattagtcacctcactataccctctaaaggatctagaaaaagaagagctaaccccaacctagcagaataccagaaacaaagattagagtggaaataaataaaggaaattaagagaatagataaaattaaaagttttttttacagttcagcaaaattgacaaatttttagctagattgactaagaaacacaagaagactcaaatatccaaaatcagaaatgaaaatgaggccgttactgtgactttacaacaattaaggttatcgtaagagaatactataaacatatgtacaccagcaaattgaataaccaaatgaaatggcaaatctctagaaacacaaacctaccaagactgaatcacaaagaaataaaaaatatgggtaaaccaaccaggtgcagtggctcgtgcctgtaatcccagcactttgggaggccaaggtaggcggatcacctgagatcaggagttcaagaccagcctggccaacatggtgaaaccccttctctactaaaaatacaaaaatgagctgggtgtggtggcaggcgcctgtaatcacagcaactcaggaggctgaggcaggagaatcacttgaactgggaggcggaagttgcagtgagctgagatcgcaccattgtgctccagcctgggggacaagagtgagacttcgtctccaaaaaaaaaaaaaaaaaagaaaaagaaaatatgggtaaacgtataactagtaagaagattaaattaccaataaaatcttcccaacacagaaatacccttgactggatggctccaccagtgaattctaccagacatttaaaggaaaaattagtgccaatcctttgcaaactctttcaaaaacttgaagaggaggaaatactttcttttttttgtttgttttgagacagagtctcgctctgtcgcccacgctagagtgcagtggcgcgatcttggctcactgcaagctctggctcccgggttcacgccattctcctgcctcagcctcccgagtagctgggactacaggcgcccaccacaacgcccggctaattttttgtatttttagcggagacggggtttcactgtgttagccaggatgatctctatctcctgacctcatgatccgcctgccttggccttccaaaatgctgggattacaggcatgagccacccggtgcccggccgagaaggaaacactaactcattctatgaggacagcattgccttgttactagggccagacaaagacagtacaagaaaacaactgaccaatattgcttatgaacattgattaaaaaattctcaagaagacactgcctgctgggtgtggtggctcacgcctgtaatcccagcactttgggaggccaaggtgggtggatcacaaggtcaggagtttgagaccagcctggtcaagatggtgaaactctgtctctactaaaaataaagaaaattagctaggcatggtggtgggtgcctgtaaccccagctgcttgggaggctgtggcaggggaatcgcttgaacacgggaggcggaggtggctgtgagccgacattgcgccactgcgctccagcctgggcaacagagtgagactccatctcaaaaaaaaaaaaagaaaaaagaaaaaaaagaaaacactgcccaactggctggccgcagtggctcaggcgggtaatcccagcactttgggaggccaaggcaggtggatcacttgagttcaagagttcaagaccagcctggggaacgtagtgaaaccccacctctacctaaaatacaaaaatcagctggttgtggtgttaccctcctgtggttccagctacttgggaggctgaggtgggaggatcactggaaccaggaagttgaggctgcagtgagccgagattgcaccactgcataccagcctgcacgacagagtgagactccatctcaaaaaaaataaataaataaaaataaaaaataaaagaaagatctcaaatcagtcacctaactatacactttaaaggacctacaaaaagaagaactaaacccaagctagcagaataggggaaacaaagattagagtggaaataaataaagaaaaggaaaagaagagaatagataaaattaaaagtttttttacaggtcagcaaaattgacaaatttttagctagattgactaagaaaaaaaaaaagaagactcaaatatccaaaatcagaaatgaaaatgagggcattaagctgggcacagtggctcacgcctgtaatcccagcactttgggaggccaaggccggcggatcacgaggtcaggagatcgagaccatcctggctaacacggtgaaaccccatctctactaaaaatagaaaaaaatcagccgggtgtggtggcgggcgcctgtagtcctagctactcaggaggctgaggcaggagaatggtgtaaacccgtgaggctgagcttgcagtcagccaagattgtgccactacactccagcctgggtgacaaagcgagactccatctcaaaaaaaaaaaaaagaaagaaaaaagaaaatgagcacattactgtgattttacagcaattaaagtgattataagataataccacaaacataggtacaccagcaaattgaataaccaaatgaaatggcaaatctctagaaacacaaagcctaccaagactgaatcacaaacaaagaaaaaatatgggtaaaccagctgggcatggtggctcccgcctgtaatcccagcactttcggagtgcactccattgcactccagcctgggggacaagagcgagacttctcaaaaaaatagaaagtaggggtaaacctataactagtaagaacattaaattactaattaaaatcctttcaacaaagaaatacccctgactggatggttttaccagtcagttctaccagacatttaacgaaaattaatgccaatcctttgcaaactctttcaaaaacttgaagaggaggaaatactttctaactcattctatgaggccagcattgccttgatgctagggtcagacaaagacactacaagaaaacaactgaccaatattgcttatgaacattggttaaaaaattcttaggaaaacagtgccaaactggttgggcacagtggctcatgctggtaatcccagcactttgggagattaaggcaggtggatcacttgagctcaagttcaagaccagctgggcgtggtggcccatgcctgtaaccccagcactttgggaggccaaggcgggtggatcatgaggtcaggagatcgagaccacagtgaaaccccgtctctactaaaaaatacaaaaaaattagccaggcgcagtggcgggcacctgtagtcccagctactcaggaggctgaggcaggagaatggcgtaaacccaggaggctgagcttgcagtcagccgagatcgtgccactgcactccagcctgggtgacaaagtgagactccatctcaaaaaaaaaaaaaaaaaaatgagggcgttactgtgactttacagcaattaaagtgattataagataatactataaacataggtacactagcaaattgaataaccaaatgaaatggcaaatctctagaaacacaaagcctaccaagactgaatcacaaataaagaaaaaatatcggcaaaccagctgggcatggtggctcccagctgtaatcccagcacttttggagtgcactgcattgcactccagcctgggggccaagagcgagtcttctcaaaaaaaaagaaagtaggggtaaacctataactagtaagaacattaaattactaattaaaatcctttcaacaaagaaatacccctgactggatggttttaccagtcaattctaccagacatttaacgaaaattaatgccagtcctttgcaaactctttcaaaaacttgaagaggaggaaatactttctaactcattctatgaggccagcattgccttgatgctagggccagacaaaggcactacatgaaaacaactgaccaatattacttatgaacattggttaaaaaattcttaagaaaacactgccaaactgactgggcacagtggctcatgctggtaatcccagcactttgggaggttaaggcaggtggatcacttgagctcaagttcaagaccagctgggcgtggtggcccacgcctgtaatctcagcactttgggaggccgaggcgggtggatcacgaggtcaggagattgagaccacggtgaaaccccgtctctactaaaaagtataaaaaaattagccgggcacggtggcagacacctgtagtcccagctactcaggaggctgaggcaggagaatggcatgaacccgggaggggcagtttgcagtgagccaagatcgtaccactgcactcctgcctgggtgacagagcgagactccgtctcaaaaaaaaaaaaaaaaaattgagttcaagaccagcctgtgcaacatagcgaaaccccatctctacctaaaatacaaaaattagctgggtgtggtgttacacacctgtggttccagctacttgggaggctgaggtgaaaggatctgggaagttgaggctgcagtgagactggggtgatcaggctggataatcctctctccctgttcccctcatttggctgctccagaccctgagaaacttctacctgtcccatgccagctgagggtgtctgaggagctgacatcaaccccatggatctcctgaactgtgctggaaggtagagacaggcagggaggcttcccaatgggtcaggagaacctgaccccacaaatcaactgatcttcaagagacaggatggagggagggatcattctagagaaccctgctccttgttcctccctgtggcaaaatctggcgccaggaagagtttgagtgtgtaggcgtgtgtgtgcaggtgtaagtgtgcaggcacgtgtgtgcaggtgtgtatgtacagccgtgtgtgcacgcatgtgtgtgcaggtgtatgtgtgtaggtgtgcgtgtgcaggcatgtgtgtgtaggtgtgcatctgcaggtgtgtatgtacagacgtgtgtacaggcatgtgtgtgcaggtgtgcatgtgcaaggtgtgtgtttgcaggcatgcatgtgcaggtgtgcgtgtgcaggcatgtgtgtgcaggtgtgtatgttcataatggccctaacgcccaagctggaaagttgtggatttacgggaatgagggcaagaaacacctggcccgcccagggcggaaaaccgcttaaaggcattcttaagccacaaataataacatgagcgctctgtgtcttaagggcgtgttcctgctgcagttaactaacccaacctattcctttaattcagcccatcccttcgtttcccataagggatacttttagttagttgaatatctctagaaacaatgctaatgactggtttgctgttaataaatatgtgggtaaatctctgtttggggctctcagctctgaaggctgtgagatccctgatttcccacttcacgcctctatatttttgtgtgtgtgtctttaattcctatagtgccgctgggttagggtctccccaaccatgctggtctcagcactggtctctactgaaaataccataattggctgggcgtggtggtgggcgcctgtaatcccagccacttgggaggctgaggcaggagaatcacttgaacctgggaggtggaggttgaagtgagctgagatcacgccactgcactccagcctggcgacagagcaaaactccttctcacaaaaaaataaaactagtgtgggggaggggggagggatagcattgggagatatacctaatgctagatgacaagttagtgggtgcagcgcaccagcatggcacatgtatacatatgtaactaacctgcacattgtgcacatataccctaaaacttaaagtataataataaataaataaaaataaaaaaataaaaataaataaaactagtgtgaatcgctgggcatggtggctcacgcctgtaatcccagcactttgggaggccaaggtgagtggatcacctaagggcaggacttcaaaaccagcctgggcaacaatgtgaaacctcatctctactaaaactacaaaaattagccaggcatggtggtgtgcacctgtagtcccagctacttgggaagctgaggtgggagaattgcttgaacccgggaggtggaggttgcagtgagccaagattgtgctactgcactcgagcctgggtgacagtgagacttcgtctcaaaaagaaaaaaaaaaaaaaaaaagctaacatgaaatgctgcagcagttttgagtaaaataaggagtgaaaagagttcacaagattgatccacagaaaggtcatcggtgaacctgaagagttttggtggaatggggtgacagaaaccaggttggaggacatgaaggaggaaagtagtaagtgaaatgtgtaaacagtgaacacaggcaactcttaaaattactttgggccaggcgcagtgactgacacctgtaatcccagcactttgggaggccgaggcgggcagattacttgaggtcaggagttcaagaccagcctggacaatatagcaagacctcatctctacagaagttttttgtttttttttttttaattagtcaagggtagtggagtgcccctgtagtcccagctactcaggaggctgaggtgggaggattagcctcaaactccttgagcccaggaggttgaggctgcagtgagccatgattgtgccactacactgcagcccgggcaacagaacgagaccgtgtctcttaaatttaaattaaaatagagagtggctccctacagatggcaactgcagcccccgcctccccctgagccagggctttgggcccatctggctcccctctggaggccggcccatcacgcagccagtgctgacagattgggtgtctccggtgcgccggcggctgccgcttaagtagcttcctgtcagggagtcaggggtcacctcatccccgctctgttcaaaacagtactgacctcttcggggtgcctcccacgcctgtctactgcacgagcatgtgtttagtgtcaactctgcgatccagaccctgcctggtgactcttgggggagcagcttcaggagcccgtggcccccacggcaggtggcttctaggccagaggggcagggttcctgcgctcatgagctggcgagtctcgccatgtgcatccactgtatgccacacagacagggaccatgtatgtcccgagtgccggcttcttggttccactgtctagagtcaggcccctggctctgggcctcggctctgggcaagtccttgttctcagaattcttgtttttttttttaactagaatctcactgtgtcacccagactggagtgtagtggtgcaatctcggctaactgcaacctcaacctcccaggctcaagcaatcctctcacctcagcctccctagtagctgggactacaggtgcacaccactatgccgtgctaatttttttttttttgtagaggtggggtctccctatgttgcccaagctgatttcaaactcctgtactcaagcgatcttctcaccttggcttcccaaagtactgggatgacagacgtgagccactgcacctggcctagaatttttcttaacttcaagcagtgtgtcctgctgggggatgggatgagctagaaactgtggtcccatggggtcagcaaggtttggaaatgatcacaggggttcccaggccaacctcaccacctctgagctgagtgaccctgggcgagtcagttcccttccctgggactcagtcttctcctttgaagaaagggtacaagagaatctagaacatcgtaggacttcggcaaatgtcggtccctttcccccacactccaaaggtgacgttccctgagacatcttagtctgggcaagtgtgttgttgtagcttggggggtggcctggtcccttggcctgtcctgctcagccagcagcccttggctggctcagtatgggaggttcagacacggtctcagttcttgacaagctcctagccagaggaaaggcgatttcattccggtgtgatgagcactagtagaagagatgttagaacggagggactgcacggaccaggtggaggtcaaggaaggcttcttggaggtgacataggagctggcctgcgaggctgagtgggaatattttgggtggaaagaccacggaacaagcatttccgacagaggaagcagctattgaagagggaaggtggttgtgtgctggggaaacctatgtggttctccatggtcataacaggatgcctggggcgtggggggcagaatgtcagccggcaaagtggggaccggagtacccgggaagctgggatgaaggagcctcctctgcaggtagggacagggccctctgaagccggggaggggacggggaaatggggaagggaccaca

SEQ ID NO: 67 - DNA, 2878 bp, Homo sapiens
  source 1..2878: mol_type = genomic DNA
agactctctccggccctaaaaggcaattgtgctgagattttaactctaacttgggggttcgcccgattccctggagcaacgcttctctaaaaccacggagcaggccagtgttcggaactgcacaggtagttacgaaggaaggaaatgaagtccctcgttccaacagcttcgggtccagtcacaagtttctctctggcgagcacgcggccgcctcacctggggtgggggaggcgctgagaaagcgcagttctctttgggggaggagagatggcctctcagaggcgtccccacctgcctctggaacgcctctccctgcaggccccctcggttccctgcaattcgccgcccgctgggatactcccatggctcggaggcgcgctcccggaccctggtgaggagggtgaagagcgccccaaaatgggctgagaggaaaatgcgcccacactggcgcctctccatcctggctgctcgccccttccctcctcctttcccacacgcctcccatctccgtgcctgcacccccccacccccagcaccctgcaatggtcggaactgcagggagtggggagcaacgcgaaaggccgagagaagagcgctggggagaagtcccggaggtcctagactccttggggcggtctctgcggggcgctgggccaggacagctgccaaccctccaaatctgtgcgctcagaaggagctgccctttgcccgctcctcctcacaggcccaccctagacccacttggggatgatcccaggcgcagctctcccctgccggcccaagcctttgacaggagtcctgcggcgaggcagagaccccctgaactgagctctccgacgccctagttgcccgttagagcccccatgcgcgccctccagccttcgaaagctctcttcctcgccccaccacctacgcgcctggtgatgctctcgtgggcccttcctgctccctccgcccccatcccagcctctctcgcctcttccagggcccacccaaccgcactacgagcgcccgcgccccgcccggcacccctggttacctgcagctgggccggcgcccagcgcccgcgcgggaggaggtgggggcgtgcgccgggccgagcggcctcggggcgcagcagctgcgggtagcggcagcgccatcatcacagccagctgcttccctgcgctggagccacagactagcggggtcatccgcttctgaccacaaacttctagggcggccggaggagacaaaggtgccgcgcgtcgctgctccagcagcagcggctgcgcggcggcacgggctcggagcccgcaggcgccggagctctgcgcggccgctcggcccagctccgcgtgctccgccccggcccggcccccgggctaggcacgctgggccggggcgcggcgcgggcgggctcagggcgggctccggacggtcccggtagggccgccggccgcgcgcgtagcaccaaccagcgcggccgccgcgccccgccttatatccggcccggcgcgcacccggccggcggcggcgcggctcgcggcccagccaccggttgctatagcgatgtccccccccccccccacatgttgctgacagcaattggctaaggggccgcggctctccaaacaccctctcccgcccgagactatgaatggacatcagctttgtcagtcattggtacaacgccgaagccagggccttcgccttttctttcttttcagtgtttctccctttcatcgttcatactgggcaagttcagggtagcaccgaggggagagagacctcggccagaaaagtcaaggcgcgcggctctgctgtgacctttgtcctgggaggggtgggtggggtgcgtcgccactcttggcaagagaaaattgcacggcatatcgttcttcccagttaccttttccagtgttgccgttcgggcctttttgctccctttccaaatggaagcaggccaatgattcagggcgagtagacgagagcccctctgctcactttaccagggtcctcccgagtgtttaggtcccgatgcgcgtagaaagtgtcttgcgagacgcggaactggtgagactttgccaccatttggtccaggccaatgtcggccgccagcccaaaacgccgaagggagacggcggtgaaaacccaggcgtgcgagctgcgtccttgcccttccccctacccaggtcaatggtctggcctagaccaccgctctgcgggcgaaaggagtggagcagaatcacaggccacgctcccagtcgttcgagcctgcccacataacccccggcccctggcgcagtcaggcccgcagcgggcgagaagagctagggtctcggggcgactaggaccactgagcacctcccccccgcgcctcccgcccatgctctctctccccaggccctggaccccgggccacagccacaggttggggcaccccggtgcgcggcgcccccgcggagctggcgagagccggagagctgaaacccaacatctgtgtgtacaatgcgctctccgaggcccacagctgcaggaacaaggagaagaaaggaagaggggggcgcagatcttgtcacacgcagatgacagtctgcggagggctctttagtttctccttttctggaaaccccagcggccccctcctaggcccccctctcccaccgcctggccattgttccctgcgcccgggacagctggagacggcggcccgcgccactcgacgcccctcccgccgcacacccggctgcccgcggcgcccgctcccggcccctccggggccaactcctccacaccccccacctccccaggccaggcccaggcggcgcttccacagtctcccctcccctcccttgcactctggcgctgcccctagacctgctcggtgcagagggcc

SEQ ID NO: 68 - DNA, 70398 bp, Homo sapiens
  source 1..70398: mol_type = genomic DNA
aaattaagaaatgaagaagcctagaaattctcactgttacagaaatctaatgccctcccctgtgacactgcaaatctaatgccctctcctgtgacactgcaaatctaacaccctcccccttgacactgcaaatctcataccctcccctgtgacactgcaaatctaacgccctcccctgtgacactgcaaatctaacaccctccccagtgacactgcaaatctatcaccctcacctgtgacactgcaaatctaacaccctccccaccgtgacactgcaaatctaacactctccccgaagacactgcaaatctaacgcccccccgtgacactgcaaatctaacgccctgccccatgacactgcaaatctgacaccctccccaccatgacactgcaaatcaaacaccctcccccatgacactgcaaatctaatgccctccccacagtgacactgcaaatctaacactctcccccacaacactgcaaatctaacgcccccccatgacactgcaaatctaacacccccccgtgacactgcaaatctaacaccctccccaccacgacactgcaaatctaacactctcccccgtgacactgcaaatctaacactctcccccgtgacactgcaaatctaacaccctccccaccacgacactgcaaatctaacactctcccccgtgacactgcaaatctaacaccctcccccgtgacactgcaaatctaacaccctcccccgtgacactgcaaatctaacaccctccccaccacgacactgcaaatctaacaccctccccaccacgacactgcaaatctaacactctcccccatgacactgcaaatctaacaccctccccaccatgacactgcaaatctaacaccctccccaccacgacactgcaaatctaacactctcccctgtgacactgcaaatctaacaccctccccaccacgacactgcaaatctgacaccctcccctgtgacactgcaaatctaacaccctctcaatcatgacactgcaaatctaacaccctcccccatgacactgcaaatctaacatcctccccaccatgacactgcaaatataaccccctcccccctccgtgacactgcaaatctaactccctcccccatgacactgcaagcgattcttcagtagacccaggtctctgggtacttgaaaccagagcagccacagcaagccactgtgtaagagttagcagagaggggctcctggccatctgtgcagggacatacgtccatgcatgtgtataaaagatctctgtaatttttatcagggctaggaccatcctgaaagtgcaggtctcccagagccagccacactccctatgctgggctctgcatggagtggggtcagcatgtggccagctgctgccaaggtctccctcccaatagccctcccagaggcctctgcccaccttcaccacctaatctccatgctcaagcctcactgtgtggccaggctgagtgcccatctcctcacaggacacagcgctctctgcaggacttttgctaagtggttggtcccctgcagcaacacacaggggtccacggcacaccctccacacacgggggtccccagcacaccttcaaatatgggggtccttagcacaccttcgcacacgggggtcctcggcccaccctccacacatgggggtctgcagtgcaccttcactcatgggagtccttggcctaccctccacacacgagggtcctcagcatgccttccacacgcacaggggtcctcggcccaccctccacacacaggggtcctcggcccaccctccacacacaggggtcctcggcccaccctccacacacgggagtcctcggcacgcctttccagaggaggtgatcttgaggcaccacaaaagcagcacctggcccctggccgctcccagctcagagcccacggtggggtcctcagccttcaccctagttttgctcccgcatctgagggctgcgtgtcacctcactgtgacttctgactgcacagcaggtgttggtgtggggagtcaggcagcctcagcgaatgtcctgaaaatgctcccacagaatgtttatatctttacagacacaaaatgctgctggggtaatactcttgggaagtatgcaaatgagttctttttcagatgtcaagcaggagcgatgatcagagaatcctctcattgagactgggagctggtggaatatgactccaccagctccagaccccaacttctccgcgttcacctgtacatcgcaagtgtctaaaaatgatgtgtatcccctcccagtccctcactgtctttccccagatcacacccccacaaccctgtgctcacggagaactgcccccaccttttctaggaaggagggcttggttatcagtcatcctcctgccatctctgatgacaggcagtggcaggggctcaaccttgtccttccttttcattcccactggtgccaccccagccaccttcatctgcgtagcctgaatcactgtggcctaactgggccctgggtctccatgcttcactcccaaagtcaaacacaccgtctcccatccctggcatttccatgccctcacttgacgaggatctgcaagagccgagctctgtgatgggcagcaggtgtgcacagcaggagggccgggcctggtgctcccagcatcttcaggcttaaaaatttggccccaggaagcctttgcattcataactgtagctaccactattcactgctccaaaattcaaaggaggagttctcgagacccaagaacacacaacacacattccactagcctcgaagccgcatcctcgcacatctcacagcctggggaagcgatgcagaatctcaccagaggataaacaggcaaagaactttggggctttgctaggaaaatgtcttactctgcggacccccagagggtctcagggacttcccatgccccctcccatgccccagacggtcctttctgaatggccgacttagacaaaggctacaccctttaaattcagtgacagccaacagaatcacttcctgcccttgaaatccaacaatgtctccacaggaagcatctgctggctcagcacagcaccagcttcagcccccacctccgccccatccctgctcctggacctgttggttccgaggaggccctggacaccaagacacccaccccagatgcccagactccctcaacatggaggatccccagactgagtcctccacaaatgctgaaaccccctcccaagatgccaaggaagccccccacccccaggatactgaagtcctccccagatgccaaagctcccagaggccaagcgctccctaccctgacgccaaggcccctctaggacaccgaagcccccgcctcctctgctgaggaagtgccattccatggaaggcccggctcagcctccctgggtcaagctcctgtctcctttcaggaagatggaagttcacagaggccgcaggtgtctaagggtcaagttgatcactacaccatccccttttagtgtttttgtatctgttttgactccctattatttttctggtagttcatctttttatgtgtttttaactaaatccattcagacaatcttgttcttcctctgccacttttctccacgttgtaagggttttaaaccaatgtttctaagggagcactgggcttcatttgacatttccagtaagtatcaaaagctgctatcacttcaattacagacactccgagcccaggacaggctccagatgcccggccttcatgcagcaaacaccttcacagggaaggaaggcggaactctctttccttgccacagaaaaggattctaacggcatttgacaaagattgagcatggttcgtcgcgaacgccagcctgcccccacggtcatgtccagcttaaccaacacacggcccagcagtctcggtcagtggagcccaccacccaagcgggggcggtaccactcccaccactgactgaaccttggaatcaatacaatgcagggtagagcaattcatttgaattaatgtgttaagtggcacaaatatgtgtttatcgagagaaacctaagtttgtgagaaaaggatctattggaaaattcttctttttaaaaaagtttcatggaaaaagcttcctgcaagcatccgcactgctgcaaatataataattgtttgaaagcataacatttaaatcagaagcatccctagacatgttgattagaaatagtcttaagagggtcaaactatgtccacagaggctggaacaccaaaatagaggcaaaagtcctgagaagggagttgtttttagtcaccaggccagtgaccactgtccagcaggtccacgtgcatggatgagagctgtgcccctctcttctctaagccaaggggctgttgggacaggcagccgcacctggccagctctgcccttgctcatcagctgggaagcagcatgcttcttggggggcaggcattgtctacaacacagactacacagtccacagtccacaactcctgaatcctgcctagtatttatacagtaaacagagactctgaaataaacaccgtgccgaatggagcctgtgcagctcccagtgctgtgaccccaccatgatcgctcatctgctccagctggagcactctgcctctctacccattttcctgctctcaccgagtcaggcctcggaccagcccctgtgtgagatggagatgtgtttagtgtgggaggaacacggtgagaggtcagagacagagcagggatccgtgcagggatgcggaggccccagtgctgggtgttcagggctgactcctccctccccaggcacctcctgccagagtgacctcatgagccctcatggtttcaaccccacccattcgcagcagccacatccccacctgcactgggttctccttccagactcacagcctccgcctgctagctgctcccggccaacccccatgggcacactgaccccgtgtgtcccgaagaccccccgcctgcctctgaaggcccttccatcctactgctcctccatcctggcgtctgacaaatcaatgtatctttccccgtggatgtttctccaacccattcactcttctcccgctcagtgacctggcccctgaacctgccgttcccaactcagacaaagccgtctccaactcggacaatggcgcctccaactcgaacaatgccacctccaacttggacaatgtcgcctccacctcagacaatggcgcctccagcttggacgatgccgcctccaagtcagacgatgccgcctccagcttggacgatgccgcctccagcttggacgatgtcacctccaacttggatgatgccacctccagcttggacaatgccacctccagcttggacaatgccgcctccagcttggacaatgccgccttcccacctccacaaagtctgcttcctaaagagcaagtccagccacaccacttcctggcttcagttgtcccatcagacgacgggtcaccaacagctggggcattctcaggagccaagctgggtgccttcccccttcctggacatccctaccctgcttgctgggcccagtccaggttctggaagattctgcctttctgttcagctgtcccacctctcagttccgacagtgtgagcctggtggctaaagattcctaatctggcccttgaagactcaggcaaacttagaagctcctggtttcaaacttctctttcccactttgcctcttgtcttgaggtggcagaaacagctgatggtgaggcaggataatacggtctggaggcaagaagcaaccacacttttctagtcttgtgaaacaaccaaagcaactgtctgaagcctcttcagctggcccatgcctcatgggagttttgtagctctttctgcgtttgagaagacactaaaaaaaaaaaagtaaaatccagctggtcctgagagacaagagtttcctcaatcctggaaattcagcaggaaaaatactgtttatgcactgaatgaaatcactgaggccaagaatagttatttgttcacaccatttcatggatgcctatttttgtcccaaaataaagactctgcatgtcaccatgttgatgcatctggaaacaagtgagaggctttgttatcagcatgcagcccagatgtgaaggcccacagcagctcctgagggcacgtaagcttgcaggaacaggatgatcctccaccggctgcctgggccatctgtgtaagggccctgtggactgagccatttacatcagttaggccagcagccacagggatggtgtcaccactgtgggattcaacactttgaagaattaaggcagaggttacttttgtccacaaaatcacatcctgcagtaaggatgtgggtacaagtaatttatttggaggatgatcccagaagccaagtgagagaacgggacagtaagcctgagaagggcggaagccatgaagtacatgcacaaaccaccagtgtggacggccggggcccgacactgccggagaccctctgagaggcatgtgggatgtgccttgaatcgtctgagggtcaaagaatcaggggtctctatccattgactcccatcccttgctctctgaagaggtgaactcctgagcagccctggcctgccctgggtgtgggctagtgtgctgcttagctcagacagaccaaggcaggtgcttaaggctggagccatcagcatagatgggagctgccctgcagagctgaagggaggcacagggtgggcaactgggatgtgggcaggatgcgaaaaggtctgtcaaaggggtacttcttccaagtgggccaaagactccatcaggtcgagtagtgacatggaaatcacagagcaggtggctccaaggatctgtccctccactgaagtaacaagtaagctgacaaaaatggacagaagtgactgttctgggattctgtagtctaattttaaaaatcagcagtaaccagggggtgctaaattgagaaagagaatgctaaattttggttaaaagacattctgtggtttttgcttgcccacctattattccccattccccagttcaacagcagctacaggattggtggcctaagttcctggtgagatgtggtggtaccagggggcagtatggatcttgttttcaaaaaactgtggctgtgtgttttgagctgtctggtggttccttgagaaaccagtgcaaagaggaaccctgttttagcacctttgggcgagactggctttccaggaggaagctgacgaaatcatgtatagagttatactgaccaatactatcccaaatttgatgaaagacatgaatatacatatccaagaagctcaactaactccaagtagaattgattcaaagagatccatgctgacatattatcatcaaaccatcaaaagccaaagacagaaatttgaaagcagcaagagagaggcaattcatcttgtacttgagatcgtcaataagatcaacagcagtttttcaccagaaaccatggaggcctgaaggcagtgggatgatgtatttaatgtgctgaaagaaaaataactgtcaaccaataattctgtatcaggcaaaactatcctttgaaaatgaagccaaaattaagacatccccttagaagcaaaagctgagggagtttgtcactagtagacaagctctgtaagaaatgctaaaggtgacaggctgaaatgcaggtcattgaggctgaaattctaaacagtaaccagaagccatacaagaaaataaagaacttcagtaaaattaactacataggtaaatataaaacccagtattgtagctttggtttgtatctcctccttttgtcttctatatgatttaaaagacaaatgcataaaacaataattataaatctatgttaacagcatacaatgtaggaagagataatttgtgacaataacaacataaagctgggaaggaagctattcagaagcagtttttgtgtgcttttgaagctaagttggtataaattcaaactacattgtgataaatgtggggtgttaattgtaattcccatggtaaccactaagaaaataacaaaaagaaatgtgcaggaaaagaaaatgagaagggaatcaaaacagtacactaaaaattaaatcaaagaaacaaaaaaaggcaatatttgaggaactgaggaggaaaaaaggtgtaagacatacagaaaccagcagcaaagtggcagaagtaaatccttccttaacagaaattactgtaaatgaaaagggatcaaactcaccaattaaaagagagactgacagaatacatttttaaaagtatgaccaactacgggttgaatatccctaatccaaaagtccaaaatctaaaatgctccaaaatctgaaaatttttgagtgcctacatgatgttcaaaataaatgcccattgaagtattttggatttcatatttttggattatggaagctcaactggtgagtccggttggccttaaaacaagatgtgtttgaatcatgcaggtccacttatatgcagatttttttcaaccaaatgtgaattgaaaatatagtactcgtgggattcaaaacccatgtatacggagagctgacttttataaatgtgggttctgcagggccaactttgagacttgagtatgcgtgaattttggtacacattgcagggggcgggtgtcttagaaccaatcatctgcatatatgagatgaccacaaatgttccaaaatttgaaaagatccaaaatctgaaatacctctgtcccaagcatttaagataaggtatactttgtatgtaagataagggatatatgctgtcggttagggactcacgtaggatccaaagttgaaagtaaaatgatgcattttgggatggtgaaaatgttacatacaggtggcagttgcacaatgttgtgaatgtaccaagtgccactgaattgttcatttttaagtggttaattttatgctatgttaattttatctcaattttttaaaaagactccctcaatttagttttgtttcattcatctattccctatttatttgcctctctagattataaaattgttgagaacatggacaggagtttattcctctttgtgctacccagcacagtgcctggaataataaatatttactgaaggcatcactaagcatggagttgaacatcattgaggggctcagacactggcggctgagtcaatgccatgcttgctgcaggacagcctgcccaggccatctcagtctcaggtatttcttcatagcagtatacgaatggactaatacaggcccatattccaagacccttaggaacaagtggtaattgtttactatctagacgggactctcctacttgataaaagtctcctgctctatagctccacaaacagtaaatttatttgaaatcaataaatgaatgattaagcactgtgactggagagggccgaacagggttccatttccagatgtttcccaggcactgatgattcacttcctggggccgggcaagttccgaggctcctcagggtctcctcaaacaattcaggcttctttaagcctccagcttgcaactatctgactcattaagttgaagttggcaggaaagttataaaggttgtacttgaatcacagtcctgagatcttgggttgagatgctttttatttagcttgtgcatcaccaacttgtaaaaaatatcttggtaaaaaaatttaaaataaaactttaaagtttgtgttatgacagattaaacatttaatgccacatggtgtgtatatctcaatggaaacactgttcttgtgtgttcagtatctgtgtgcatgttaatcttcctgtgagatcataaagctctgtaagggaaagggtccaattgtctcaccttgaaaattccaaacctagcaaacgcctggtgggaaatacaaacccgcaggcgtttctgagtgaacggaggttgtgccaggtcaaatgctcactgctggtcccgtcctgctctaaaatgttcagatgcataatgggttatttttgttggtatttgggtgggtcgaatgctcactgctggtcctgtcctgctctaaaatgttcagatatgtaatgggttatttttgttggtatttgggtgggtcaaatgctcactgctggtcttgtcctgctctaaaatgttcagatatgtaatgggttatttttgtcggtatttgggtggtatttttgctctatgacctcccatttctctgacgtctctagattcctttgttatttgtgatttctgcttctggtggtgacaacaaaatctgccattgctgtgcagccgcctcacccatggagcaggcttatcctctacaactattctacagaaaagacaagcaaggtctgcgtggagtgaaagcgccttctttccatatcggatgctggaagctgtgatgttggcaaacggctctttgcatgaagtactgtgtactgaaccaggaaagtgaggtgcagacgcggaagtcaggtgcagatgtgttgggcagatgagctatggtgatggcgggtggccattccctataagagagtggctcctctattattaacaaaataaaaattaaagaaggtttccattgagtttgctagttcttcactagcaatattcccagctggttgaccttcatttgttttagtttgatttcatccaacacagctttatcttacctgctgcccacaccctactcttgagagcacgtactcctggcaggaccccaacccaggaaaccctcccatgccccaggtgccgtcccctgaccaaccagcctcactctcagagacaaggatgaaacgcatatgaatatccactctaatacggttcagagaaggatgatctgttatctgaaacttttactgcaaaagctcttttaatcaaaaccttcagaaaatttgaattttactccttgcaaagattatttggttaaaaaaaaaggacactcacaacaattaacatatgactggggatgtgtaagaacagcgaagagaactggacaggctgtgtcctgggaacagcgcccggtgcacacacccctttccatcttccctattggcaccttcagtccccggaggcgctgctgatgctcataggaagggactaaggccttcacagtctgtcaacaggagggtcccatggggctccatcacggtctctgggaccccccttccactgcagcaaagtggacaggtgcactgcatcaacatctcaacaccgggtgaaaagggaaacgccttactaaacgatgttcccgtgatcagaatcacgggctaacgtccctccgcttccgcagtcttcaggcctcaggcactgccagtgacattagctgctgtgcgtccctcctgccggactgcaacaccgtctcaggatccacctcccaccatcttccctgaccatggccctgctccatctgatttgtttgtcctctgatcaggtggggcctgagtccggcagtggatgccagtgagtcagccatggttggcagggactggctggctgcccccctctcttcattggccccgcctgtctggcctgggcgcccactcactcctgctgcacctgccacaactgccggctgatcctgctgctctgatgccccctcacgtctccagcctgcgccccgcactgcgttcgctgcccatcttcctcccaagctcacagtctagctccaggtgcctgctctccttgttctgtgtctgtttctgcacaccctgcggggaggccaggctcacccaagaaaagagtcaaggctgcaccatgaagcctctcgggctgggcagggagtccaggccctgggagccccccagagccccccacagaatgtgcagctagcctcgccagacgcgggcgatggggccgaaccccgcaggacaacttaggaggagtgaagagtggaagagtgcccggtgcagggatgggtgggaggaacctggggtagtgtgcacgcctgagacagggtgggggacacgaagggagacaggcgagggtgggacaggcaagggtgggtagtgtgcatccctgagacggggtgggggacacggggggagacaggcgagggtgggtagtgtgcatgcctgagacggggtgggggacacagggagacaggcgagggtggggagggagacgctgactccgtggtggaacgtgggtaggtgataggctggctccctgagcagcccctcccctgtggtgcagagctgtgggtctaggggtgagggagccatcatctcatctcacgccatggagacacaggtgtggcttctgttcctgtatctctagtaaatgtttccttctgagaaactgggtctgtcagcctctttctcaggcctcttggttccctcagacttgggggtaggtgtgcacaggcctgcctgccaggggacaggaaccccaggggaaataaaggtgatgctcaaacccagaccaccgaatgctctgaacacacttgcttgctttcaggtggaaacattcacagtgtccctgggtacagcagacttcatatcacagagacttccctctccaggacgtgaagatgtccatcaccgagacgtcagcacggcaggtgggagaaagccatgcacacagtgaaggggacggcctccattggcccacagggtgagctatccagttccaggagccacctgaccacagggtgagctgtccagtgccaggaaccacctgaccacagggtgagccgtccagtgccaggaaccaccggacccacggggtgagccctctggctcgagaagtcctcagcgacatctgggggtcctgtgcatgcaccatgttgactgtacccgtgtgcagcttgcacagagtccccagcagctctggggagggctccgtgttcaatatgtgatgagctttcgggaaggacaggagagccgggtgtgagaagcctccttcctagggcctgtgtctctggagtgcacgaggcagatggatggagacgtgggagcaggggctggcagcactccccgagcacagtgggaactcaggagcaggggctggcggcactccccgggcacagagggaacggcctgggtggcatggagagtgtcctcccaggatacagcggagtgcccgtcaccacctgcccaccttcttcacaccatgaggctgctggcacgggtgcctttgctgccggctgctgtctgtgctgccctgcaacctggatccacatggctggaggtccggtgtccctaaagacttctatgacatcctgacactgccctgcttggacactctctggacaggagacacctcacccctcacagacatctcattttttcagagctgcatcatcagagcagttgggggacaggagggccaagtctgaggactcagacccggggcagctggtggaagctggggttaagagtggaatacatggccaaaggatccctcctgagggtgagggcgaccgagaaaggaatgagggcataagagcggtgctggagaaatgtaagcaaatccgcatttcgaagcagaaatcgctggtttaaatattctctcctttccctcaccatggaatgcacaaacgcttgaagatgcatgtgtgttagagtctcttccacagaactctctggaaaggccgttccaagagcttcaggtgttcaggttcgtatctgaggctgcaacaggcagagccacttccagtttcctgactaaaaagtgaaagttccagaagcattcctagatctgtggtgtgtgtggtgcacgtgtgctgtgtggtgtgtgtagtctctgtatgtgtgtccatgtgggtggtgcctgtgtactgtgtgtgctgtgtggtgtgtgtggtacatgtgtgctgtgtggtgtgtgtagtctctgcatgtgtgtccatgtgggtggtgcctgtgtactgtgtgtgctgtgtggtgtgtgtaatctctgcatgtgtgtctatgtgggtggtacccgtgtactgtgtgtgtgctgtgtggtgtgtgtggtgcacgtgtgctgtgtggtgtgtgtagtctctgcatgtgtgtctatgtgggtggtgcctgtgtactgtgtgtgctgtgtggtgtgtgtgtggtgcacgtgtgctgtgtggtgtgtgtagtctctgcatgtgtgtctatgtgggtggtgcctgtgtactgtgtgtggtgtgtgtgtgtggtgcacgtgtgctgtgtggtgtgtgtagtctctgcatgtgtgtctatgtgggtggtgcctgtgtactgtgtgtggtgtgtgtgtgtggtgtgggttgtggtgcctgtgtgagaggagtggtctcagccggggtgatattaaggcctgcagtacagctccagaccccagagcgaggccccgcctccctgccgagccccagaaacccccttttcaggggtggaagtgggggtggcctctcccatgcagttgagtgtcctgggagggaaagcacagaagttctttctggtatctttagaaccaaatcaggtgaggtgtttaagtatctcatatgttttttggtcatcatttctatttactcctgcaaaattattttttaagataaattaaaagaataataaaccgaaatactagacttaaaatttaaaaatttagaaattgctggcaatctttttgtttttacaaaatgccacttcctagtttgtttctgggtagtgtgggagtgaagcgggtggggtggagggtgctgggccagtgtgcctctcaccgtccccaaggagccccctggagatgcagtccagaaagacggatccaccggccatcccaggtaccaggagcagcacacacgaatgctggatttgtgcctcacactaaaaagcagcttggtgtagctgcgaattttctatccaggcacatctcttcactgctgattaagctacctctttttgccaaacatactctatatttgtgctggatcacaggtaatttggtggagaaaagcaattccaaggaacacaggggagggtaccatcatgtttgtgatgcatggaattccttgcagctgggagacctatctagaatgctgagccgggctcacatccccctgggtgggagctatttctaggtctcatcagcagccaggggagggcttaccagtaatttttaagccatttcaacttctctgaaggcaaaacctgggaaagcaccgcaggcccatcacagatcccctgagagaagcaactcctcaattctgcacctgcgtctgcttccagacagcacacagcaggagggttatccaagcatttgaagaaatgctctccaggatcaactctcttcttcagacaactcccaaccattgtggttttaagtggcagggcacagctcagaagagaaagacaaggagggcaaggcggcaccgcagctcagccccgcagggtgctagggcggacaccctgcggggtttgcctgggctctgcattcccatcccttcattagcccaggggtgtggaacagtttgcacccagctctgggtcttcatacgtggaggtcaggagagtctcaaatagtgcatctgagaaaacccccaaattggtgcgatttccaataatacgtagcctttgcatatttctaaagagagtcagaggttggaaggaacccaggagaccaagggagaaacccgcacattctgacaggtgcgttttctcatcaggatgtcagctgctgggacactgccccaggccattcgtgtgctgctgaaactaggatgtgtttctcttgtgtttggatgagattttattcttcctacgtgctggcatttagtacactgttgtttatggctgtttgatgagaaaagcctagggacggctggtttaaggtaagaacattcacagtgtgttatctgcatgcccagggctgtgagggagcagaagacacagggttggctccctgacgtgttggagacagcaagagacgtggagcacatctggagggggaggctgggctgctgctgtagccgtgatcgctccggtccacatctgggttcatttggtgtgtggacacaggtgtctaccgagagggttttacctaagttagactaaacaaggctgcgagccagtcccagtctgtgactctaccagaagaggctgggtccctggctgaagaaatgctgaaaaatcctcagacacaaatgaatctgttcgactcaatgtgcactcaacaattgactggctatccctagccctctttgggtctaccagttgctatttcttgcgtgggcatcagcctgcacacagtgaacaaaagcagctggttcagagctgccagtgctccccaggggaaggactgacagagtgatgccaagacagggctgccctcctccctagggaatgtccaatccatgcatggccaccagaatcaagggcccacagaggaatcaagtttcaggggtcatggtgggaacctcactttcccagaggataaactgttacacagaaggcctgactgcttttggtttcttagcctgtgagttggaattcatttgtgtgactaattcatgtttggaatttacaaaaagaagttgtttcaattgccaccaagtaaagggttcatttaaatctgcaaccttgctagaatgcctggctcatgccactatgaaaacctgcatctgagcccattctgttttgaatggtggacacctagagagtaagaaggaaaagggaaggaaaggtcctacccaacatcagaaccacatgagcgaatggccacttgggaaatggaaatacatttgacctccatggctcagagaggttcagaagggttaataaacagctcaagcacttgcacctgagagcccactgttactctagagcaggggacaagagtcacccaaggtgactataagtccccacaaattcatctgatgtgcacttcccagaatctgcagcaccctgtaccaacccccatcccctctccacagcaacagtgcatcctaactgtgagcttaggagacacgtatttttggcatctaggacttaagtattaatccctgggggggtgaattccataaattaaggaggggtacagtaagaggatgagatgtttaaagagaagcatatccatggaatcaaaatgcgatcagagcattatggccaaataatccctaagaaaaacactgatggtacacacaacagatacaagattcaaaataaatcatcaattaatacttttaaatagtattattgtattctttttatttatctattactattaataattattatttgatggtacaaagtgaaaaggattataagtgagtgtgatgagcatttgcacacctacaaacaggataacacaagaaatgggaaaattcctagaaatacgcaacctactgagactgagtcatgaagaactagaaaaccgaccccaccaggagtgagtaaggagactgaaaccgtagtcaaaaacctcccaaagaaaatcctgcagtcactggtttgatggataaattttaccaaacatttaaagaaggattagcaccactcctcctcaaacttttccaaaatattgaagaggaaacaatttctaactaatcctgtgagtccagcattactctgacacgaaagccagacagacactacaagcaaacaaaactaagaaccagtatcccttataaatactgatgcaaaaaatcttcgacaaaatactagtagacaaaattcggaagttcagaagcatattaaaacgattgctgtaccatgaccaagtgggatgtattcctagaatgcaagaatggttcaacacataaaaaataataaacgcaatacaccccactaacagaatgaaggaaaggacccatatcatcatctcaactgatccagaaaaagcatctgacaaaattcaaccctctttcatgataaaaacgctcaacaaactaggagtaacagaaaatcacctcaacataataaaggccatatatgaaaaatctgcagctaatgtaacactccagggtaaaagatggaagacttttcctttaagactaggaacaatatgaggaggcctgctttcaccactgttattcaagacagtattggaggtgccagccacaggaattaggcaagaaaaataagtaaaaggcatctaaatgagaaaagaagacataaaattgtttctgttcacttatgatatgatcctataggtagaaaatcataaagattttacacaagagatctgttagaacttaatagaatttattaacaaatttagtaaagttgcagggtataaaatcaatatacagaaatcatttgtacttctatacactaaaataaacaatgccaaaaggacatttaaaaagcaattccatgtacaatagcatcgaaagaataaaatatttagggtaggcttaactaaggaggtgaaggacatgtacactgaaaactacaaagtgttgttaaatgaaagaagacacaaataagtggaaagacatcccatcttcacgtattataaggctcattattgttagcttttaatactacccaaagtgatctacagattcaacataatctctaccaaaaatattgatattttttcagagatagaacaacccatccaaaaatttatatggaatctcatgggaacccaaacaaccaaagcagtcttaaagaaaactggaagacttgctgatttaaacttacaacaaagctatagtaatcaaaacagcatggtcctggcagaaaggcagacatatagaccaatggactataaaacggagcccagaagtaaacccttttgtgtacaaatgctttttgacaattgtgccaagaccattcaatgaggaaaagaataggcttttcaacaaatggttctcagacaacttgcaaaagaataaagctggacctgtaacttacatcatatacaaaacttaaaactgatcaaatatctgaatttacaagatgaaactataaagctctaggaagacttagggggaagcttcatgacactggatttggcactgatttctcagtatgacactaaaggcacaggcaacaaagaaaaataaacaaattgcactttattgcactttatcaaaattaaaaccttctgtgtattaaaaaacattatctaaacagttaaaaagtaacccaaagaatgagagaaaacatttgaaaattacatatctgattaggagtatctagaacatatgtaagactcctacacccaacaacaaagaagcaaggattggaatagacatttctccaaagacgacgtgcagatggagagtgagcccatggtgagctgttcaacatcaccagccattaggcaaaagcaaacaggagccatgagatgccacttcacactcctcaggacggccatcctcagaaaaccagaaaacaagggctcatgagggtgtaaagagactgaaactcgtgtgtactcctagtgggaatgtaaaatggttcagccacactgggaaatagcttgagaattcctcaaaaaattaaacatagaattaccatttgaccccacaattccacgtgaggtaaacactcaagtaatgcaaaagcaggaacttgaatggatatttctacactgacatgtatagcagcactattcccaacagccagaaggtggaagcaagctgagtgcccatcaggggaagaacagataaaaaacatgtggtctatacacggcggggtattattcagccctaaaagtgaaggacattcatccaagctacaacacgggtaaaccttgaggatattatgttaagggaaatgagttgtatatataagaggacaaatattatgatcccacttctctgaggtccctagggtcatcagatccataaagacagaaagtggaacggtgggtaccaggggccgggggaggggttgaggagttcttgtttagtgaatacagagtttcagtttgagaaaatgaacaagttttggagatggatggtggagatggttgcatgacactgtgaatgtacttaatgccactgaattgtacaggtgaaaatagttaaaatggtaaattttactttatgtatattttaccataacaaaaacatcattgcaaaagaagcatgggaagaatcataatcaggtgctgttttaaactgtaaatcaataaaacctttctgaaaaaggagttgggtggcacatgtcaagaacagataaaatatagatacattttaaccatctaatttcaattttaaaaatacatctttaattctttccatttaaaaaatgtgcagtaaacattagatatagaaataaaagctctaagaatagggaaatagctaagtaaatatattttcatggatgaaaaattattcatccgttaaaatgatattacaaatgttgaaaagaccaagatatttttatgatacaatgataaatgaaaaacaaaaacaaaaacaaaaaaacatggtcaggcatggtggcttacgcctgtaatcccagcactctgggaggctgaggcgggtggatcacctgaggtcagaagttcgagaccagcctggccaacacagcaaaaccccgtctctactaaaaatacaaaaatcagccaggcatggtgatgggcgcctgtaatcccagctactctggaggctgaggcaggagaatcacttgaacacaggacggggaggttgcagtgagccaagaacatgccactgcactccagcctgggtgacagagcgagactccgtctcaaaaacaaaaacaaaacaaaaccaaaacaaaacaaaaaacaagcaaaaaccaaaaccatggaagtgaaattctcaattatattaaaatatgtatctgtaacactcttgaaggaaatatgccaaaatattcacagtagttatagtttattagagagattatgaagaaatatttttctttcctcttttgattttttccaaaaatttcacaatggcacacaatatagatattaagaattattataaggtcaggcgtggtagctcatgcctgtaatcccagcacgtcgggaggctgtggcaggtggatcacttgaggccaggagttcgagaccagcctggccaacagggtgaagacccatctctactgaaaatcaaaaaaattagctgggcatggtggtacacacctgtaatcccagctacatggaaggctgaggcaggagaattgcttgaacccgggaggtggaggttgcagtgagttgagattgtgccactgcactccagcctggatgacagagacagactctgtctcaaaaaaaaaaaaaattataaaaagtcgattaaaacaacaacaattttaaaaagagggcaggaaagtggtctagtgcccaagagacctgtctcagcattaaagcatccatttaataacggtgtaatcttggctttgttatttagtttctctattcttcagtttcctgatttgtaaaatgaaattttcaggtgactgcctttcagcactcacactcgaaggcacttagtaaattcggcactcatattctaaggcactaaacacatgtgtctacttatgggagcccgaacatgagcctctgtcaggtttatggaggatgagttccagtgggaaagaggcttcctgagtcacagtgagcccaggagacccggcggcggccgcaccgggacccggggtgtgtggagacccggcggccacacctggacccggggtgtgtgggaggctctggaagagccactctgtgtcccaccctctcactttccctcctgctgaagaggcctcagtgcccggcgggtgcacacaagcggcgcagtccctactctggcgggaaacacaggatgtgaaagtattttatgaaacagtttcagtgaagaagaaagtgggtcattttctaatttgaaaaatccagagtcttctatttttctttgaaatttaaggagaagcaaagtgcttttaaaatgtttgcgtattagcataaacgattacaaatatttgtgtgtttcctggtcgatgaaaacacgccgctgccagcaggatgagatccgaatgtgaatggccacacttcagcaggagtgttattccaccagcgggagcgttattcccccagcgggagcgttattccccttcccgtttcctgttccttggtgttgactttaatgcatatgttcagatacacagaggaatagaattgtcaaactcggtcaccagcaggtctctcattattagaggacaccctgatccaggacagcagaccaagggtgcttagtttttacactatttaatacacagattattttcatcaatgttaagactacagcttcctgaagtcagaccccaggccttttattggtacctacacacccggggtcaggtgcagcctgcacatggcaggtacttgaggaacacctgtggacaagctggaagagtccggtgggaagggttttcagtgacaagcataggaagggttcgtgacacctgttcctattacagacatggggaggttcaaagtgaaccagtcaggaataatctcagcctcaccccagaaggaatttacaaatgaggaccatatatggcatggactagagggtcatatcaacccacagactgtggcattcttggttccattccccactatttggataaccttgagcaaggtagtctttgagccctgaaatggtgaggaacatgcccttagccatgggatgctggcaggtcattgatactgtcctatctatgaacggggttttcctgtctttaaatggggtgatgaggccacctcgcaaggcagcatgcagagaagcaagtccacacggcagacactcagccagcgcagcgcccagcacagacgtgctcagcagacgcacactctcagctctgacagccacggtgcaagtcagatgcaagcctgcaggctgagccgggcagtctcctggcctcaggtggacctgcagtcagagacagtccctcccttctgcggcatcctttccttcctgtgtgcacgctgtagaatagcgggctgggggtgtttaagaccagaagcagaaaactgacaactttgttgcctggaaaaaataaggtggacaatactggaactaatggcagaaacaaggttttggagcaatctacaatttattgaaagcagccctgagtcccaggactaaaataactaagaattggtttggttttattatttcttgttaagcaccatgtctgaggttaagacccagttcttaaaagtaatcacatagatacgtgttacacacatcagttcagttgctaaccagcccatcagcttggatgtaattacttcacacgttctctgagaatgtgttccacacataaagaatttccataatggccaggcagccttgagtggaaacaggccacagttcgggcctgggagagaagtctgcaggggggagatctgtggtcatgccctcaccccatccccagggcagacgatgccgcttctcagtgaggtccccttggcttcctgtcacagcacctcggtgctagtccacccgggagatgccagaacagggctaactcgttcatctttccagtccaatggccggggttgctacatttctcaaacttaatttctatcattaaatccttttgttttgttttatttttggacagacgagttctccctatgttgctcaggctggtctcaaactcctggccttggcctcccaaagtgctgggatttataggtatgagccactgcacccagtcattaagtcctaattacatgttatttgccctgttcaagttcaagcagtattttttttaataaagattattcccaatagatcttagtcttcatctgtaagaggctgttgagggcacgaccacctcgcagtgacctccctctgtgtgggacccccgttcccactggcacaccatggggacagctgggtggggtagtgttgagttctggtcctggtcccaccgacctgggctggagctcccagatgctccacacacccacgtctacagaaacactaggccagactggggtccgccccacacgcacagaggatcactgggggcgatgtagagatgtggaagctggaccccaccccccaggctaattcatcagcaagatgttggcaactgctgggctggatggttattagcatattaggatgacatttgaccctaacattccagttttgtgctaccaaaaaaaaaaaaatcacctgaatgagtcaagacagttaaacttgagggtgatttgggaatgaggggaattcatccatttgaggttaaatgtttgccaatctaatttggtcaaaacagttcatccacaaccccgtgcaggccacaacacaggagcaggtgcagcagggcccttgagtctgtctcacgccattaacaccctgtgatggccttacttggcgtgtggagctgtgaccaccagggccaacctgaggcagcatcatggacttgaccgactcacctcagagcttggcactgggtgctctgattcccttcctcaagcttcccacttgaaggttggtgtgaaaccccaccccactcaaccctggctgatccccatggcctgttctttcgacgatcctcctcttgccccaatttctccaccgcacagactcgccagggctttggtttgtgagtgccctgcactctgtcagttgggccatggtataatttatgttcaacagagacctttgggagtgagtgtcagtgccgtagcggaacacagggatctgaggcacaaggcagggctgtcccaggcaaacagggacaccggccccttcatcagtaggtgacatgctttcattcaataggaaattccagaacaccaagaaagggatctccagacagggacctgaaaacaggatatggaggtagatttgtgggagagagttggaaagggagctagcactctttgagtacccactttgtgctaaatacttagtttttgactccatatgtatgaagattaccatatttcatcaatttcaagacgaaccctttttcacagtgtaacccctctgaagtcaagatgcctcttatgaacactggcaagagagtttagctggagcatagccctttcctgatagcacataaagagacggtgcccctcaccagggttcctggcttggactggacagacgacagcaccgcaagcatctcaccatcgagagactgagccttcccaacaccatttggcattcccagcttacacagctgagggggtgaagcaaggttcaaatcaaagtcagcactaataaaaatttctaggtttccaaccctacacacccatttgggtcccactcaaacatcaccacagggtggctctccccagtcacccctcaggcctggcccagtgccatgagaactgggacctcaggagggtcagagccccagcaggttccagctctcagatcaaggtgttcttttcttatcatcttctttcttctctttcccctctcctaaatcactgctcactctctgccccacacccaactcaacatttagatgctcagatagcatttcagagtcttattttatgactttctgaagaattgtgctgcttcaaaaataagagccccctcattaccaaaaacttaacccaaaagtgcacttcccaaaatgcctccaaataagtgtgggaaatccaggaagccctcgagagccactgaacgcctctgtgcccagcactttgaccagcaccgtggaatcagcttcccaaagcatgcatggggcactggaatcccagtttcacagacacagagacacagaaagcttgattcacaggcaggtgccaggagaactgcagttttatccctgtaaagtctaattccaacaggagtactcagccacattgaacttcttctcactaagaaaagttatctcggtggcctataaactctttggaaattgctttgaaaacatgttctaggctggtgttttattatttatgaagcaacactgctgtcctggtttaactgccttcctgtgaaagaaaaggcttcctgttttgtttcctgagactcctctttctccttcatgtcatcaccatcaccaccatcatcttcattaccaccatcatcttcaccaccaccatcattttcattatcaacatcttcatcaccatcattaccatcatcttcatcactatcaccatcatcgccatctttatcatcacctttatctttattatcaccatcaacatcttcatcaccatcatcatctttatcatcacaatccccattatcaccatcatcaccatcatcttcatcaccaccatcatcttcattatcaccatcacaattatcactatcatcatcaccatcatcttcatcattaccatcactactatcaccatcaccatcatcatctttatgatcaccattatcttcattatcaccatcaacatcttcatcaccatcatcatctttatcatcacaatccccatcatcttcatcaccaccatcatcttcatcaccaccatcgtcttcattatcaccattaccattatcaccatcacaatgatcactatcatcaccatcatcttcatcaccaccatcatcttcattatcaccatcaccattatcaccatcatcacaatggtcactatcatcagcaccatcactgtcatcaccatcatcatcaccatcatcttcatcaccactctcatcatcatttttaaaaaggattgcattctaaaaagttctgtgtttgaaagtatatttgttttctttggctgctgttgtaacaaatcaccacaaacttagtggcttaaaaaacccacaggctggctgggtgcagtggctcatgcccataatcccaacactttgtgaggctgagacaggaggattgcttgagaccaggagtttgagaaccacctgggcaacatattgagatcctatctctattaaattttttttaaaaattagccagatgtggtggctcacacttacagtcccagctacttgggaggaccccttaagcctaggaggtcgaggctgcagtgcactgtgattgtgccactgcactccagcctgggcgacagagtgagaccctatctcttcagaacaaacagacaaacttattgttctgcaggttagaagtccagcccgggtctcactgggctgaagtcaaggtgtcggctgagctgcactcctttctgaatgcggatgacggtaaatgggatggaaggtgcaggtagagactctgtgtggcaggttctatctcatttacgtggctgggagttgtaaatgccatgagtttcttctgtttgttggaccgtaaagcaatggaggagtgggtgaaatctgactgtgggctgagagggctgtgtgtccccgtcctcactcagaggcagacaaatactccatgacatggggaaaaggagaacgatgctgacccattccacaagtcatcaactcgcacaagttatgtatgtgcagtttactgagagtcagtcatacctaaaaagagaaaaactcaacaaacaggagggtggacattgaaaagtatctggctgaccctctgtgagtgaagatgtatttaccttgggatgaatgatcaggaaaaataaaggctgaatccagggagaaggggtctgggcagccacaaagctatgggacacaagtccatggaggtccaatgagctcatctcatgcacggttctctttttgtgatgaacaccagtgtgaccagtgtaaatacaatattagttggatcatttgttagtaacatacctttggacactggcttcattcttcagtatcttccctttatagacttggctttctgggagctggatgtttacccagtaccacctagcactagtaaattactacagcggagggcaggggaggacccactactccaggatcatttgtgggggtggcacctgactcaatattaaaaaaattcacatggtgttttatggtttacaaggcagccttgaacatctgacaccatgtaacaagcggtaactgtgagaagtggggatacaggaccaggccttctctccaaaccttgaggttacctttcctaggaatgcagagctttcagaatggtgtccattccactcactgcatttcagcctctgtggccttgggcagcacctgtgatgcctgtgctgactggcatcgtctgcagtaagtgaggagggcacagagccttccatcaatctgttcagggcatgatttgctgcaaagtgagttgtgaaaactttcggttttcaagagtttctgggtctcggggttgtgtgaatggatgtgaaccagcctccttctgtttttccaggggatctaacaaggctcgaacgctggagccgcatgtctgcgaccactcagcaggtgccggctggggctgggctcctcagacctgaaacactgacttctctatttggcacatctccagggtcatccttgcagatgaagaatccagcctgggtgtctcctgacccatcatacagcctagaagggtttgtgttttgttttttccaagtaaattcctgctatcattttacttattttattgctgtgtgtagagtgaagaagatgctgaaaaaaaagagtgagagaaaaaaatcccgttgatcctggtagatgggatatatgggaactaattttatatccatgcatgagttaaaacgagcagtaggcacatttcccatgggcgatggaagtgacctctgtcggctcagtggaaggtgccgaagaaacagcaagagacctccttgtccaggtagccacaaaggaatttccttttgaaatgtatactcgttgaaatttttaatccaggataaattatgagagtctgtactgcacatgtcagatgctgcacatgaagggttaacatcttgcaatatccatggcatcaatgtttccttttttttttcatcttgctctgtcactcaggctggagtgcaatggtacaaccatagctcactgcagccaccacttcccaggctaaagcgatctgcctgcctcaacctcccaggtagctgggaccacaggtgcataccaccatgcccagcttatttctgtattctttgtagagacgggatctcaccatgttgcccaggctggtctcaaactcctaagctcaagtgatccacccacctcagcctcccaatgtgctgggattacaggcatgagccactgtgcctggctgccagtatttcctctttgcacacatcctgcacttgtcagtggccacttgcccacctctgatttctcaagtgaaatcatcatgagaagggcatgagtggggagctgggaggtggtggcaggctgggtgctgcctgggtttcatcagaacctcctgaggtgggggccaggggtagccatggagttgggagttgtggaggaggcgagatgcttggaaggaagctgtggacagggtctgaatgggggtggctgagcctgaagctggagttgagtcctggtgggagcagaaaccttgggcacctgggagtttggcttagacagattgggctgtgcatggtggagaaaggcccaagcagaaaagctcctgaacaggcctggagcttgcacaggagaaaggctggagtcacagacctggatgttgactctcctgatctcctaagggagagaggagaggaagaaatgaacggagggtcttgggggaaattccccaagaaataagtgagtagcaaaaacaaacactgccagactcctgaggccaacgggatccctgaaggtgcagggacttaacacagccaccaagaaaatgcaggtgagaggatgagtccaggaaaaacatcactgggctggcctggggaaattggtggccctggcaaggaagttgcagaggctcagttccaggaacacacagggaaaggtaaaagacatttgtttcccacagggccagggctctaccagctcagttttgtattagacactggggccacactgttggaaataataatttagggataactgcacaatatacttgccacctttgccctatgaactccccaagagctcaggacacacattgagaaacaccagcacacaagtacccaaggtcatctgcaggcaaatagaaagcatcgtggaagcaatgctcattagacccacacactgtcccaggtgctctgctcagcagaaccgggggacagagacagcatcccaactagcagggaggtgacaatcccaggggaagaaagaaggggaaagtctctattccagcacaagggtctgaagtcatgaaaatagagcagagcagggagtgaagctgtgccagagccacgctgatggcgtcctcaccattggtgcgggtgggtggccagatgcagctgcgcagatggcaggggcatgtttcctcctctcactgtaactggcagcagtgtgcttcattgtcacgctcagagcggacccccccccccacaggttgcccaccccagggcaagacctagatcctggtgagccttggtgggacctgtgcccagcacaacacacatggacagcccagcaggggtagctgtgcagccagtggagtggcttctgtgcccagcatgccctctctggggctcattctcgtgtttcctaccctaattctaagctcattcttcagagctcacagtgcccctgacactccctggtccccctctctgcccagtgaccaaagctggcttgtccctgcacgcacgaggcaccactccatcacatgacttccatctgcctggcaaatctgcaccatttttggaagcagctgaaatcccatttacccagtaaagtcagctgaaataatcctagagaaagttcaccacctcttcctctgcctgtgcctctatcacagatttaataacacacccttgtaattcatcttgcttatgtgggtgttttctccatgagttcttcaagaaaagagctggattctgttcatctttgttcttacccctgagtatccaactcagagctttgtacatactaaatatttgtacttgtactgaatattttttggaatgaataaatgcatttttgaagcatcagaccttcaataaaaaaggttatttttttcttatccatcacgaatccgtatttgaagatttctggaagaaaaatgaatcagaaaattcagaatatccaggtgagtctggggatattccaccccagtgcagcatagacacacctcaggacagagaaattgaagttggtggggtttcttaaagctcttgctgtaatgagcgccacttggaagtaatggcttaatcgttattaatttctttggtatttcctatgataacattaatcacagcaaactcatttgatgtaatggagaccaggaacccccctggaacgttccccagcaattccgtgctaattaactgaagcatcttgtaaaactgccaccctgttttacgattaagtgcatttcttgcacactttgattaagacacaaatcccaagccaataaaaaaaaaagtgggaaagaaagaaagaaaaaaaacccaccgttttagaatgcagtaatgagagcattggtaaagtaacagagacttcactgccagaggcgacaatagctactacttgaagtgaagcaaaaagaactccccagggatggtgtagactgagaaaccttcttctgtaccttaatttatccactgcatatgtacagaagcaattttaaaatgcatattaaacactccagtgaaagaaaagagaataattcacaaagatgtcagttctgcatacccaagtgagaactatgaaagcagagagtcctatgcaaacttatatcaaggtatggaaaacaccttttaccacttaaggtaaatgttcaatttccagagggcaaatcgtgcgctgcctcattcagcagcagaatttttctccccaatgattggcatttggctatcaaggcagaagaaaatggagcatatcacaagattgcacagcttggaagtgtaaaaggcgttcactagaacaggttctctggcacccagcatgccaaggtcctaacgaaaatcgtgtcaaaactcacgtcagtcattctgtgttttttctccactggttcaaatgcacatcattctaaggatgacagacacatgcagaggcacctggaatgaggcaaatgggacctcgggtcttaaaggatgaaaccagagcacatgggcattaacctgctgactgacagcagctcaggacgagagaatgcctatgtcacccaagagaagggggtccaggccctgtgggagagaccacaggaactccacaccacgagagcagggcttcagagaccacgggaactccacaccacgagagcagggcttcagagaccacgggaactccacaccacgagagcagggcttcagagaccacgggaactccacaccacgagagcagggcttcagagaccacgggaactccacaccacgagagcagggcttcagagaccacgggaactccacaccacgagagcagggcttcagagaccacgggcactccacaccacgagagcagggcttcagagaccacgggcactccacaccacgagagcagggcttcagagaccatgggaactccacaccatgagaacagggcttcagagaccgcagaaactccacaccacgagaacagggcttcagagaccgcagaaactccacaccacgagaacagggcttcagagaccagagtaactccacaccgtgagaacagggcttcagagaccacaggaactccacaccacgagagcaggcttcagagaccgtaggaattcacaccacgagaacaggacttcagagactgcaggaactccacaccacaagaacaggcttcagagacctcaggaattccacactgtgatagcagggccccactgaagccaggggtgacataagcctgcactctgggctgcagcggcctcactggcctgcaggagaggccccatgagatgccctggagcagcagtgggtgggaggaggttgtgcaggggccttcgagggatgaagcagctttgctggcagttttggggaagacagccctacttggcctgcctttagttcatgggctgataggacagacacaggatttaaaggccaaatagaaccacataaaacctgcagatgtaaaataacaaatagcatgctgtggggaggaatggggaaagggtggggggaaataacagggggtaggctcttcaatatttaaaagttccagacatccacagacttcttatgtcattttcctgatgggagggaaatgaatttccaatatttatatacaccatttaaataattttgctaaataatcagaggtcttagagaaagatgtgcatagagccaaacaagctgtctacatgagacacagccacagccgggtggggcttaccctgtaaagaatatccttctgcacagcagaggatggcctcactggattagatggctctccttgaatcaaagccctaattttcaggtaatggccaagatataagatgtaaagcactgttgtaagatttttaaaatctgtactattttttgtaatggcaatgtaaaatttaaaaagatgaaagcatagcaacaaagataaaataaatagcatgcttttagaagaccacgcggcatggaaagcagtctctagcgctgtctttcttccgttagggtggactggaaccacagggtatgaaaagtggcctctcgcgctgtcctccttctgttggggggactggaaacacatttctccattcattgtcagtggtgttacaagccattggtgagcttccttccagagtgaatgccaaatgatacatttatattagatctctctgaccactgctgttgacgttggcggggtagcaggtgtggccataacatggagcacaggctgagctgcctgacttgcactgctggacggtgggttggcggtgttgacgctgcacaggtcatgagcgccggccctgcggatccggcgatgatcattgtggaaagaatggacagcaccctggttgatgtgcagagtgaccctgcagtcaagtctgtttgcctcccactagcattttctcatctccagcacggtgtcaatggtgccactccagccgggccaccctgcccacaaggtcttccacggggctcctccccagctcacggggaaatcccctttaatttcaaacagggcccttccacctgcccttgattccctgtggcaccttgggagcatggggctgccctactgtggagttagtgggtccacttcgagaagacagagacagagtgaagcctcaagaacagtgttcactggcagtgggaaccgtcggtcctgccatgggacgatgtgactgggggctcgtccatgccttgtcgtggacatctctggtctcagccggcaggggtgggtgggacctcagacctcagcgggtgatggcagtgggagcctgggcaggggcgggcagggctctgtggtaagacacagagggcaggggctggggtgggcagggctccatgggaagacacaggtagcgggtcaggtgctggggaggtgttgctgggcatggtggatttgcaaatttccagggcggtggggggtctggcaagtgtagacacagggcagaagtgggcgcagtgtctgtgggtgaagagctgtgcgggcgggcactgagaagaggtgcccacgtccatccccagcccctcaggcatgttcaccatcatggcgcacatgtctgggagtgagcagaggaccagggtatggaacaagccctagtcagaaatgcctcctgacgcctgtgacctctgggcagggctagtgaggggctggggagagcagagggtgtttctggataagaactcacactaaaggcctggcccggaccctgcctccatcagcagggtgcagcccaggcccagcacattctcctcctcctgggacctcgatcttggcttcccctaggcctttctggggccccccagttcctgccaacactgctgtccacgctggggccctccagttcctgccaacactgctgtccactctcttgtccaccccatgattccaaccactggatccgagcatctgcaccctgtatccgtttctctaacccagatttccttcaagtttcaatcctgtactttcggataaggactggatgccagcccctgtctcctcatgtctgagagcctctccatctccagacaccccaatctcctcgtccctgtgatgtcggctcaggtcaccattgtgtcctcttgctctcctgggtcaggcacctaggagtccctgaatgcaggcaaatcattcctcagctgtcagctattcatattcccacggccccacgaggagacgtgcttcattctacacaaacttgggcgagctccctagacccgaactgtgcttttcagtgagtgtcacagatgtcacatgggtgtcagattcaaggatgaggccagcccttggtgccaggcttggcataaatcagccccaccagcccctgcctgccctccgtgtctggtattcatgttcaaaggagtctaaaacctcactgtcttttccatgtgaatttacctttttttttttccattgcatgtcctttaaataaccaccaggtacctactgtgtgccctgggcactggggatgcagagggtcccaaccacaatgcctgtctgcaggagttcccagggtggaggtccagctgctctgagcctggtccaaggacagccacaaactagagataggctttggacaaagcagtgtggccgaggtggggtgttgtaccccatgcgatgtggagagagggaacttctgtcgaggatggcagagcagagctgggcagcagcccagcacagggccctccctcacctgagtgctcaccatccaagtccttgtagcacaaggtgagctggaagcaaaagccaccccagctcagatgtcctggtgaaacgccgggaaaggggcctcagccagggccatggcagcttagggctggttcccatcgcgttatcagcaaacgaatcttcccagaatcaagctctgatctttcttctctgatgtgaggtgctcggcgattcccaggaggcgctgatgagttgctcagcctggcagccgagttccagcagagttgagacccagcggctcctctggctgttcctgtgttgggcattctcctgctcctagcaccggctggcactctcctctgtggcctctgttctctttattgttcagttatgaggcttcttcctcagttccatgggttaaaatccagatgcaagccccccccaccaattaccccttcattctacagagttcccaggttctcgcccactctgcccagcaccttactggagcctccaccatgaggcctcccgtgctgcctcctgggatagtcacgcatgtgcctgtgcggctgccctaccagaccctggggcctccaagatcgcaaactggtccatccctctccctgcctccagcgtctgccgaccatgcttgcacgtagccgtggacttgtgccgcagattggggtaaataatcctagagcagataactaaggtacactcttcaaactgtaattcatcacaaaactaagtaatattttgtttttaaatgtacctaagcccatgttgtcttgttgatattaaactgtgggggtatagaggtgtggtagcattttactaagtcacagaggatataaacacttctgcttaagctcccaaatcgtcaaagccaggcatagtggaagagaagttgaatcaaatcgaagtttattaacaaagatagctgtcatgccaggaatcgttatagatttcgtcaaatttcagaggtatatgtaattatgaaaagccataaacacagtagtttccatgaaaaactatgagtaggtatggaaaataaaacagatgcaagggtaggaaccacagctaatagtccatgaatctaataattagttaactgattaacgaaatgcatattcattaagcacacctgtagagagcctattgcgtacaggtgccgttccagcaccggggactccctggtgtgacccacaggtagggtggctgtgccccatgaagcttgcatggaactcaccatctgtggtggcactgatccaaattcaatgaacaaggtgatttctgatcagggctctgagctctgcgtcaagtgggaggggttaatgtgctctggagtgacaggggtgggaggggtttatcagagatctgggagccaggaaaggtctcctgaggggatactcaagctgatgcctgaatgccaagagccacctgggcaaatgtgggattgtgcctggcaggtggagggcccagagcgtgcaaggccccaggtgggatgacgtgagtgtgttcatggagtagtgtacaaggccccaggtgggatgacgtgagaaggccccaggtgggatgacgtgagtgtgttcatggagtagtgtacaaggccccaggtgggatgaattgagcatgttcagggagcagagagaatgctgctctgtccagtacctgtgagcaggggaggtgggggcgggaggaagtgagaggtaggatctggtaccatctcgagaggctgcagcagggacacttgaagatctagtgacacctaagagctccctgttgctgctgctgggggagcaggaagggggatcaccctgacaagactggtggcagctgggacaagagtcgtggctgaggaggagggaaggaggtcagcttcccgatgtgtctgtgggccggcaggactcaccgccgcaggcagcaggctcaggcacctttggtaactaggcccacaacagatcctgaactccctgtacgtcgcatgcacatctacagactaaataccaaggagttttctaaaaaggccaatgacaggtcaggtggacctgaattgttaccactaattaggataaaagaggtttacagatgccttgggccagggcagtttcccggaaagtctgaaaccagctctcaggtgtgttttgtggaagacacggctcctctggcacagggctgtgaaactagctctcagacatcggtgaaactctgcctgatctgcttctcaaacagctcccgtgtggtgctgccgccatctccgccgtcaggagtggctttgcaaagacgtcttatgctgaccgcatgtcttttggcctttcttttcaagagccaaacacttcctcctagacaagacacagcaagatactatggcttcacgtccttcctaagcaaagccagggaccattcgggaaattgtttagcaatgctctgagtcttttactcttttgaaagcttttgagctcaagacagtttctggcaaggcaagtccattcattcacacctaaagctacagcatttgtgaaaataatgaaaaggtcttaatgctggcatctttaacaaacccttcaaagtcacaaacactcatgaaagcagaagccagaactagactttgctcagaggtgagcagctgatccagctcaggggtccccagtgatgattctttctgaacaagagtcctcagctcccccacttccctctgggactgcacactttctgttcccttcctcaagggaagccttttcccctgattttctgtcacagtgaggttgcattcgtggtgaagtcggtcctggttttggggccaacctcactgctcgtggggctgacagacgagaccccaggaagcatagcgccatgatgggagaaagacatcccctgggccttcctggcgactcacaaggctggatgttcttgtctacgacacctgcccagcggaaggcccagaggggggtggctctctggagttgactctgcagagcactggcaaggccaggatccagagctgcatacaccaagggccgccctcccccaggcctactgcacctgcttggccttgcctacctgccatctcccatcgcccccgcggccctggcaggagggattgtttctctttctgtgtacaaccagaacctactacagggcccagtccacagcagatggctaatgaatgtctgctgaatggatagaaaaaaaaagaaaaatgttttaaatgttcaaaatacctgaaggagatgagaggacattgcttaagttatcagggaatgaaattcccaatagaaagacatgctaactctcagtttagaaaatattatcctttaatccatggttttctctggaaaaaccaccaaagttaagaacattccacatctgagaaaacacttcacgtcgctgtggctgcagcagcaatggtggtgatgacggtgacactggcaactgcacgttgctgagtgtccgctatgcactggtcatgattctaagttctcacatcacatttaacacatgacagtcctctaatgcagacactatgggagcccacattttgcagatagggaaactgaggcagctggtccagatgacttggtcactacacagaagagccatgcagcccggctccagagcgacgctgcctccggttcctttatctacctctggtgctcccggtggctgacaacgcctgcttatgtattctgctctctgcagggggtgccgctgaatgccggtccttggaggtatgggctggactttatgactcgcatccgttgcatagaatacagtgcgtgatgcacaggcataagaggtccctcagcttcctgctcaatcgcagcccaggccagcaagccaaccataccctcatgtgagtcccagagccagagcccccgactgggcagctgggggatctgtgacaacaggaacgaagctggtgagttcggggtagtgtgttgtatagcatcagataactaatagagtctatttcctcagcaatacaaggatcccccaaaagcctcataaagataatcactgaggactccttagtctttgaaatgtaatcctcatttcattaagtttcagtgaccatcacattttgatgacttggtaaaaattcagtactgatggaaatcatgaccatattattacatcactgaggtttctctgcaaaacaggaacttgttgatcagggtattcattttatgcaggctgagatgcaaacttcataggcaggctgcacaccagagggtaattcagtatctctgcatctgagtaagaaagttcttaaaccactgtctctttttatgtcaacttacagggaagaacattctccaaatatcttagaaattcagtcaagtgtttcaaagccaaactaaattactccagctatttgtcggagttggaaaagaaacttctaggactgagcagccataagatacagccatagataccctgtgattggccgggcacggtggctcacacctgtcatcccagcactttgggaggccgaggtggggagtcacttgaggtcaggacttcgagaccagcctggccaacatggcaaaaccccgtctctactaaaactataaaaattagctgggcatggtggcacgtgcctgtagtcccagctacttgggagactgaggcaggagaatcacttgaacctggctgggcggaggttgcaagtgagccgagatcatgccactgcactccagcctgagcaacagagcaagactccatctcaaaaaaataaataaataaaagatactacgtgattgtattagcatcacatctgcccacagccttggaaagtaggcagacgctcctccctttaagcctgaggaaacccaggcttaaagaagtgacatgatcagccagttcccaccaagccccacctcccacacgggcactggggacaggggagggataagtagccagttcccaccaaaccccgcctcccacacgggctctggggacaggtggggggtaagtagccagttcccacggagccccgcctcccacacgggcactggtgatgccctgcgcactctggctgtgttgtcaggcactcacacagttagatcagtaacttgcagaaaggctcctcatataccaaagttgagtggataaacagccttttaccctaagagtgacctcagagtttgcaagaacccacacatttcttggtccttatacaaattcagaggaactgcagacagtggtgtcaccagaaccatttagacaataatgtgtgtggacgagacatggagaaggcttccatagtcggtgatgctattccaggacaggtgaaactgctcaaactcctgctattccaggacaggtgaaactgctcaaactcctgctattccgggacgggtgaaactgctcaaactcctgctattccaggacagatgaaactcaacttcaactaaaccaatcaatatattcaacacaccaacacacacacaaatttgactccagtcattgataaaatagtaaaaacaatagtttctttcctgttttaaaaggagcttttccctttcattcagttaatttaacagggagtgattccatttttttttgtagtaattcagtttactttattttaaaaaataactcagtgtaccaaatgatttaatgacttcaatgtatcaaaattttattggctcataacctacatctatttcataaaataaggtttgatctaaaatgacccttgggcgtttccaagttaattaattagcaatacttcggaaaggcacaagctatgatgtgaaggctttgagttaatataacaccagttccctatcatatcagcccattcttcaagggctttgcaaagcagcagttctccaaatgcagcccttacgccaggtgccacctggaggttgttagaatttgtagaatgtggggtccccccaaacccctgagtcataaagatgaggaggggaatgcagagtgcagggtaccgcccagaacccctgagtcatagagacaaggaggggaatgcagagtgtggggttcccccccaaaccccaaatcatagagatgaggaggggaatgcagagtgcagggtcccctctaaaccccgagtcacagagacaaggaggggaatgcagagtgcagcgtcccccataaaccccgagtcacagagatgaggaggggaatgcagagtgcagggtcccccctaaaccccgagtcacagagatgaggaggggaatgcagagtgcggggtccccccaaaccccgagtcatagagccaaggaggggaatgcagagtgcagggtccccccaaaccctgagtcatagagccaaggaggggaatgcagagtgcagggtccccccaaaccctgagtcacagagacgaggaggggaatgcagagtgcagggtcccccctaaaccccaagtcaaagagacgaggaggggaatgcagagtgcagggtccccccaaaccctgagtcatagagatgaggaggggaatgcagagtgcagggtccccccaaaccctgagtcatagagacgaggaggggaatgcagagtgcagggtccccccaaaccctgagtcatagagacgagtaggggaatgcagagtgcagggtcccccctaaaccccgagtcacagagacgaggagggggatgcagagtgcagagtccccccaaaccccgagtcacagagatggaggggaatgcagagtaccgggttcccccctaaaccccgagtcacagagacgaggaggggaatgcagagtgcagggtcccccccaaaccccgagtcacagagacgaggaggggaatgcagagtgcagggtcccccctaaaccccgagtcacagagatgaggaggggaatgcagagtaccgggttcccccctaaaccccgagtcacagagatgaggagggaatgcagagtaccaggttccccccaaaccccgagtcacagagacgaggaggggaatgcagagtgcagggtcccccccaaaccccgagtcacagagacgaggaggggaatgcagagtgcagggtcccccccaaaccccgagtcacagagacgaggaggggaatgcagagtgcagggtcccccccaaaccccgagtcacagagacgaggaggggaatgcagagtgcagggtcccccccaaaccccgagtcacagagacgaggaggggaatgcagagtgcagggtcccccccaaaccccgagtcacagagacgaggaggggaatgcagagtgcagggtcccccccaaaccccgagtcacagagacgaggaggggaatgcagagtgcagggtcccccccaaaccccgagtcacagagacgaggaggagaatgcagtgcagggtcccccctaaaccccgagtcatagagatgaggaggggaatgcagagtactgggttcccccctaaaccccgagtcatagagatgaggaggggaatgcagagtgcggggtctcccccaaaaccccgagtcacagagacgaagagggtgctgatcacatcccaccccagcttccaggtgcttctgacacagctgaaacctgaacccatgactttcagggctgtggcctcccccgcccccgcccacatgtgtccaccagccctgggagtgagtctgaggcagggattctcagggacgctgcctgcatgccccggaggagtagcgtgtgtgtgtgcacacgtgagcttgtgagtgtaggcttgagaccgtgctgccgacccagtccctggaatccctgtgctgagttgttctcatgtggctgctggcccagggaggagcgttacggacaactgttaagtggaaattgtctggacgtaatgcagttcatcagctcaaaagctgtgggtctggctgtgtgagccaacagcgctagtgtcctggtgcctggacacacggatgttctggggctgttgctgaaactgcggcacagtaagccctgcagcctccctggaatccctgaggaggagccggctcacccagcgccgcgagcatctcttcctgactcgcagggggcccgtgagatggagaatctgcctgacagggtgcacttgcacagccaagcaccaagaaggaaaatggcatttcattagccatggagacagccgggaacccagcagccttctttattctggctcatattttctcatcattctcagggagttgtccaggtaacaatgaccttgtgtaaaccagcgtccctgcctgagtcctcttcacctgaaaccaccgccccacgccaggctccacctccccacgccaggctccaccccccacgccaggctccaccccatcccacgccaggctccaccccatcccacgccaggctccaccccatcccacgccaggctccacccaatcccacgccaggctccaccccccacgccaggctccacccccccacgccaggctccaccccatcccacgccaggctccacgccaggctccaccccccccacgccaggctccaccccatcccacgccaggctccacccaagccagcggcaccggttctggctggaaggttcccaaacctaggccagggtgtgaatgccaggggccctgtgagtggtgagtgatggttgctgggtgctgggggctggcgctgttcccgccgcgccctccatgaagctgactctcagtcctgctctctgacaccgggctgtgctcagcagccacgagctgaccacgcggtgaggctgttcacttttctccctgactccagctctccccacatgcagctcatccccgacatgggctcttatcccaccaaccgcttctaaagacctgcagaagctccctagtcacaggacgtggcgagcccaatactcacgtctgcccctgacttctgcactaggccctgcctcagccactggcctcctgcccctcactgtcggcctcaggcccaggctctctgtgtagaggcctcctggcttccccaccccgtgctgctccccacccggtgctactcccctggctgagcgcccacacttctttccccttttccaaatcccacctgcaggtggtggtctctagcactcctcttggttcatgggccttgactgacagctttctcctgcagccatcctctccacaattctgggagcgtcgactgtgctcactcaacactccctttaacaaagtgacatcagatgtttgggccctacttgcatttaagccatccagtgcattccacataaaaagcgtgcacctggaggaaactaaataatcacaaccaatcactctttttttagaaaaaagcagcagctctctcaatgtagaccaatttatcggtctaaactagagagaccgggcaagccacttccatcttgcgagtttagcatatttgcctgttgacacctacacttggaggaagccattctgtgtgtgtggtgtgccttcacaagtaatttctatggaaaacagccgtcagacagtcatcctggcccaaggtgacctcattaccagaatttgttctagttgtcattagacatatcacactatgtcactcaaaatgggaaagaaagagaagatactgacatgccgccccagtgattagagatgaaaatgtagttataccatatatgatccctgcttggagactatacggatagggtttaagattcaggcccccctcagatccatcactgtggtcctgaagcctctgtccttcttctgttcttttaaacttctctgtgtagatacagcaagtgtgttttctactcactgcacagccagcgctgctcttgaacaaactcctgagggaggtgcacggaaaccatgcatccaaatccggagagcagggagaccagccggatagcccacctggctgacgagacccggcctcgctcagaaagctcctccaagatgccaccgcgtgtgaaatgcttggggttgaatctcgagagcagggagaccagccagacagcccacctggctgacgagacccggcctcgcttagaaagctcctccaagatgccaccgcatgtgaaatgcttggggttgaaatgtaacgaatctctcactactgacaagagaaaggccagaacacaaacacacttcctgcttccagatggatggaggtgggaggagggaggggttctgaccatcttctctggtgctcagtgaggcaatagcatgagatagataccctcatctacagccccgctctcgtatgtccgggggaagctatggagagggtgctgcaaagctgccagcaagtatgtctgcctctgacgagtcactgttggatgtgaggcaacgtgaaggctccaccactaggacccaggcaagactgccaagcggatgaggcttcgctttaggaccatggactctggcggcagataatggcctgagaggtcagctagtccaattgcttccttgtagacacgcagaaactgacgcccagagaggcagggcaccccgtgtgtggtcaccgtggtcagtggcagaggtggggctggaggtcagaactggctgcatccgtctccatctccccaagcacaggccatgcctgcctctcccaggtggcatctcctctctgtggtcctttccctcctgcctgcctttctgcgacatctgcactattcagacatcacgcttcctttcgtcctcactcaaaattcccattcactcagcattaccacggtttgatattaggactgcttgattcaagccaatagtgctaaattagaaataatgaaggcttcactcttccacggggttctgcccttggaagaactaatgaaacccaaggaccatccagttggcaggactggaagtaactgggcagaggagacattttggagcaggtggtcggtgcccacccactgacaggagctgccggtttctgacccactccacccctcctccaggaccctccagagtgaatctggagcgagggggcccagtgactttggggtcatttgcacggtatcagctatagccgcagtgagagggaggctgctggacacgctggggttcacctgtgtcccaggagaaccccgctttaggatataacgggttcatgcactggagtagctgccggtacacatctagggagtgatgatccccctccaccagccagtggggaatgagcccgtgaaggtcacagccagccatgaaacagctgcactgccccagcacgccgcccacgcttggtcggcaacacagagattccatttcttcctgggattaggaagcacgaagtgtccagatctgcttctgaaatctcttcctcccttaaggtaaggtgctgtgtggagcttactggaacctaaacgggggcaagatgaccggtcactaaagggggcgaggttaccagtcactaaagggaaagggggcgtgatgaccagtcactagtgggggtgagacaaccggtcactaacgggggcaatatgacccctcactaatggggtgatcggtcactaaacggggtgagatgacaggtcattaatgggggcgtagtgtccggtcactaatagggtgtgatgacctgtcagtcattatctcttgcataagagacttcccaggggcagagcagacccggtggacagcaggagctgcctggtcccactgctgagttttatgtctggatgctgaatagctggaggaagcggcctgctggttttgttcacactgggtgaacagttggaatacaggttcctcgggcctgtcctaaatgctatcagtctttctctagagatggggcagttattatgcagtgtgggatccacagttacagagcggatgggggactaagaacatccattctgcagaaagtgggacattcagggcaatagggaatctgcttttcaatgcagcatcccagtggggtggccccatcacttctgacacctccatcactgatgcccccagctctccccacacctgccattccccacgttaatgcagcagggatccagagaagggtctccggacatcactgatgcccccagctctccccacacctgccattccctgcgttactgcagcagggatccagagaacactgtccggacatgcaggggaccggagtcctcaccactcccccttttgtcttctccaagccagggtcaaagctgcctcatgcagacggagaggagaagctgcgttccctgcctttcccgaattgtttgtggactgtgagtgatgcatgtcctgtggcaccatgggagcaccagggaacaccatgctgtctctccccggagcccccactggcgtcctggccatttccagcttgtctcccaaagacaggcttctttgtgctttggtcacacggagaattatcagtgcagtctctgtctctctctctcatttccccctaaattgccacatgttgcaactcccaggcgtgcccccagctctcctgaggctggtttgcagtggccgggcccagctaaagcaactgaacctccagagcagaggacagtgtcctgcctgcacgtcttgacatggccccacaggagggttccctgtctttcacgtgctgatagaccaaacacaccaaacgcattcccgggcaggtgtgtacatcagaacagtgatgaatcagggacccttcttagtgctactataagtaacaacagtgagtcagacgggtgcaaaccctttggaagactcagtctgcaagccccagggagcacaggggggctggagggaaccgggggagggatgcacaggcgagaaatgcccatgacccggtccacaggtcatgcacgtccacactttctaaaaaaccacctacaagaaaggggttgtttcctggcccccagtggggtgcagaatgtcagtgctgggctgcaccctgggcagggctgctctgggcagcatcgccacacccgtgtcccattcttggggtgcatccccttctcacatctgtgtctaaagccaggaatgggcagtgtgacctgaggaaaatcagggacaccctctgtgtcctcatatgcaaacatgtctctttcatgccagttaaatgaagaaaaaggcaagacctaaatcctgaactcctaccgctataacacattcctctgcgctaaggaactgacattctaaaggtgcagatacccccgggctggaggctgaatgggcaagaagatcccggcacagctcaggctgagtcgaaagaccgtggtttttggccaggcacagtggttcatgcctgtaatcccagcactttgggaggctgaggcaggcagatcacttaagcccaggagtttgagaccagcctgggcaacatggtgaaactctgtctctactaaaaatataaaagttaagctaggcgtggtggcgcatgcctgcagtcccagctactcgagaggctgaggtgggaggatcgcctgagcccaggaggtctaagctgcagtgagccgagattgcactactgcactccagcctgggtgacagagcaagaccacaccttagaaaaaagaaaagaaaagagaaaaagaaaagaaagaaagacagcggttttcataagggggtaagactcagagggcagaagaaagcggagtcttgtggggggcaccatctgtggctgggtcggagggacgagggctgctgtagccctttcctttctgcaccgctctgaccaagtgcgtctaaggggtggagggatgaggggggtgggtgccttcgtggctgcttagccatgattctgctggacaccatggtctgggggaggcagcgggggcgggtgccacctcaccttcgggtacctgacgggccggaatgacacatccttgtcatgtccaccccacttcacagatgggaaaccggggctcaggtaactcaagggaagcagcattgagaggtcagggcaggccttctgcccaatcccccgcctgctggctgtgttccttccacactcggccaaggtctctgcccccgcatcccaccccgccctgcccagggctgcgctgacctgccttctccccctcctcctcattagctgcaaagaaaactcttctgggggctgccaaatgcagagctgcttcgtgtcccttctttgacagtaaaagttgttttcttggaaataaatcaaatttgtatttctcaacaaaacctgccctccatccctctatgaagaaaaatgcaagttgctcttctgcgctccaaatacaccgagacgaaaacaagcccaggtgaagctgcagctggggacacgagttaatgtgagtgcgagcccagggcagagcgggcccagataaataattcatgagcgccaccggggaagaccgggcactcgtggagttcaacagatcataagcaggatccagggtcgtgtagcgacacagcttcccaagcaggcgagtgacctggagcacagaggggagggacggggacaggtgcagcagagattgggcacgggccaggaatgcatcacggcacctgcgcacaggggtggcctccaggggctccaagtcctctgggatccaggttctccttccttcagggcacccccacccaccctctccccaaggcttgggccacactccatgccaccatgcccaacggtccccgccctgcacccacctctggcaagttctgggcagggggagagcgacacaaggcaagggaggagacatcggtggatgggggagcagggcaggctgggggtcagggctcagggcggtgctgacagtaggacatgctggtccccttcccagtgaagtcccaggaaacagcctctcatgttgctgggccggtgctcaggagctggggctgcctggggcacaaagcacgtggactaggacactggaatgtcaccgagcttccctccgatacagtgggagggaggacttggcgcacagtgggtgagtgaatggacaggcaggagtgaccagcccagtcccagcgcttaccgaggaggactggggaggggggccgagtctccagtcaggcagagagagctgctggtgtcaaccctgccagcaagatgtgccccagatccccagagtccagcgaacttccctggccctggccagagtccacgtctgactctgaaggtgtgcggggtgtggacatgagggcactgctcatctccactgccaggctttggggtgtggatgcaggggcactgctatctccactgccagggctgctggatatgctccagcctgtcacaagccaaggcgaccgagcttccctgagaggcacccagcctgatgcagcacagggcaacaggctggggcatgacgggctctgctgtttctcagtctccctgtgatgggagtcgcaatcccatcctcggagggtggctaaggggatccccaagaaagtacccggacaattcctgccacagagacactttaaaaagggcaatggccggcatttctgaggtttccttttcctaaccaggaacagattctctttgacaaatgggtcttgccacttgttatgaacccaatgccgtgggcccggcctgcacttcctggtggagtcctggccccacccagctcctctacacgtcctcttcactgaaggaaactcacagagccctggtggcaccgggtgctgcccgtgcagggcacagaaactcagggccggtttccctctggctgagggagggtgagggagggcgagggagggcggacctgtttcctgttaaaccctggagctagcacagacttgcagcctgcctgggacccagtgaggatctgtggagatgggctacagggagtgttggggtgagagctgcacggggctgttctcagcagatcccagcaagtgacacacccaaggctggggacccaggacaaggccaagggcacctaagcaccaagcaagagtgagattagaccctcccagaagtgatgcacccaaggctggggacccaggacgaggccaagggcacctaagcgctgagcaggagtgagatcagaccctcccggggctcaaaaaaggctcccagcatcggtcacagcccgtgcccctcgcaggcctgcatgacagtcagggcctccatcaccatcaggccagcacaggcacagcccagacatgcaggaggctccagccagtatttgagaacagacgcctgagtgccgggactcggcccacagcccattcgcccagggagactggtggtccccatgtgccacccgagctgtcaggcactcagtatgtttttaaagcctcactttttaattatatcatctaatacatggaaaattgtgtatcactactgtaaatgaaaagcagaatcattgctgtgagaaggccaccctaaaggtgagttccatgaaaacaaaacacccaaattttgttcatttaaacgtgatcaaagactgcatggcgacacgttctctggaaagaggggctgctcatggccccgagtctctcgctctccaggatgagttgggagtggaatcgccatggccacggagtcccttgcagcctctgagcttctgcctgtgggaagagctggcaggttgggggaccggccacacggtctgtactgagtgggtctctcagcaccacctcattctaacaggagggctcctgaaatcagcgccttatggtgctaaggttttaataacacattagaatacacagaactaaataaaaataaaacaaaacaaaataaaacacaaaagctgtagaggattttctgctctggaaaacaccagtgcacacaagcctttatctgggggtcccctggaggggttggggtggcccaacagagagcagggagcagaggcagatgtggggggtcacactccaccaggagcccccaggcaccgtggccacaggacagccgagcttgtggactgtcctccagagtccagctggaatcactgcccacgcctaaatctaagaagaagtatgcgatgggaagaccttttggctccttctgctcaggaagcatagacagtatcttcagttttgcccacgcaggccccttgaaggggacacacagacgccaggagacagacgcgtggcggccgggtcactcccagtggggagctgtggtttgggcgcctgagcctggagcccccgtcttactgggaggtgttcccttatgacggagcccacggggtctgcccaggtcacagtcccctcccacaggccacgcttcaggaggatcatcgcaggtgggtggcctctattgaggtgtgagctgcaactttccattttctgatcacgagctctaactcattttcccacaacatattatgggcggctcataagattttctatcaaaacgtaaatagattcggatttctctgaagagcaggtttcctatatcggtgcgtacctgtccgtgttcacattaagaccaaggacaaaagaggaaaatagattttttcctaggttgtatgactttatgaaattaaaaaaaaaaaccacctaagcagccctgagcctccgcaaaaaaagaccccacggggacatcccgtacctggtcagagccaggacataccccatgtgcttttttttcctcccctttcagaaatgtaatttccatgacgcgtccacccagggccaggaaccacagaagagaaagagcagtgggaagcttccagaaactcccatgagggctcaggaaacatggggaggtggcgatcggaatcatctgccaggcctggagagccagaggtcggccagccgggaggtgtcctgtccctgagtccccgccctggctccactttcatgcaagagaggggcagggtgggccacagagctaggtcctggagagccacccccaacccagcacgggtccaggacagcaggaagaacccatcctaggtcggaagttcaaatctctgatttgagatgagtgttgaccctacgggggttgaaggcctctctggagagcgtcgattgagcagacaggcccagagctggacgatctctccctaaaatgccaatggcctcggaagacaaaacccaaggggggtcagtggccccccatgcactgagctcactgggtctccctgcgcccgtgtctggagtcatacacaatgctgttattttactgcctaatttcaaaatgcacggctgcagtttacaccctgagctgtggcttgaataatttatcgcaaagtccctgtgtcagtgaccagtgtgttgggtgttgctttgaaacccacagagaagacctaatgtatcacgttgttttcctcctctttaaatattattgacacagcgatacttcactacaggccattaatactggtctgcttctagaggagaaaataccgatgcaggtcagggcaggtgactcgctctgagccacttaacactgggtggcaatggtaacccgccactgcttcctttttaatttaatccacgaagcagcacagcaaagtttcctcatatttctcctcttaaagctgacagaaaataaccagcagaaaacaaacaacacatcttagggaagggaatttagacaaggacagagaccagggagcgagaggaagatgcctgtgtttcccacagtcattgggatgaatctgaggcagcgttagagcgagcgccttccactttggcccacagctccttgttcctaaaatcagcaccgcatccccagcttacagctccttgttcctaaaatcagcaccgcgtccccagcttacaactccttgttcctaaatcaatgccgcgtccccagcttacaactcctggttcctaaaatcaacgccgtgtccccagcttacagctccttgttcctaaaatcaacgccgcgtccccagcttacagctccttgttcctaaaatcaacgccgtgtccccagcttacaactccttgttcctaaatcaacgctgcgtccccagcttacaactccttgttcctaaatcaacgccgtgtccccagcttacagctccttgttcctaaaatcaacgccgcgtccccagcttacagctccttgttcctaaaatcaacgccgtgtccccagcttacaactccttgttcctaaatcaacgctgcgtccccagcttacaactccttgttcctaaatcaacgccgtgtccccagcttacaactcctggttcctaaaatcaacgccgtgtccccagcttacagctccttgttcctaaaattcaacgccgtgtccccagcttacagctcctttgttcctaaaatcaatgccacgtccccagcttacaactccttgttcctaaatcaacgctgcgtccccagcttacaactccttgttcctaaatcaacgccacgtccccagcttacaactccttgttctaaaatcaacgctgtgtccacagcttacaactccttgttcctaaatcaacgctgcatccccagcttacaactccttgttcctaaaatcaacgccgcatccccagcttatagctccttgttcctaaatcaatgccacgtccccagcttacagctccttgttcctaaatcaacactgtgtccccagcttacaaacgctgtgtcacactctacggtttctatctggttttattttcatccaactctctccaggcctgcctgtcactcagggagagatctcaccagtccagccacatctgggagataaaaatgcccaattcaatgagcatttgttaaacacaccccaaggtttgttgccatgaattgtaaattcctggaaggcagcaaacctgcagtcttagagtaggatggggcctttcagcccctgaacgtgcatctgggtgtggaccaagggcttgccagccccgcaaagggcatgggcagcctgctttgcctcagcgtccacatgagcaggcggcgtagcacctcctgtcagaggggaggatccacgtgtgcatgtggaggtgcagaaggaggggtcatccatggaaatctgacttctacggcaaactcaagtttaagcaaaagtagactacccttcggaaatgcacactggaacgatagcaaaacatgaaatcgacgtaagtgtccatcagtggatgaatggataaagaaaacgtggtgtgtccacacaatggaatactactcagctatgaaaaaggatgaagttctgtctgttgcgcacaatggaatactattcagccataaaaaaggatgaagtcctgtctgttgcacacaatggaatactattcagccataaaaaaggatgaagtcctgtcttttgcacacaatggaatactattcagccataaaaaaggatgaaatcctgtcttttgcagcaacatggatggaactggagccattatcttgagtgaaacaatgcagaatcagaaagtcaaatactgcacattcacacatttaagtgggagccaaattacatgcgtgcatggatgtagcacatgggacaatggacgctgcagacccgggacgctgggaagggagaggagggtgagaattcgccgctcgggcccatctatgttattcagtgatggctacactcaaagcccagacttcaccactacacaacagatccacgtagtaagaccgcacttggaccccaaacattcatacagtaacaaatattactaagagaacctactggtcagatagatctttgctttcctgccagtcagtgccaggggagctttggtctctcacacggcttagagcccttccttccaaggcgggcagctcctgcgtgcacatgggggctcccaccaccccgagggccggtcccccatgcctgttggagggtggtgtgggtttgctctggctggtgtggacaagcccttaactgagaacagggtcaggggaccttctagctttcttctctagctttcttcgtctctagcttttctttttttaaggcatttattgctcctgaaaataatctgtgcttgcaaagaaaaaaagtcattttgtttcaaatccagtgataaagaatggatcttttcttctcctagcaaaccattttcccttgccccaggggaccatgtatgacctgagccatcttcccccacgccaggccctcaggagacccaacctccctgacacatcctaggcccggggcgggtgtggggaggcacgagcttctctggaaaccagcagctgtcgcctgcttgcccatctgtcaccaagctctaagtcctgctgtctgctcaacaggcatgaggagcagtcccacagtgcaatgaggccggcacgggggcccagggagggctcggccccaggtcccctgacgtggggtgtctgccctccccaggaggacggggttgggggcacatctgatggggcctgggtcatgcctgccagttctgcacagagctgcctcctgagtgcccacgtgccctgcggggctgcctggcggctccatttgctctgtgtctgtggagcaactgcgcccctgggcccgcctggcctgggctcccactgaggtcacagcacctgggtcattcagctccaaggatggggcaggccccacagggcaggaccccctccagcagttcctgcctgtcctgggaaggccacggagacagacccttgacttcaggacagggggctgctctttccataaatccccctggctggcgcctggagcccaggttcctcccacacagccagtcattcctgccatccacactggccctgcaagggctggaagggccacaggtgggcctcactcaagagggaaggaccagggaggagaagggagccacattagcctggctgggtgggcaaagccacgtcagcagccagaatgtccctgcagataaacgtggggggaggcatgacagaaagccgggtttctacagaaagaggaggccagggaggggcagagcctggggggaggagtgcagggaggggcaggcagagaccagtgggtcatagggaccctgtggagcccccagaccagcccctgcacagaggagaggaatgtggggccggaggaatggagtgcaggggagatgagtgcacgggagaggagtgcaggggagtggagtgcagggctgggggagagtagtgcaggggagagtagtgcagggcagggggagaggagtgtggggctgggggagaggagtgcaggggagaggagtgcagggaggtggggagaggagtgtggggctgggggagaggagtgcaggggagaggagtgcagaggagaggagtgcagggtggggggagaggagtgcagggtggggggagaggagtgcagggtggggggagaggagtgcaggggagaggagtacagggcgagggggagaggagtgtggggctgggggagaggaatgcagggcccgggaaaaggactgcagggccaagggagaggcccagggcccgggctgcagcctggcttcagcttttacccggcagcctcagagctctacttttaattaagtgccttaccaaataattaatttgtactcctctgtggaataggaaaagagccatgaaataattaaagaattaaaacactagctcagagccaggagcagcagtcagggctggcccggaggctcctgggctctgaccacgccatccatccgctgaggacagcagaccacctgcgtgagacgcggaggagcagcagctctgccgtgagaggagcccgtgtccagcctccaacgtagatgctgtgttggacagagtctaaatgtagaccgaataagctacctcacatttcaagctcagtaaatgtaatgtttaatcacacctgtaatcccagcactttaggaggccgaggcaagtggatcacctgaagtcaggagatcgagaccatcctggccaacatggtgaaaccccatctctactaaaaatacaaaaattagctgggtgtgttggcaggcacctgcaatcccagctactcgggatgctgtggcaggcaaatacttgaatctgggaggtggagcttgcagtgagcagagattgcaccactgcactctagcctgggtgacagatactccatctcaaaaaaaaaaaaaaaaaaaactctacttcaagttgtaattctgagattttgaagcacgtttggctggactccatccttcatgccccacgtaagagggttgtgttctgggtagagaagtcatctttgtgcggggtgcgaggcatccgggggccaggggactgtgagctgcagcaacagtgacccctacagtgctgacagtgtggggcggtcccgggtccgatcctggctgttcctccgagcggccgtaggggtccgccctggcccctacactatgcccaccaagaggacctcctgtaaacgtgagcctcatgccagagaacccacagccagcccctcacacccctgcactgaccggcttttatttccagcctaaaagaagagaaggcagatttagttgcctgaacacaaaccctccttctccctcgctcaagccatcagggggttctagtcggcttgtccactctcatctcctttaaataaacagcaaaaccgttttcacaactcagctcccaatgtgaaattagtttcatggtgactgagcaccgtgtgctgcccgaatttctcaccaacctcagacgctctcgttttcacgtgccacggagctacacaaagataaagcagcccaataaagacccggctgaaggcttttgtgttctctcactcttgcccacttaccctgcgttttccaccaacacaggcaggggaaagcttggcctgggaacctgagttctgggacctgctccctggctggacttgctggcacccaccggagatgaggcctccaggaaacctgtcatcgggagactcgtccacacgacgagaccagggggaagaggtgctgtctgcagctgttctccgcgagtccctggcccacctgataacgagttccgtaactggaaacatcaaggtgggggtgtgggtctgagacttcactgcactttattaaatctcagccactcaaaggtggggtgcagactggggttcgcagctccgacataccacacttgatctcagatgtttacctgatgaactttggcctctggtttttatttttactttttttttttatttttcattattattttttgagtcagagtctcactgtgtcacccaggctggagtgcaatggcaggatctcagctcactgcaacctccacctcccaggttcaagtgattctgatgcctcagcctcgcgagaagctgggattacaggtgagtgccaccatgcccggctaatttctgtatttttagtagggatggggcttcaccatgttggccaggctggtcttgaactcctgacctcaaatgatccacccgccttggcctcccgaagtgctgggattacaggcatgagtcaccttgcccaacctagtttttatttttttaattaactgcttgcctcactaataaaacttctcttttgccaaaggatgcttctcaggttgcattccccagtcaggggaataaccagaggattaaaacaaaaggttaaagtgatcacttcaaaaacaattgccaaggcccgtaagagaagggtttaaaagccccagggccatgcttggtttcaggccagagggttctcagctggaatcacccaacacgtgaaagccgtggagaggccgggatgaaagcacctggtcaccactaacgccctgcacacctttccttcttcctcctcctctttatttcttaacaggaagctgcctgacatttcggctttgaggtctactgggaagcatgactgaagttggggtgcagggtgggggctggtgtccggccgcaggtggggagcagggtggggctggggtcgggccgcaggtggggagcagggtgggggctggtgtccggccgcaggtggggtgcagggtgggggctggggtttggccgcaggtggggtgcagggtgggggctggggtttggccgcaggtggggagcagggtggggctggtgtctggccgcaggtggggtgcagggtgggggctggggtttggccgcaggtggggtgcagggtgggggctggggtttggccgcaggtggggagcagggtggggctggtgtctggccgcaagtggggtgcagggtgggggctggggtttggccgcaggtggggtgcagggtgggggctggggtttggccgcaggtggggagcagggtggggctggtgtctggccacaggtggggtgcagggtggggggtggggtttggccgcaggtggggtgcatggtgggggctggggtttgaccgcaggtggggagcagggtggggctggtgtctggccgcaggtggggtgcagggtgggggctggggtttggccgcaggtggggtgcaaggtggggctggggtttggccgcaggtctggtgcaacgtggggctggggtcgggccgcaggcggggtgaagggtgggggctgggatctggccgtaggtggggtacagggtggggctgaggttcggccacaggtagagagcagagggccttctcccacaggcctgctcttggctgtgcatgtcacagaggggaccacactccacactcacagcaacccagaggtagagttcacgtgcaaagaatgggaagctggagccttaaataatttgcctaagttcaggcagcagcaaaagccagagccagaatctggaagcaggtacagctgattccaaacctacctcctatacccatgacccctcaggaccacagggcctgagtccacggctggggacgtgcacagcagggggacctgaggaccgggagggcggcacttcagcctcacgggcgctcccaccatgcagacagacgcaggcagtgtagtagatggtaaaacggccgaaaaccatcagcagcctcaggaccgccctgtcatgatgccaactcccaatccgtgctgagagcccggcactgcctcagggagattagcaaacacttttcatctgtttatacacaaacagcaggcatgggcccgctggccttccaggaacatgagtctgcgtgactggctgttgtgccctcacccggaaccgtgccaggcaccgaggaggtgctcagtaaactatggggttgcatcgtatttgaggtcatccggaggcacccgctgctgcactgggactcctggagatcctcctccagccggaagctggccaagctgtctccaggtcctgggatcacgttgtttcagtggagacgatggccgccagcttcagattcagaaatggcacttagtgcctcttcccttggagtcacctcgggtgacatggggtggcccccatggccagcactgaccagctctgccccccaccgaggcgggagccacatctcaccaccaaatgcccttttatgggaactgaggtgcaaagcgggggcttgaggcaagcagcccccgcgggaaacacggcgtggtcatcaggcgagtgctgccttagagacccgccccctgcagaggctgtgctctggatggtcactcactcacccctttattaagagttggttctacggaggatgagagaggcagggacgtgttttgggagaaggtcatatgaaaaattagtgccacagagtttcggcccctaaaaagcttccagtttcacggtgaggggaaatgttgtaaactaaaacctctggtggggagagtcacttttgttgcccgaatccccagtacagtggacggcgcctcgtgagccggatggcaacctggccagcatgcagtgaaggaacaacggggccaaatgccgcaggtgtggatgagggagaaaacaaaagctcccactgcgcccctccctccctggagcttagggttcatctgaggggtgaagaggaggatgtgaaggacaccacgggggtcagggagcctgggaaatgtccaggaatcctggggccggggcctgctccctggaagcagatctgaggacgtttcgggcaggtcagctgcagcgagagaaatggacttgccggggaggaactcccggctgcctcaaagctcagcaggtccacggagcaggagccacacaaggctcttcaacaagccccgtgaggtggggagctggcctggaccaccctggcgtggacacggctgggctggatctcatctgtggaactcctggcaggagatggagtgccctggtcctggccggggtttggcagcacaagtgggggtctgctacaggccgcttggatccaggggaggaggaaagagcacaggagagggcaggagatgtttggcttctgtcatgagctgacctgtgtcccccaaaatccacaggggaagccctgaaccctcatgtgactgtacttggggacagggcctctaaagaggtaaaggtaaggccgggcgcggtggctcacgcctgtaatcccagcactttgggaggccgagacgggcggatcacgaggtcaggagatcgagaccatcttggctaacacggtgaaaccccgtttctactaaaaatacaaaaaattagccgggcgtgttggcgggcgcctgtagtcccagctacttgggaggctgaggcaggagaatggcatgaacctgggaggcggagcttgcagtgagccgagatcgcgccactgcactccaacctgggagacacagcgagactccgtctcaaaaaaaaaaaaaaaaaaaaatgaggtcctgagggggccccaatccaataggacctgtgttcttcaggaagaggaagagacacacagcctgcatctacacagaaggacagcccctgaggacgtggccacgacgcagccaccgtgagccagggaatgcggccccaggaacaagccctgcccacaggcgtcccagacccaggccttggggactgcagaggatggatgtctgccccacctgtggggcttcaccgtggccacccgagctgactgacaggggtggggaagcacgccatccgggctccagccctgcggttggcgggatccaggtttcttggtggtggcgagcttctcacatgggcttggcggcacctcccaacacgccaaggccagtggtaaaacgggcctctgctttttttaaagaatagcttgtctaatgactctgagagcatctattaatttcatcactgttgccgacttaatcagcaaacttcatttacaattccacaagctacgaaaaatcatttgctactgtcatagcagtataggaaacgtgtcagcaccttgggagcctggccagtgtttcatttcactgagttccagaagactccggctctcggatgggagcagcccccatggctgcttttcggctcctcgtttggaaaacttggtgactctctaaggtgataggaaaagcaaaaattgctctgttaatgcttccagtgcccaatttgggagtaaagaatgggttttatcaccaaaaagaagacttcacatgatgtttctgcctgagagaagtaggcagggtctaggggccatcctagcctcctcccatcccagaggatgagagagggaaccgcccacttcctgtgtggccccaggactcagagctaccctcaatggcacccgaattttattcctaacccctcccagatgcttcctgtgtgtccacagctgggtggtggttctagttttaggttttttatatttaaaaaaccagcagattaaaaaattaaccagcatctatttttaaagaactgcatgcattcctttgctataaataacaccttagtggactctaaaaaaagtaattcaaaacaatcctttttcactgggtttgctgcttgtttacattatatttctctgagataacagaaagaggcacatcttatcactttcctgacagtttcattttcaggatctgataatgctatgtgtgcttatatggaaaatattgatcccactatactctgctcttcctaaatttttcattttttaaaaaattcatgacagtatttgattcccagaggttttacaaaccatctccttcaagcaaatgcatgtaaatttcacttctgtgactctgagttcatttttaaagaatggttttagaaaatcttcttctactttgccaaatttcatctttaaaatgcttgtttctgttcctctcatgataatggtaatgtttatgatggctgattttaaaacctcttagggtatgaagtgtgttgtagaaatgctaaatgctaatagatacataaacagtaagatggaagcgggagaaacacacacctccccctttcctcacaagcctcagcatttccggcttgagaaaatcggcctggcacccatgaagtacctgcggtctgagctgtgtggccactatttttttttttttttcgagacggagtcttgctcttgttgcccaggctggagtgcaatggtgtgatctcggctcaccacaacctccacctcctggattcaagcaattctcctgcctcagtctgccgagtagctgggattacaggcgtgagccaccacacttggcgaattttgtatttttagtagagatggggtttctccatgttggtcaggctggtctcgaactcccgacctcatgtgatccgctcaactcagcctcccaaagtgctgggattacaggcgtgagccaccgcacccagtcgtggtcactcttaaggtgggtgcagcttatggtggcgaatatggaaaggttactattggctttcgctgatttctttaaaaaaaaatgcaaagagaaaggtcactaagcaaaagacctaagctggtttggaattcactaatctaacactggctagagtttaaaaagtaggggctagtaaagcccacttgatatgcacaaaataagattagctgcagcgttttgctgtccacgttgtcttagagagctggaagatggggtgcagggggaggtgcagggcaggaagcatctgcggtgaggcctctggtcagtcactgcacagctggagaaggctcaggtggtgctcgtggcccacgaggggttctccccagaagagacaggaagggcccaccgtggtttcccacagcaatgtcctcatgcacgctgaggcacacatcttacgtggatgctgttagtattcagtacactgcgtctaaaatgcacgtgtgtgcaaatgcgtgtctctagtgcactcagagtgggaagtctgcacggctccttttaactctatgggatcatgaaggaaagtaaaaccttagaggctgaggggtttctgcctgcatctgaatttctttggaatgctcatgtcaaatctgatggaaaggtggtactagcagcagccactgcccaaataaacatgttcaaagctccttttcaccaaggcttctgctgtgaacctctcccttcttggggcacctgctgccccttcctcctgcctctcctggggcagcacaggcacctgcaaccaacttacggagttttgcagatgtgacaccctaagaaagcagccaacactgtgttcctcgtggaattactgagttcacatcccttttcctttttagagagacagatcctataggcagcatgaatggaaatgcaaagactccatcgatttttaccaacttttccaaggaaagtccaaatcatgtttgctcctccatggtggtacagttcagtgccagcctggtctggccctggagccttcttttggcatccagaacatctccctgacaacccagaaacacagctgacctcctgccatcctgagcctcacaagcttgctggacacctgcggtgagtcccagcaagggtgagtcccagcgccaggcaaagatctggcgagggaagagccgcccgggatgcagacacacttatcactcacttgccatttccacaacctcatttctttgcagctgtggacggcaatggcttccttaagggccatcccacccctatggagatagatgccagggcttgggagccacctggtgtggctgtgcacgctgagtgtccttgtcactcagaggaaggtaggcccagggtcccttaggccaagagacttgtttgggtctgactggggccaccctggctgtacccacatttccaaaagtaaacctgtaacgcatcatgtctcaaagacaggaaaccccatggacaccccagctccatcatgcggtcatgacattttggaccaggagggcctcctgtgtggtcctctggcgggaagcctgctagtctccctagggctgccctaacaagcctcacagcctgagcggctcaaacaacagaaatgtactccgtcacagttctgggggctgaagtctgaggtccgggcttcggtttctcctgagactgcgcaggctggcgggcggccgtctcctcctgtgtcctcacgtggcttcttctccagtgtctcttctttcaaggacaccagtcctgctggagccaggcccaccccacgacctcacataacctcaatcgcctcctgaaagacactttctccaaatacagtcgccttatgcggccccgggtgttggcgcttcccaggtgaacttggggaacacacgtcagcccatcccaggtggagctgcggcagtgcggggtgtggctggtgctgggggtgggcaggaagggtaagcaggggacgagggatcagaggcaggaggtgtcctggccctaacatttcctttgcttctcgtaaacctcacctgagcccacccaacaccaaggccacatcaaggagagaggacaaggggagagtgatcacagggtgtgacagtgatggaggggacccagacgcagggactacggagggcagtggggcctcacagggcacctcccacagggagcagagagcggacgatggccggtggtgatgagatgtggccctgctgtggaggaagcgccaggtgcatctgatgaaggcatgaagacacagaaggggacaggaaggggctagaaagaaaagtatcacagtcagcctggtccctatgctgtgtgcacgtgcatgtgtgtgtatgtatctgggtgtgtgcattgcatgtgtgtgagggtgtgtgtggctgtgctatgtgtgagggtgtgctgtgtgtggctgtgtgtgggtgggtgtgctgtatgtgtgtgggtatatacatgtgggggtgtgtgggtgtgtgtgtgctgcatgtgtgtggatgcatgcatgtgcacgtgtgtgtatgtatctggttgtgtgcattgcacgtgtgtgagggtgtgtgtggctgtgctgtgtgtgggggtgtgggtgtgtaggtgggtgtgctttgtgtatatgtggggtatgtacttgtgcacgtgtgagtgtgtgtgctgtgtgtgggggtgtgggtgtgtgtggaggtgtgctgtgtgtgggtgtgctgtgtgtgggtgtgggtgtgctgtgtgtgggggtgtgctgtgtgtgtgggtgtgtacatgtacacatgtgtgagtgtgtgtgggtgtgctgtgtgtggggtgtgcattgcacgtgtatgtgtgtgggcatgtgcatacacactgcctgatgggttctgaggaatgaacggatccatgaatcaatgattacacccaccaaaatttctactgattgcatgatgggaaaatatggaataattgcccattcttattttcattttcaggagaaagaaaacaggagtgagacaccaaaacgcagggctttgtttacagagaaggccgcgggggctccccgccaggtctgtgcatttcaactcagttctgtccttcctcataaacagatgaacctgtcccgcgcgcgtggtggcggcttacacggcggaaacaccctcaggtgctttctcactatcaaagagcagcttagcatttatttcatatttttgtcttccactgattcttatttattttacaaattgcacctgaacaataaaggaagtcattccaaaagcagcagcctgccccccaccagcaggcagcagtgacgtgtctccatggggccttaaaccttcagggccacgttgtgatttatcttcacacagcgcttggcgcatgcgggcctctaacgaatgtttagaatttcagtgactctagtatcaccgttttctttctatcttctcttccacgcacgtgtctgtctttctcatggtctagtcattgtaagtttgttttttaaaaagttttactaagtacatatgctactaaatgtggtgagtaaatgtttactgttcaattttatcacgttgatatactcagacttcttctgaaatgagacacaggctttctcctttcacctttgtttccaagatgctcttcctgcctctagctccccgcactccctgcacttccccgaggtcactgcactcacagagcttcctatgtgatcagttccaccaggcatagcaggaattcttctcatttgtccaaacgaacagagccccaggaggccccacctggtgcccgtgaccgaccccctcagtgaacctgcaaaggttcccatgcacaaggcgacgcttcagacatttcaccatctcactctccaggtcggacttgaaaacgctctgatcaatgatcaaatctgcttccacccaattcaaatgcaagcagttctgaggcacgattatacacaatacgtgctatttattaaccgtcaccactcagctaggttctttgccaagaatttcccaaaagaagtcttcattctacatagcaacttgttcttatccatgggaaagatagtgtcttattttaaatgcaaatgaagccgattcagcatgtacaagcagaacccgcaaatgagagaaatgttggtatatgtgatttgtaaataacagcatattaaaaatataatagataaaatgtttccaatgataaggccaggattcttaataattggataatcttaatcaaaaatcttagatgagtaaaattttcccacttaatataaaaaccacgacatcaagctgagtataaggacacatttaaattctggccaaaaagcaaagcttatcctgggagttccaaacctccttcctgcctgggcacagctctttctgggtatatagcacatgataaagagatcaatctttgagctttgttggaaacagcacacgaggtaacaccaaccaagcatttaaatttctgatttggatctatgagcattgctaatgacacactcactgcacacttgaaactcttggatttccacactcatcatcactgatctacgccacgccattcccagaattccccatgccatcctgccccaccatgggcaccagccaaacccactgagtaggcactgtctcccgcccatccttcaagaccaggctggcctttgcctgccccagaccctccaccctcacttccagccatgcccctgcaggaccccgtagagcacttcatcttgtccctgtccttgtggaggaggcaggggcctgtgtgaactgccctgcttactccggcatccccagcagccctcagcaagctcagcacaaggtaaagcctcaacacgggaggacggagttcattttcctccactaccacgagatcctggggggccaggatcctccaggtccgtcctttccttcctctgctcacccatccaccagctcagcacctacttcaggcctcagacgttgtaggtgctacagagacatctagagagtgaacccacagacacacaaataacctgtgtttaaaagtgtgttaacagcattgggtggttcccagtggggtacacactacatcatttctacacttgaaaaagtaagaattccaagatggatggatttactcaaaacctcagaaacaccactgaccagctacttctacaaacatcagttctgttttgtcctgcccactgtgcatttaggctaacaggcaatgaagaaatcttgaaactatgagaaactatggaaaaaaattcaagttttaaggaagatacagtagcaccccatttatatagcaccagtaaaagttattccaaataaatatattttcagggtaacttaaacttacccacataacaccagtatgagaagtttatatactttaaaaagtctattttttaaaaaagtattgtttatttctctgctgccttacacacagtaaaca

SEQ ID NO: 69 - DNA, 24488 bp, Homo sapiens
  source 1..24488: mol_type = genomic DNA
gtcaaagagaaacaaaagaaggatacctactttccaaacacatcatccatcaacatgcatgcagctgtttactggaatttgctttttcgttacttaagctaatgaggtcatttggaagatatttatgaaaataaaacataagaggatgaacctgccccatccatttggttaacaggaaaacatctcgcagatgtaacagccatggctgacttccagaactgtcaccatccgcctgcctcaaagtcactggcacgtgtgtggtttgctgctcctggacccgctctctcaggggcatcatcatgaggcctctgcagagccagaggaaagaaaatcatctgaagaagaggattccgtgaccactcttattttatctccacagtactgtttcttgcctaatttgtgccgaacatttacgatgacaaagacgatgatccgaaaacagcaggcagaacaaggttgcactatggcgaggagaactgggatgcggagagaaaggggcagccccgggcacacaaagcggccgcgtgcaccagctggtgtttccctctcagtgagtgtattttttttttttttttgaggcagtgtttccctcttgttgcccaggctggagtgcaatggcatgttctctgctcaccgcaacctctgcctcctgggttcaagtgattctcctgcctcagtctcccgagtagctgggattacaggcacgtgccaccatgcctggctaatttttttattttcagtagagatggggtttctccatgttggtcaggctagtctcaaactcccaacctcaggtgatcagcccgcctcagcctcccaaagtgctgggattacaagcgtgagccaccatgcccagccgtgcgaatgtaatttttaaaatccagcatctcaacatcaggaagaactttacagaccagtttcccttctcactcaatttggctgcatcacccactgctcccaatgggaggcgagtcccaggggctttttccacctcattccatgctcgcctttctacatcatctgttacatgctcaaggcttccccatcggcctctgcaatccctcttcccagttccttcctgtttccctactctccatcctcctctcctgattcctttccttggcttgttttcacccacgtgccactgaaataccagcgtctaccaaattttcactatcgacacctcccacgcttcatcctctgtctggtcgtctctccacagccatggctgtagtcaggaatgattcctaaatacgtttccacactttttccaagagttccaccttcatagtccagtctttctggacgttgtaacctctatcacacaaacatttcatacttgatactctaaggctgagccccttttcactgtccccctccccacctaccatgatatccacagacacgctggtgattgcacctcacagaagcctctctgggcttctccccacgccccggccgcctggccatctcttgcctcaaaggcctcctaaggagtctccatagcattaagtaatttaccttccaattcattctcctctctcctacaattaaaagtgaatcattccagccagcgcagtggctcacacacctgtaatcccagggctttggaaggctgaggtggaaggatcacttgagcccaggagttagagaccagcctgggcaacaaagtgagaccctgtttctaaaaaacacataatttaaattttaaaaaataaatgaaaatcctccaataacatgcagcctcttctgtatgaagccaaaacttccttacaaggcacaaaggtgctttccccttgttccttcccatgccctcaactccccagccccctcccagcctgccttgcacccagccctaggcagccacattcttggtgctttctgcctattgttcttggtgctgttcttggtgcttctgcctatagttcttggtgctgttcttggtgctcctgcctattgttcttcgtgctgttcttggtgctcctgcctattgttcctggtgctgttcttggtgctcctgcctattgttcttggtgctgttcttggtgctcctgcctattgttcctggtgctgttcttggtgcttctgccttttgttcctggtgctgttcttggtgcttctgccttttgttcctggtactgttcttggtgctcctgcctattgctcttggtgcttttcttggtgctcttgcctattgttcttggtgccgttcttggtgcttctgcctattgttcttggtgctgttcttggtgcttctgcctattgttcctggtgctgttcttggtgtttctgctattcctgtaacctgcaaggcttttctccacactacaccatggaaagtcctctctagtaaaccgtagcccagcagaaccactcgtgagtcctgtgattccttccaaaccactagacctggggcaccttgggccccagcatggtgcctcactgattttggactgggcacaacacgattcatccaaacaccacttgacaaaggccagcaggacagaacagtacaacgctggttccacagtgtggtcctcactgaagacagggcgggtggcattgacccccattcctgtcccacagttgagggctgccccacaggcttcctcctcacttcgggggtgcaagcctgcaagaccaaacagcccacagccttggaggaggcagagtgcgggcagcgccccctcacagaaccgcagcaacgacacctatcaccgcccaccacaggcgcactgtgggctgatggggtgggccacatatggggaattccagaacgtgaccctgtacctaaatccctgcagttcccaagtctccctcagtccttcccagacatctcttaaggggcctgactctgcctcagccccaccgccccccagcctgagccccgttccacctcctcactggcctcgctgcccctctgcaatctcctccaacagccgccaggatcatctttacaaaatgcaaaggtcatattgctcctgagctgcaatgccctcaggcagtcccctgcctttagggtggagtccaagccagcctcatggacagcgtctccagactcttccccaccatagccaggcaggcctccaggcgcttccagactcatccccaccatagccaggcaggcctccagatgcctccagactcatccccaccacagccaggcaggcctccccaggcacctccatccccttcgtcacacatcccacacaccccggtttgttcccaccaggccttcactaacatgccactgcagaaaaaccttccctcccccccagtctgactagagtccactcatttttcaggtaccaagttgcaccttgcttcctccaagagggctccctaattcctgaccgggcggggcacccctgcaacattctcccagctccctggactctccctggcccagctctcgccaactgcattgtgattacttaagaacttgctcctcccttaaaagaaaatagactccaggagggcaagagtgggtttatctcagttactgccatggtgtctataaaatagttagagcccaatagttcttactgaatcaatctatcaattaattaatagagacgatacggatttcatggggtgggaggatatgaacattaatagagacgatatggatttcacagggtgggagaaggatatgaacattaatagagacgatacggatttcacggggtgggagaaggatatgaacattaatagagatgatacggatttcacggggtgggagaaggatatgaacacacagggacatcagcgcttgtcctttctggacttagcaaaggccatactcagtagctcaggtgccaagtaagccagaagtgaagaaaatgcacagccaagccgggccagaacgtccacagaggctaaaggatacggctcaagctccacctttaaaagagggtaggactgagatcaacagaggatataaacagattaccaggacggcatgaccatagaggaaggacccacttgaggaggccacagcaggacaagagggaaggacgaaccttccccaaggctaagggtcaaacattcgagctgattaaaaatgttacttgaggccaggcgcggtggttcatgcctgtaatcccagcactttgggaggctgaaacaggtgaattgcttgagctcaggagttcaagaccagcctgggcaacatggcgaaaccccgtctctataaaaagtacaaaaattagctgggcatgttgctgggtgcctgtaatcccaggtactcgggaggctgaggcaggagaatcacttgaatctgggaggtggaggttgcagtgagctgagattacgccactgcactccagcctgggtgacaaagcaaaacaactctgtctctaaacaaacaaacaaaaaaacaatacttgggctccaggatgcccatcatcctgcagcagtttgcactgagctccctttatgccaacaggctcaggatccccaaagcactgcagcagagaacagccgtgcagcatctcaggccacacagtacacaggcgtcgtcactgtttccaagaacttccttggctgaaaagtcatttcaaactttggggctattttggcatctaagtgggaagagggagaaaacattaaaagaagtcccttagtgctgacactgtcctgccagccagcacatctcctcattttatgaagtcggactcatcccagctatctgtgtgagacactcagttggccatgacagttaaattactttttcataccgagaacagaattagtctataaataagtaaagaggtgctagggctgagtcagaagtgccgattccacctcaagctccttccctgcccgatctgcaggtggctctcagggcatgggggaccaagctgtgtttgagcctttgctttgcatgggtggctctgaaggtgatggaatgggctggcattctccagcactctctggcattttctgacattctccagcactctcctgcactctccatgttgatctgggtgactctggaccttcattctaaagatactcaagaatctagtggccatacaacatccccaagggagaaaggggccctttttctccaatgctgctgatgctgtttcccatcatataaggactttctcccatcccaagcagccaagggaaagaagtgactcacctcagaaagaagaaaaagggaagaagggttacccaatgcctcccccatggcatggaaattctccattttccccacaacgccagcacggtcacactctgcaagcaacacccatctgttctccttacattttccaactttactatcattagcctgaaaccaagctttcctgttcagtgcaatgactactctgccaaacacacaagttctgaacaggacatgtgccatgggaaacatttcgatttaatgagcttttccagtgcaacacagaatgattttttaaatcccagggatgtcccccactcaaacttgtcatttcttttaacaaaacaacggcaatgccaagaaaggaaagcattttctggccacagagtgggcccttcagctccccttccaagagggagccctgacacggaggcagaaggacttccatcccctaagaaaaacagagtttgggatcttgaacaaggtgcattggcagcctgggtctcacaccgtcccttctagagcaggaaggtgtggaaaggagagtaaaattccactattgtgaaattcccccttcagcaatgaaacggactctgagaacttatttttcctgaaaattattatttatgtccatctagatggtgtttctatgtttactgccactacaatttaaaacagttcatgcccttcggtagacagtttctagacgagtctttcctggatgtttgaagcaggttctccaccttcagctcagctcgaggcccctggagaaacactccccagagcaggatctccagagaaggctcccttccgtcaggagcaacagtggctccaaccccgacttccaagctctgggcggccttccactgttttgtgggtggtgataattccatttaaagtagcacttacatggttttttagaaaagactataactcctggatttttttcaaccatattaccaatagaaacaaacatacgaagaacgatcgggtggctgcttatcagaaaatcctaatccctgcctcagccatgcccagccaggtcacagtgagcacgtcctggtttccatgtctgagcaccagatcggtaaccccagcctcttcactctcatgagggtgcagcaaagattcagcaggaggatacacatggatacgctgggcaaaccacaggcaccctgcaggccatgagggcctggccgagatctcagccagccaaggaacaggagatttcagccacgtccctcttatctctcccacagcaggattccaagtgctgcagccaggaccttattccatgacttccctctgtgcgaggcgctcagtcctgcagacgcagtgacttcctgccccagctggaatgctgtctgcgtagtcatactataattttatttgtattatttttattgttgtattgttattttatatttttttccccagtactttcaatcctctgttggtcgactcaggcagaacctgagggtatgcagggctggctgtattcttgcccaaagggacctgagaaaacatctagaccaacgcacaggactgtgtgattcacccgaaaccacacagttagttgctgagttagagacagtactaggtgtctggcttcccaacagggtgaattatttctggaaattgttttttctccctgcatctaaatttaacaatgaggaaatctattagtaatcagcaagatgctgaagcagtaactccaaaatcagttgacgaatgatttctcaggagcagcacgctgggtgctggctcaggaggaaggtccgcatcggaatggtggactgtccaggtactggctcaggggggaggtccacgtcacaatggtggactgtccaggtagtggctcaggagggaggtccacgtcacaatggtggactgtccaggtgctggctcgggagggaggtccacgtcacaatggtggactgtccaggtagtggctcaggagggaggtccacgtcacaatggtggactgtccgggtagtggctcgggagggaggtccacgtcacaatggtggactgtccaggtgctggctcgggagggaggtccacgtcacaatggtggactgtccgggtagtggctcgggagggaggtccacgtcacaatggtggactgtccaggtactggctcaggagggaggtccacgtcacaatggtggactgtccgggtactggctcgggagggaggtccacgtcacaatggtggactgtccgggtgctggctcgggagggaggtccacgtcacaatggtggactgtccgggtagtggctcaggggggaggtccacgtcacaatggtggactgtccaggtgctggctcaggagggaggtccacgtcacaatggtggactgtccaggtgctggctcaggagggaggtccacgtcacaatggtggactgtccgggtactggctcgggagggaggtccacgtcacaatggtggactgtccaggtagtggctcaggagggaggtccacgtcacaatggtggactgtccaggtgctggctcgggagggaggtccacgtcacaatggtggactgtccgggtagtggctcgggagggaggtccacgtcacaatggtggactgtccaggtgctggctcgggagggaggtccacgtcacaatggtggactgtccaggtgctggctcagggggaaggtccacatcggaatggtagactgtttaggagaaaggtccacgtcagaatggtggactgttttaagaggaaggtccacgtcagaatggactgtccaggatggtgcatgtgcagggtgtgttctggcaccactgtgtgtgtacagcgaatcgctctctgtaacctggcccctggtgaccagatgcacttacaacatgcaccttgctgcggctagatgcagtctgtggacacagattaaggtgaagtgagggcatcagcatggtctggagtccgtgaggcactcggaccaccggagccagcccaggggttggcacagtctgcagggctcagcgtctcccctggttctcacgtggacattggctttccttgtcttgagagcagctcaccatcacgagttcttccaacagcccaagtcttcatttccacacacttgcttctgtgtgtggcagatgtggagctggagagaacagacctgccgtgagaagggagagggcagcaaagatcacccagaacttgctgggactgagatgaacaaaagttacccaaaaatgggaatttcaagaatagccaagggcttcaacagaggatgagctgacacttagatttagggattgtcagcatcaccgtggctgctgacatcttgaaaactggaaaatggggtctcagaagaacaagataagagcgcaggaggccagggtgtgactcttggggtccaggaggggacatcacaggaagcacaagttggaggggccagacgggttgcagccaggttggggtctggggagccccagtgtgaccaggggcgggggtggtgggtgagcctcagcagccagagtggtgcagacacgtcccacggtgagggctggtgcggacaagagattagccaaaggagcagccaccatgctgccgacagcgagtctgccctgaagtggagtctgccctggagtggagtcgtctgccctggagcggagtcatctgccctggagcggagtctgccctgaagcggagtctgccctggagcggagtcgtctgccctggagtggagtcctctgccctggagtggagtcgtctgccctggagtggagtcgtctgccctggagcagagtctgccctggaatggagtcctctgccctggagtggagtcgtctgccctggagtggagtcatctgccctggagcagagtctgccctggagtggagtcatctgccctggagcggagtctgccctggagtggagtcgtctgccctggagcggagtcgtctgccctggagtggagtcgtctgccctggagtggagtctgccctggagtggagtcgtctgccctggagtggagtcgtctaccctggagtggagtctgccctggagtggagtcgtctgccctggagtggagtctgccctggagtggagtcgtctaccctggagtggagtcgtctaccctggagtggagtcgtctaccctggagtggagtctgccctggagtggagtcatctgccctggagcggagtctgccctggtgtggagtcgtctgccctggagtggagtcggccctggagtggagtctgccctggagtggagtcgtctaccctggagtggagtcgtctgccctggagtggagtctgccctggagtggagtcgtctgccctggagtggagtcatctaccctggagtggagtcgtctaccctggagtggagtctgccctggagtggagtcatctgccctggagtggagtctgccctggagtggagtcgtctaccctggagtggagtcgtctaccctggagtggagtcgtctaccctggagtggagtctgccctggagtggagtcatctgccctggagcggagtctgccctggtgtggagtcgtctgccctggagtggagtcggccctggagtggagtctgccctggagtggagtcgtctaccctggagtggagtcatctgccctggagtggagtctgccctggagtggagtcgtctgccctggagcggagtctgccctggagtggagtcgtctaccctggagcggagtctgccctggagcggagtctgccctggagcggagtctgccctggagtggagtcgtctgccctggagtggagtctgccctggagtggagtctgccctggagtggagggaagtgaagccagatcgctgaggagtgcgaggaaagctgttggttgttatggtcaagccccagaactcgtagatggatgtccccagcccagtgcctcagaaggtgactgcgtttggaaatcaggtttttgcaggaaaaattggcgttaaccctcagcatggagtggggattggtcccaggacccccacttacgccaaaatcttcacacactgaagtcctgcagctgccccacggaatctgcatacacaaaaagtcagcttctgtacacttggctttcacagccctcaaatactgcatttttgatccatatttggttggaaagatccatgaataaatgagttcagacccatgttgtcccagggcccactgtagttccgatgaggccactgggggctcctccagcacagccaacaccacctgtgccagcatcactgcccttcgaagtgtggccccagcagcggtctcctgcaccctccgaaaagacagcccttggaagactgtggctcaggatgcaaggctctgactgaaccctcaagctggccctccatgcgaagaaatgctgcgtcccaggccctgcacagtgctggacttcccagctccaggctctggagccggctgcagagcacagcgtgaggcaggccctgaccgctctggaaggaaaagcacctctggcaagtagtccagaggtgaaagtttctctattttggaaactgggcatctgccaaggagaacacacggccccctaatgtgcaacaaaaccgtgagacccgagcagaagctgcagcagaaggtagcacgggcaggatgctaggccccaggggccatgggctacgcacgggccaggtttccagcctgccagccccatccagacttaaggacggaaagtgggaccaaggctgagccgctccgcacccctcgctctacagctggacacaggctctgcagaaatcctgagctggggccaccccagcctccctggcccagaacaggcgctcactgtatctcctcccttcctcctgagaggtcctacgggatggagtattaatagtgccgtgtttaattattattcagcataatcacacatattacggggatttttaaagatcctttcatgcacaatgagtatttatctaatgtgccctcctcattcccaagcagccctcgggggcagatgcccccatctcccaggacatctctgctggtctctctccacggcacctgctccacagccacctctctctgctgtgctcacacagtgtggaagctcccgcttcagcaagaggaaagccccgatgatacagggtgaagacgcctcccctcacagacctcagacctgtcccagagccctgacaggaagacccaagctctcctgaagccttagggtctcaacatcccaagccgacaatgcccccccattgactcggctctctgcagacctgcagacctgcagcccagcccctactctcccctctggctggcattgtgcagtccttccttcctcagcagcgctgtgtgggaagggggactatctgcccagtccctgaggagatgatgacttcctacagcttctgaaagggcccgctctggggggagccacatcaggcagacacacggctcctggtgttggcagggtgccggcggaatccagggcaggattcacttgtgtggcgaaggggtcacccctcgtgcaggctcaggccctccctgcccacctgtggcggcgaagggaactgacaccactccttcccggtgagctcggcagggctgcatctctcccgtgggacgctgcagagataaccaggtagagccacgctcacgagaaccaccagccactctgagctaggacggggcacaggcaaccacgttcccacaaacacagggtctggaggtctctccgctggtcacggcctcggaattccgacatgctggactgtggcttgggaaactgactcggttgttctccattcctgatcccatttcctgtttgtgggtgtgatggctgagttgtgcaccccaaagttcatacactgaagtcctgacccccaggacctcagaatgggactgtatttggagatgggtcttgaaagaggtgatttcagtaaaacgaggtcgccggatgggcccggatccaggctgactgggtccttatggaggaggaggtgaggacacagacacgcacagatggacaaccctgtggggcacagggaggagacggcatctgccagccaaggggagaggcctctgggggaacctgccctgccgtgctctcatcttggactttcggcctccaggactcagaaatgtctgttgtttgctaagccgcctggtttgtgggggtttgttagggagactgagccaattcatacagtggattccgccactttctttctaacacaatgaagatagagttggtgacctcctcaaaccttcataaaggcataacttgtaacaacacaagttatggtttgtgacaaatatcaccagaagccccaagcagagtcgagacgtgcgcagaaactgcacaagccaacctggctcaggcctgggagagcatccctccgaggagcatccctccgaggatcccccacagccttcccgtcctcggagcaaatgcagctgtgtccttcccgcaccgtgggcctggccctcacctccccccaccccacacccagcttctccaccagctccccaggcctcctccccacaaggcgcgtcctgggcctccctgaccccggccatgccccccgccaccggagccacttcactgccttccctggccacagctccctgaagacagggccagcctgcgtctccgtgtccagtccttggacgtgctaaatcctcagcgagtgtctgccaagacacatgtgatgagcaggtgaaggaacatgtctgacctcctgcttcagtgccatggaggcctcaccagccccaggccatgggctggcctctccatttcctccttctgagaataccgtggagttgggattgtgtttgcctgtttacagggactacggtcagtgtccctcccaggccgctggtccttcctaacacctggcggcccactgctcagccatgtgggggttgtgcacagggcagggctccgaggtgtgggctccactctgtgggggggtctcacagcagccacacagagctggccattccctcaccgtgacctctgcagagagtagaattgtctgtgtacatggggctggggccaggctgtcctccgccagctctcaccccaggctcccctggtcttcctgccccgtatcccagattcatcagcaccagccacatctcacctgccccacaagctgcgcctcggtgctgctgtctcaaccaccttcctgtgtagcagggaccacctacctgtgttgcttgtgctatgtctgttggtttaaagcccatctctgatcccgcccgacacacagcagggactcagcaggacactcagtctaaacgacagggtagggggcaggcagggacagccgaggagctgctcctgggtgttcctgtgttgtgtgagcacatggaggaagttggtgtgtactaagcagtgaagctgctagcaactggctgtgtaacagctgccaagtaacacatcatgtttccacagagctccagaggcatcagcctaaacaagaggctcccgagaaggtgcactcatacagtgtggtgggggtacccgtgcttgggtgcaggacaggcgggggcacccgcctgggcagcctccagatgctgctgaggtttgccatggggtatgaacgccaggtgacgtcccaaaacaggccactcaatcactccccagagccggtcagccgtctcttgccctgtgaaatgcacatttacaaagcgtcacctggtgtatcaggaacaggttcacttgctgtctcagacctgtgaatgcctacatttcagctgatttagaaccacgcatgctgggccaggctcggtggctcacacctgtaatcccagcactttgggaggctgagggggacggatcaagaggtcaggagattgagaccatcctggctaacacggtgaaaccccgtctctactaaaaatacaaaaaaaaaaaaaattagccaggtgtggtggcgggtgcctgtacttccagctactcgggaggctgaggcaggagagtggcatgaacatgggaggcggagcttccagtaagccgagatcacaccactgcactgcactccagcctgggcaacagagcaaaactccgtctcaaaaacggaaaaaaaaaaaaaaagaactgtgcacgatggacactggcctcggtgagtccacaacaggaagcaaacaaggattaaagtgcccggaattggaagacacaacatttcctacacagcctgagtctaaggtgatgaggggtggaaacaccagctcctcagggggccagccctgtgagggaaacgtgtgctcacgaaagtcagcctggccttcgagcccaccaaggggctttgggatcacacagccaggggcaaatctcagctctgcagcctgagaaaagtcacccaaatgcctcaatccccttctcagacaggcagacagacaataataacaatgatgcctgggacacaggacattagaatgcccgcagcactcacacagcacctggtgggcactaagcacccgtcgctgttggtcctggggctaacgctgatgggaggagcagctgcgtgcatatttacttctgaatattttcacattttaaaatcatctccattttgctttggaatgcgtggcatctctgctgtgcaggtgctgacacgccccagagcaagcattggctgtgtcggcagaggaaggtgggaaggcccaggggaggccagcaggaggacggactcaccaggacacccccaaggacagggaaggtgctgctgaccacggccagcaacgacgagccatggtgacagctcacacacagctgcaaactcacatcgctgcctctggaaccacagagtgctctgtattagatattttgtgcatttttgaccaaaatgagtcaaatgtggggagagtggcaactgtgtgagtctgggctccaatcagcagcgaagatgcagtgtgggaatgacagcagcttccctctgcggacacagcacacactcaccacacctgggctgtgtccaccagccccaggggctgtggggaggggcggtcaccagaaggggccaggcgggagcaggaccagctcacagtctccccaggcctccccagccagcatgagttctcagcatctcctctacacacatggacaaacaccacacacacgtgtacatcacacatgccacacaccacacatatgcacaccacacacgtgccacacacagcacacatatgcacgctaccacacacatgcacacatgtatctcacataccacacacaagcatgcacgccacacatgccatacacaccacacgcatgccacatgcacacccctaacttaaggcctagctccaagtttctgtcacaaccaagagggaaaacagagagaatgcaaaagaagtgagatccattcctaggacaggctgaccccaaaaataagtagaattacgtcagatatttagaacatggaattagtgatttggttccctggctagtccatcaaagcctgtcgatccaaaatacaatttaaatgccacatgcttgcaataaaaagcaatggaaagcaaggtctttacagtaataattaagtgaagcaatgaaattgaatccaaaattattttttgtttctcttcaatactgatgctggtacatgaggaaaacagaacaagcataattggactgaatgagggaaggtggcaatttgcggaggctctgcaggagctcctgggaatgctggggacctggacatcccacgccggcctccccgtgtgccacagactcagctctgctccctggagcaggtttcatgcactgggacagggagctctggtaccccacgacttaaacacatagagcaaggcggggggggttccatgtgggcaaggtgaagagaaagcccacgatggaaccagctacagcacacgtgtgagagcgtgtgcctgtgagcacccatgtgtgcatatatgtgtgcccatgtgaggtgtatgtgtgcaggtttacactaacatatgaaacagagtgagtgctggggttgcaaagacccagaccacaaagagctggtggcaaaggaaaagaaacatgcacactcccaagatctgtttcacagcagaacccactccttcctgctcctgaggggcgaggcaagaggtgtcgggccatgtgggtcccatgcaggttccaggaaggacgttcactcagcagagcaggggaatggcaggctggggggagctagtgatcaagtgccctcaaaacatacacgtgtgtgtgtgtaagcatgtgtacggatgtatctgtatgcggatgtgtgtggccacatgtatgtatatgagcatgtgcatgggggtgtgtgtgtgaacatgtgcatgggcgtgggtgagcatgtgcacacaaacaaaaacaaaccacaacagactgtgttcaaagcgagaggatccctaagctgcgatgagggaactgaatttaatgtcctaggttacagcccggccaacagctgccccaaaccatgcctgacacagcaaatttacagacacatcaccctacagcgctcaggtaacggcttcccagccacgccccattacccacgtcccatgctgccatccaagaaacgctccagggaagggaagccaaggctgtcagttcacatctccctctccagagtcgagctcaagcccgcggctgccaccctccatgaactgatggggaagggggccacaggaaggccccaaccccatccagatccaggcctgcgagcccaggggtggcacagaaacagcaggtgttccctgagagaacgacccagggctgtggcaaagccccctccaggctcagctcatcccacctgtggggaaggcaccatgaggcctcctcacgaggcagacgggtgtttgctgtggtggacagatgcccacatctcacgcgcagcctcctggaaggcagcagatgcaaacaccccagctgagaggaggaggctgaagcaagtgcaggaaagaacaaaaccaatgcaccactggaccatcacctttagagaaaaaggttaagaaatctgtatcacataaaacaacctccaaacaccaggctcgacgccctcacccaccacctgccctctgctcatagaaagaacgtggtgaacaggagcatattttacacaaacacatgcctcctcccagccacgctggctccaacctactaggcacctggaagctgaacgcatcactgcactcacacgtgcctaaacacttaggtgcgccgagaagcccaggcatttggggtttccactgacaaggacacggaaggcaaaaaacccaaagcaacgtgggtccttccctctgaagggtcagataaaccggcttattttattcttagaataggtttttgccacagtgaaaactgaataaacaacaaagtcagaaaggggcgtgtccatccacagactttaatcctgcattaacagaggctccctaaagaagggggtgccggagggaggtgcagaccgcttcagggttggcccagcacctgggtggtgcccatgcccccagtgtaaaaagatcctcagctcgtcgggcacgaccttgctttgttatctgctcttggcctctgtccattctcaagccacgtcacgtctctatgaccaggctcttagatgcccaaaagcgacattgggagaggaaactgtcagcccccagcgtggctcctgtggcttctgagaagccccagatgtcaaacaggcatcagagcattccagtcacgtgccccacagagtcatcacggagacagcagagacagccatgagatttgctcagactttcagcaaacccccaccgatgcctccacactggaagttggagcgtggtggaccgtgcgttataataaagttgctattgtatgtgactttgatcctacaaagaggaaaaaacatgggtaaaaagtaagaaaagaccaaaaacgtcactaaacttcaaaaacccgggacatgatgtgattagaggaacagcatggaacatggcaaaaaatacataacaaaacaacaaaaaccagcaacaggcgcttcctccagacacaccacggcacacttcaacctgttccttacaagactacattgagcgtgctggtgttaaatgcgtgcaggcttccgtgcaggagccctctgcacatggcagagagaatgtggcccgtgctgcactctgacgcgcagaccatcttgatggctcagggacggccaggctccaccacacctgctccctcctgactggcctctctctaccaagccagggacaaggcctcatccccagaaccaccaaaggattaacttaaagcaaaacaaacacaagcaaacagaacagaaatgacttgggttcctgtcactttgtgctcccaagccattccaagagaccagcaattaataactcgcaaagaattagctcacctccaacaaccacgggagcttgaaaaccacttccttccctagttttgttacttgcagaatgaactgattctcaaatccctggagatactgggctgagtgcatttgtcctaattacagcaacatcatcttcctcagtgcaccctcgctcacagggcagcgcccaagatctgcactcaccaaagtgagcctctcacagatggaatctgtgcaaactttaagtcccaacaaaactttgccaaactcacttgttgagcaagaagctcagaaatggagatttctaggaccctccgcatctggctgcaaatcccagacacaaaccatccaaggagatcgcacctttgccttccactgagtggcccaacgtggagtgctaggaagccatcaggagccagacagacctatgtccactcccggaggcaccgccaggaccctgtcctgcgtgatgggtctccctgcaacacacgaggagtccctatcccaggggccagaggggacgtcccgcagagaccgtcctgaccccagccctctgcattgcaccaggtggacaccacagaagctctagcctgaggcaccgagccgtcaatcttccatcaatcgatgaagctctcacctataacggacatcctttcgccaccacacagcatttaccaagctttccagggtgccctgatggacatgctcacaatgcctcggggatttcctctgaagatgtggatgcagaatgaacaccatgaaaacacagctcccactccgggtacatcccaaagtcgcacgtcaggccctccgtgccgccgtcacagctgctctctccccagccaccactgcctttgctggggatgccttgcctgaagatgcaggggctaccctccctgggcctccactggccagtgcaggttgtgaccacccaccccccgggctccatcagggatggctgtgggtgcaggttgtggccacccatgccccgggctccatcagggatggctgtgggtgcaggttgtgaccacccacgccctgggctccgtcagggatggctgtgggtgcaggttgtgaccacccacaccccgggctccgtcagggatggctgtgggtgcaggttgtgaccacccaccccccgggctccatcagggatggctgtgggtgcaggttgtgaccacccacgccccgggctccgtcagggatggctgtgggtgcaggttgtgaccacccacgccccgggctccgtcagggatggctgtgggtgcaggttgtggccacccacgccctgggctccgtcagggatggctgtgggtgcaggttgtgaccacccatgccctgggctctgtcagggatggctgtgggtgcaggttgtgaccacccatgccacaggcttcatcagggacagctgtgtgctgctcttcatttcccaaacgcagtgggatcaggcctggctggatgtctgaactgcgactctgccccaactgctgccctcattgccgtaccccaagagcctccatccatcttgcaatggagctgccactcagcttgtccaccacagtccctcctgaagacacatctctgcgaagctccccccatcacccaggccaaagctagcctaccacgtcacacagtggccatctgcccgggcatgtttcacctcggctgtgcagaccctctgaagacgagacattctccatatgtttcttggctccaggcagctcatcgacagataacatcctgctagatcagcagagacgacgcctgcacgttgggcagcctgcacagccagggagggcggggtgggaaacgcagcgggagacagtgaggtgggggtctggaagtcctgcctcgagcctcgtcagcaggcaggcgtttcagtgttccccagaactacacctcagtatgccctcgcagaaaggagcacttcacacaacatctttagagaccagccacctccaaagcctctgttcctcctgcattgcctcccaaatgatctcccagcctgggaatgtcagattctcagattccatggggtattcttttctgtggctgttactcatgtaatctaaggaagtgttgaagttctgagttaccctgtagcaaaggcatatcttgttccttccacaatctggtcgaagaaaacagcagctttgatctcagatactcttaactactcagtaccaagggaagttgtgggctttgagccaaccacacctaatgtcaatgctcactccctccccattcagctgcgtgaattcgggtaagtttcttacatgagctgagccttgtttttcctttctgtaaattggggatttaaaatgcccacctcactgggtcatggtaagaacctgcaatgggagggtacctgcatttaatctgtgctgttttcgttctcctgatacagaactgtgtcagaatcctgctttctgcggctggactatttgtcaactgcctgttagagcacctggggagcggctggggctttctctggggtcagaccatggcactgaggacttcttgtagcattcaggtggctattgaaatcatacaaaaacaattaataggcaaccattagaaattaggcaataaagttttttcagttagttggtcaactgtgtacacaacacaaagcagaatacagagtgtgtatatgtcctcaaccatgattgtttttacataaagtgtttaaaaaaaaagactggaaggaaacacagtaaatcttaatatagcggctatacttgattatatttgggattttttctttcattttctataaaatgtctaagttttccatccagtttatttttaaaatctgcaaaagtacttcaaaaatgagtaatctaaaagtctggttccatactagataagatgaagaaaaataaaatttcagttcacatccaaaaggttgggaccttactaaccagaaccccacacataaccacacaaaacactcaaaacaaccacacaaagcaaccacaactccagcccataccttccatttagttttgttgtggatgttggcgatgcaatgccccaaatctcattaagcccatcaattaaaattcaaaaatataaaacatgaaaactaaaataaagaaggtctgaaatgccctttaaattttgctgaaaatcatcacctcctcctctgggtccagacagggctagacagaggcttgcctaatgaaagtgattgtcttagatttgaaactttgcctggtttcataaacttgatgatgttttcaagaaaataaacaataagaagttaagtaagtgctgccctgccttgtctattgtgcaccaggcacacatgaagacacaagggccttcccagcccactataacccagatgggactcaggaagaccccacaagggcctttccagcccgccattgacaagatgagactcaggaagacacaagggccttcccagcccaccatcaacaagacgggactcaggaagacacaaggaccctcccagcccaccatcaccgagacgggactcaggaaaacacaagggccttcccaggcagccatcaccaggatgtgactcaggaagacacaagggccttcccagcccaccattgacaaaacaagactcaggaagacacaagggccttcccagcccaccattgacgagatgagactcaggaagacacaagggccttcccagtccaccatcgacaagacgagactcaggaagacacaatgaccttcccagcctgccatcactgagacaagactcaggaagacacaagggccttcccagcccaccatcaataagacgggactcaggaaaacaactgagcaaacatctgtcagtaggacacgggtggagacagactgtgccccggactgaatgtgtgagtcctcccaaaactcctacgtgatggtgttaggagggccctctgggacatgactgggccatcagggtggagcctcaggatgggattagtgcccttataggaagagactcaggagcccaccctctgctcgcccctgtgaggtcccagtgagaagacaggcctctgcaaaccagaagcaggcgctcccagacaccaagtctgctggcaccttgaccccacacttccagcctccagaaatgtgaaaaataaacatccattgtttaagcccgaggctgcagcatatttgttatagcatcctgagcggactatgatgaatagcatagccaaattaggataactggagagggatggcttacaagggcaagggtcaggcataaggaaccacaggaagaggctctctagttcagcagtaatgtcgtcgttagcacccaaggcccaaacgaggaagcagagtcatgcatgagagtcaactgtcaggaaacagtgagctgcagcccaaggacaggccagcgggggctgtcgccagggaggaagtgcagtccacatgccgtctctatccaagctccagctccctctgccattctcctgcctcagaacagggaaaaggtgctctgaagctgcgctcccttccactcagccagagaagaccagcagaccaggggccagaggcaggtgagtcaggacagaggtcaaaggacccacagacctgtgggacacagagcaggacgtggagggtgggcaccccgcagagcacccggcctcatctgccagcccagcaacgagcctggactgtgctgcaaactcgattccttgcatataaatgtgaacattaggctaaatgacccttacattaccagtttatctcaccagcgctttcagcctatttcttatttaggtctctgataaatgacttcatctttatttatgaatgttcctttccctgtaatatttgctagcttcaccttgacctcataaatgtaatttgttgtttcaaattctagtagcagaactgcattttaaaatgctgaaaagccatcactttagagctggtgagagaaaacattactttttttcattactcatttcttctagatttggaagcaaaatctggctttccaagcacggaaggagtagaccaccacagggacagagggtccccctgtggagctctcttccggacgctggcggaaaagagcacagctcgtgcacctttagaatcagtgcccctttttaggggccccctgtaagtggctttgtttctggaaaatgtggggacacttttcatactcgacgtagcccacagccaggtctgtgcaccgcatctcggaaagtgtttcgagacctgctcgtccggtgactggcgcacgctgcgctccctcacaaacactaaccccagtggttctcctcccagcactgcccctcacccctgcgcggcgtgtccctctgggaatccactcgcaggcgacctccagcgtgtgtctacttgctgcttctgtccctgttaccaccaaggctatggctgcaagtttccaaggaaaaagcgcagcctccgtgggtcgtgatttctgtggcttctataatgcgtgtgtgcctctcccagccgtcacacatggcgtctcaagtgccccagcccacccatgggacctgcagagacgcatcccagcgccctaggcactgagaataggtgggcgctcacctgacagtggcctcccatcctccactgccttgagccctttcccatgcactgcactacggacaccccagccactacctcatcccaaaagcaggcggcaccacggggcgggaagaggaactcaggtccgtgaacacctgcctcgtgcagggccctgactccagtgattctcgcagcctcgtaaccccaacaacaggccccggagctcagctttttattcccacttcacagatgagggaacgaagacacgacccacccaaactcacaggtgggcagggggtggtctgactcccagcccagtcccaggacctgctggaagtgaggcagcacgaaccccccagggctcagctctccaaatccaaaatggaggggtttcccttcacccctcagcgctctggagggaacgacaactgcagattccaaggtgtttcagggaaaagccatgccccccgtgtcagccagcacagcctgcaacgaccac

SEQ ID NO: 70 - DNA, 22258 bp, Homo sapiens
  source 1..22258: mol_type = genomic DNA
acaaacatcacataacataaaaaaacacaaaaataaacacataaaaacacacaaaatacaaagaaacatacattgaaaacatatggctcttttcaatcttctttttctttcttgtgtttcatatatatcaagaaatttatcttttccttgtgcattttgttcttcagttgaatttacagttttatgatcttaaagacacataagtgttctttttttttgagtcggagtctcgctctgtcacccaggctggagtgcagtggcacgatctcggctcactgcaagctcagcctcccaggttcacgccattctgctgcctcggcctcccgagtagctgggactacaggcacccaccaccacgcccggctaattttttgtatttttagtagagacggggtttcaccgtgttaaccaggatggtcttgatctcctgaccctgtgatccacccacctcggcctcccaaagtgctgggattacaggcgtgagccaccatgcccggccacacgtaagtgttttgattagtaaatccaggtagaagttgtatgtgtgaactgtaaataatgttgacaactcttaagaattgtctgttttaattaaaccaagaaacttaaactagctttctatttactaaagattatctcagatcacgtgaccttgaaaaacatttagatgggctccagtttttctaagaaaatgctccatttatggaagcaattcttttctttcttttaaccaaatctttgcataggtaccaaataacacatttgtttaggatgagagctgcccactgcccccgccaaaaaaaagtacttttatatacaaaagtccaaatttccaaaggtatatgtactttaattgtgacttgaactcaaggtaaataaattaaataattaataaattaaccttagcttactggacggccaccatcttatatgctgttcccttgactgaaatgttgtggggtaaatgactatatatgaaatgggacttattggaggaattaatgcatctgataatggaggttgagaagttccacaacaggccatctgcacagcagagaccctgaaatgctggaagcaggacttaatccagcccaaaaacctaagacccagggaagccgatggtgtaattcttagttcaaggccaaaatccttagatccttcgggaggccactggtgtatgccctggagtccaagggctagaaatcctagactctgatgtccacaggcagaagagtgtcccagctccaggagatcagatggatttgcttttccttttttttttgttttcttctatcttgctccccagtctgtcggacggtgcccccccaaattaagggtaggtcttttccactcagtccacccgatcgcatgccaatcccctctggaaacaccctcgaagacatgcccagaaataatgtcccagaaataatgccttaccagtgttctaggtgttccttaatccattcaaattaacacctccaattgaccaccatgataaggaaacacacggaggccagctcaggggagaaccagattttcctttggcatgtgagcctcagtcgggcaataattctttcaagtttattttattttatcttgagacagagtcttgctctgtgtcccaggctggagtgcagtggtgcaatctcagctcactgcctcgtgggttcaagtgattctcctgcctcagcctcccgagtagccgagaatatatgcacacaccatcacatccagttaatttttgtatttttttgtaaagacggcatttcacgatgttggtcaggctggtcttgaacttctgacctcaagtgatccacccgcctcagcctcccaaagtgctgggattacaggcatgagccactacacctggctaagaatttactttgtatacatgttaaaaaaaaaaaaaacctaatatgtattaactcctaacacctaagaggaaacctctggtaaaaagagtctttcactccaaggacacggcagagcctgtgccatcttctaagtagatgaactttccagagtccaccaagaggtcctgaatcttctctcttgcatgtctctcttccatcctctccaaggcatccagcagggtgtggatcgaggcgttccgtccagttttgttgacccatttcatcagcattgcatacaaggcatcccctgggcctgctgtaccagctctgaccacatcgatctcatttttcgtgaggtccagctgcctcatgagctggtcccaggagtcaaagggcacgatgtttgcaaacttgtcaaagaacagcatcagagctgggtggagaaagccacagagacagccagatgagttgggactcagttcagaaggggcagaggatcccacatcaggcccagaacccaaggagagaacctggagagccccctgcatgggcaaacctgttgctccattgcccacccacctcccatccacagagagcccacccacactgcctggcctctgtggcccccaaggcgctgacgggcgtcaaggtcaccagagaatctgccctcagagagggctgagaacccacctggggaggatggattgaccctacggaggcagaaagcaaagtgggtgagagcccgagggagggagggagagtggctgcagcgggagctcagaggatgcgggctgcctgggctgcgcttgtcatgggagcatgtcccagggtggccacttctgcatctgtggaaagtgcagggtctggggcaggggacctctgccctccctgaggctggggcagagctaggtgggggcaagcaggccctgaccaagaagcaaacctgaagacagagcaaacctgcccagatctcaggactaccagggattgaatgaaatgagatgtgtgtgcaaagcactgcacaccaccatccacagggatagaaggggccaggagtaccaagctatgttttctaacagcctcatttaaagaacataaaaagaaaaaagtgacattcattttaatgtgtggtactgaatatgtgtaaaatataatttaatatgcaatgagtatacaaaaactgaaactgacccaattgtcccatagaaaggtttttttgataaacagaaattgacccttctggtccttaacgactggaaacttaacatttgttttatctgagttacttcctcaggaaagacctgcaagcatctcaaaaaaagtagcaaagaactgaaactcaccagatcactacatccagaccatgatgggatgtgggacccctcattcatcttgattgtttccttgccccattctagctcctactttcttacacattgttacatttcttgcctcctatataaacccttagttttagttggtcagggagatacagttgagactgagctcccatctcttccactgcagcaccctattaaagccttcttggcaatactcatcatctcagtgactggctttctgtgcagcgagcagcgggacctagaccaaacccctgaggttttggtaacaggttttggttccctggctgggaaagtgttgctcatggctctgctgccatgggccaggagactcagaagccctcccaagcagttgccccgctaactttggctggaggtgagtttcagtctctctcaggtcccactgcagccggccccaaccacattcctgattacttccgaagaactgcctttgaaatttgacatttgcatccagacaggtgattgtcctttgtgggcccagacagcaggatctgctcttctcagtttgagaaatttttaaaggaatttccatttgcaggttgaacaggcccaagtgactgtgagagggaagcactctgcctttcagtctggacactcttggaggcttgtttgtaattgtgtgttgtttcagggcaagtgagtgtcttttgtgggtaccaggcagcacgactggctcctctcaatttgagaaatttgaaagcaatttttgttggcaggttgatcaaacctaaccaatggagagaggaagcaccctgcctgtttcagtctggacactcttggagcttgtttgttgctgcagcagttgtattatgttttggtgattatttctatgtgtttgctagagtcatgggaaattggaattcagtaaacttggtattcttttgtaatactgtttggctccaatattgcttggaaactgaagtttgctgctgaatgagaaagtaggatggagttcctgtatccaggcttttatgttgctgttctaagcagcattgggcctgattagttggttctaggtggtgttctctgcgatgctgtttggagtctgcagaggtttggcctttaaaaatcaaactgccatggaaactgctttacctaaaatttgggttcacaaccttcactgaattatctattggagctaacaaatttcagccatgtgaacatatttgtagactggtgagtttgtattactgtctcatggagagagttcaaaggtaaaagctattggatctttgtgtgtgcatataggtctagatgtgtttatgtgtatgtacatttattattaagttacatgttgtgtctaccaaattgacttataagtaaaagagtactcataaataaagtaaataattccaagcaattttcaagttcatgtgacttaagtaaatccttactaaacaagtcagctttaaaattattggtaaaataagaaaacagaagtgtcttcagaattgtcagcatacatttttgtctgggcttatatttgtctttgctagatattttgagatatcagtttggcacaaaaacttaagactacaagcccaaccaaaacaaaatgatctttgagtcaagcttttgataagtaagattaaattaatgttgttggtttaatgaaaacagctgagtcttctgacttattggtgaaaatatctatatatttaactttgaagctcttaggtgagcacctgatgttcactggctattaaaaaaatggctgacaaagaaattaactaactttaaatgatggtgtctaatatctcaattttcagaagcaatctggataaacttaaaaatgaaagaattgagtaaatgtaaatgggatgttttaagtaaatttttcatataattaaaaattgttgtcattggattacagagaaaacttccagtgcagtaactgaaagaccaatgtgtggccaggcgcattggctcatgtctgtaatcccagcactttgggaggccaaggcaggcgaatgtctatcacttgaggccaggagtttgagaccagactggccaacgtggcaaaaccctgtctctactaaaaatacaaaaagtacccagatgtggtggtgcacacctgtggtcccagctactcaggaggctgaggcgtgagaattgctagaacccaggaggtggaggttgcagtgagatgagattgcaccactgcactccagcgtgggtgacagagtgagactctgtctcaaaacaaaaaaagaagaaagactgatgtgttcataaagattgtgattgttaaccaaacatgaagctgggcaggagctgattgagtggactgaactaatagaggactgaaataattcgtatggcttttgttggtttgaaatattgctgattcttttggttttgttttccagtctggagaacttttttcttctttgctatttatagcctttaagtatactttaagtatattgagtatacttttgtaaacagaatttgaggcatatttctctctctgcctaatttctctagaatttttaaattatttgtgactattaattcatggcaatgtgtttgcttacatatggttaataacaacgttttcttttacaatggaacacagttggataaaatggttattttctcagggctttgattgcaatggcctcgtgagaggttccagcaaagccaacttaggagagcctatgtggacagtgatttttgctgcactttgtgtgggtaatcaggccacgtatatggaactaaacttattttgcaggtacattggtcctgctataatttgtctttggtggaagtggggccgagagagagagattgtgtttcagaagaaacacaatcttttagtattaaattaacctttgattcctgggtggccatgaggtcacccatggtatgtgaagcttcccatgatgcccctcctcaaccatgaagcagccagaaagatccaggaccagactctctgtgactgtgggattgataaatagaaagggagaactgaaatcaacccaatatgtccatcaaaaggtttttttgttgttgttgttgttttgataaacatagaaattgacccttctgttcttaaagctcaaatcttacatttgttttatctgagttcctttttcaggaaatgaccttcaggcctctcaaagtatcaaagaactgaaacttacaaatcactacatccaatgggatgctggacccctcattcatcttgattgcttccttacccctccctagttcctgttttcttacacattgttacttttttgtttttttgagacagagtcttgctctgtcacccaggctggagtgcagtagcgctatcttggctcactgcaagctctgcctcccgggttcatgccattctcctgcctcagcctcccgaatagctgggactacaggcgcccgccaatacgcctggctaatttttttttgtatttttagtacagaaggggtttcaccatgttagccaggatggtctcgatctcctgaccttgtgattcgcccgcctcggcctcccaaagtactgggattacaggcataagccaccgtgcccggcccacattgttacattttatccctactatataaacccctagttttagtccatcaggggacatgaattggagactgagctcccatctccttgcctacagcactcaatgaaagtattcttccttgtcaatactaattgtctcagtgattggccctctgtgcagtgagcaccaagacctagacccaacacctggtgtttcggtaacaaaataatgagtggaatattttccattctttcttgcattaagtctttggaatcagtatgtagtttatacaacagctctgcaaattgggcttaggcacagataaagagctattagcccactgaagtcagtggtgccatgcaggacagggcagcccctcagggctgttgttctcctgaacaacaaaggagaagagaggaggtggagaagaggatagacagagtggctagtgtcattaatagggtgcagaaaggatgaggtagagtgggaagaagagatgggagaagacaatttagggtcttgatggtctatagcataggacccccagtttctggcatggaatgctctggaagagcactctcagcaatggggacaccagttaggacaccgtccctattcccaccatttctgctgcatctccaggagcaaaacacttactctcagtggggtcagcaccatttgctggaaccagcagcctcctcctctgagacccttcagcttctgccggtccctgtaacacacagtggggaatgccttggtctgagtcaggggtcctgcagtctagtactgactctgaccatcagccagcccggaaacctgcagcacatcactttcccccttgggtcaccatggagatggtgaaaaacctctggtcccacatagctcacagccactccccattgctggcattaccacctcagctccacccggtcagatcagtggcaacattagattcttataggagtgcaaaccctattgtgaactgtgcacgtcagggatctgggttgcatactccttatgagaatcttatgcctgattatctgtcaccgtctcccatcaccctcagataggaccatctcgttgcaggaaaacaagctcagggctcccactgactctacattatgataagttgtataattatttcattatatattataatgtgataagaatagaaataaagtacacaataaacgtaatgtgcttgaatcatccccaaaccatcttcacctcccagtccatagaaaaattgtcttccacaaaactggtccctggtgccaaaaggttggggaccattcgttaataatataatgtcttttgtatacacatacactgatgcatagatttggacaaagaatcacaagaaatgatatctcatagttacttgaggaaaaagacccagggcactgcagagtggaggatgctctctttacttactgagtaccttttgatagtttaaattttctcattttaaatatataaactatttgttcatgtcaaagcaccttatcaagctggagattattgacctttttaatgtttgccttcttttttttttaattacatttttggttagaataaatgggtactaatgcaagaaaggaactgaatggaacagtctaggtggaaggagatcattgtctagatgagcatttaacctgtgattaaggagggacccaaagcagagggaaatgggagaatcggcagctcaaaggggttggaaaaaccagacagtgactagaacaattcagggagtgcctcgctttgcactgaaacacaaaacaagttccatttagattataaagttatatgcaaaaatcacatcattgaaaaaaatatctccataagaagttagaggagttcgtcttgtgttggcaaaaggtctttctacagtagtgagcaatgaaaaggtaaaagtatctacagatttcactggttaaaaattaaagcttctacacctgaaaatattagaacaaaaaggggcaagaagaaattaggaatctactgtctgaatgtgagaaaaagcatgagtaggagagcaggccttctcataaagactctgagagacaagacactgatcttacgcaaaaacagtgaaaacaaagaaatgttcgtttaaaacaatgttttcctaaatagcaaaaaaaagaaaaaaaaagaaaagaaaaagcccttcaatgtcaaatcaaaatacatgaactggtacaaaccaacactagggggctgtgtgcatgtgtgtacctgtatgtgtgggtacgtgcatgtgtgtgtgcatgtgtgtacatgcatgtgtgtgcatgtgcgtgtatgtgcgtgtacacagtaagcagcactgttacaggctgacttggaaattgtgcttcttcttggaatcctccatacaaccatatgcagaaatttgggcagagatttagatccaaatatgtttaatgcaataataatttcagagtaaatttaaaatccctgctgttatgagcaagggctccctaacttctgtaggagcacacagtggagaccgtgcagccttattcagtcatcaacaaaccctgtgacccccactctattcctctggagctccagtttctgaggacatggcaaggacaggacagggactaagaagcagacatttggaagagtgcctgtccccttgtgagggtggctgctttttcccacgcagccccgtcccctgcagtcccatctccctcaggctccacttcccctttgaccaggagagccgaggcatggccttcaccccctgcctacaaggtcttggaggggcctgtccccaactcaccagcagacactgtgcctcccctggggactgtacagtgacacctgtcaaatctgccggctcctggctttccatttgctgctcagagacgaaagtggacagcgagtctgcgttgctcagaatctcgttgtgagcattgtcctcagccccaggccctcgtaggagacccaagcgccagaaacacaccttaggaaggcaaagagccaactcagaagcccacacccagggctccccacggggtccgtagggcacggctggacctgctgccaccaccccctcccagtgaggtcactccaggaagtccatgctcagcacatccaggacctgctgctggggccaggccctggtgctgggcttgggggctcaccccatccccagggtacaggctgtggggtaagggtctcacctgggctgtaggaagcacagggctacagaatggcccaccagcctgtatgatgctcaaaagggcctgtgtcccccatagtcaatgcacagcatccaggccacttcagagactcagggcagccatgagagcacggggacccacccacctggactacactgtgggcaagaagcagttcctgagcccctgatgcccccagctcctggagaaatcaactcaccctgtccatgcacttggggtcccctccacaacctagaagagaagacggttcccttagtggccagggaggggcccatgcagcactccttcttagagggcagtgttgggcaggggtgggctgggggctgggacactggacaaagatccccgggcctggggatccacatgaggccctgctaactcgggagatccttcaggagcggggagcataaagggaagtaggctaaaaacaaacaagtggaacatcactgttttctgctctgtgttttgctctgaacaaagctacataaatcccacaaccacttctcgtctcgactcttgtcatccagttgaggagctgactgccccctgcctggatgggcctgaccagtggaggaactggccctgccttcccagacttggctgggagatgaggggacccccagccttgggagagggacggatgacaccagggccctagggttgcacaggatgggaggatggggggtgatcacaaggaggaagatagagcccggccagagacactaggacttggggcaggggtgagcgtttctgtctgtgggaacagaagaaggcagggcagagagtgcccagagcccttgccctcagccagcacctacctgagccgatgcaacaacagacaatcagcacagccaccaacagcaacggaacaaccaaagtcacaaccaaaatcacccatatattatgtccattgcctgagaaaagacaggaaaagacaggagtctcgggctgctggtccctgtctcctctgcagctggggcttccccagtgggctttgtacctgattctttgtggacacactcgatgtcactccagggcgtacaatccttgaccttgaccatccctctggggcacctgggtacacacagggagggaggggggggactcttgatggaaagctggccaggtgggatgaaagaggagccactctccctgcccaatgtccctgagaaggcgtcaggggaaggatagtctcctcgtatctgcagggggtccccctatgctcccttgtttaggctggggaagggtctgagcatgcacactttacccccttggcctccctgctctggggtcagagctgcagttccaggagccttctgtgctgggcacacactaatcttccctgggctgcaggggaggcctgcgttaggaggaatcacactccaggggaagatcacaagcccgtgtggccacaagctgagccccttcctccagttaacccacagtacaagtgagccctcgcccccacctgtctgctggttcctctcaatcacagcaaacactggaggaccagagaagagcaattactctttgcttccaaaaccaaaataggaaaaagacaggacttattgagaaatcaggggccaggggtgaggctggctgggtgggctcaggtcctcatgggaacttgaaggagctccacccatggccttattatgatttttgcgggctgtgggcatttctgtcttcttgaattaaaagcaaatattaaaaattacattttatgactcaatttgtttaaatataaatataaccccagctggattctataccattattttcttatgatttcaagataaaatatttcatgtacctctgttgtgggccctaagtcatggcctcctgtgcctagtgaacaagtcagcctggccaaggggactagtgctggggaggggtgagaaggggccactgcaggggacaggggtggggacaggcagatggaccaggaggggcaggttgcaggctcaggagacgccacaggctcagggacacctatgggggtggaggcaccatggggtcagggctgatagatacgggtacaaggagactcgggtctttttagggttccttgcttctgtgggttctttgaggctgctgggagccccttggctgttgtctcaccctctgctgcacttccggcacatctcagcagaattgtcattccggaaagttcctggtttgcactgacatgctgtgttcctggtcgtggtgcagggacttctctcttcttcatctgatgacagagtacaaggttttgggaatgtgtttccctgacgtgtcccttgacctttcctcaccaccccaactccctccccctcagctcagctcaactcagtttgccaaggagttctgagggccagattctgcaccagcacactcgggctcacacaggacacccacccttcagctgtcaccaacacttggagtcatacaaaaggaccatgattcattatttattacatcagattagggaaaaagcaccatttagatcgcatggtcagtagcaaaggaggcacatggtatgtgagagagtctgcaagaagaggagcccttgggtgacttcccaaaaacccagcctgctgaggaagagggaggcgcctgagaaactgaaggctgagtgagcctgagaacctgccaggagcacacagcccagggggagcgtggccccagagcagacccgtaccaccgctgaaactcagccctgtccactcagccaggccttctttgtgctgtaatgatgcccctaccctcttggagctgatagtttgcactaccaggtggcatgcattataaaaatgatttctttctgtttcattttatggacctaagacataaccatggaacagggtatgatgaagaccaagttgggctggaacttggttccctgactcacattggctaccactcccacctcactgcccctcactccacctctggacaagaggtccacacattctgtacctgatttacaagctgtacatgggaggcaagcaaacaaattgttggaagcattggtgtaacccacaccctctgtgcaccggttacaggctccaggatgttctgatctatgagatcctgggaagggagagaaaagccaatgaatgaattgccacagagttcccagaggatcgtggcggtggctaggaaactcttcttttggccatcagtagaccccagacagagaaatcccatcttcttggcttggtcttgtcgtcaattctgcatctatacacacctctgactggcgctgctgacagaaatacaatacaaaccacatgcaaaattcaaattctatgagagccatattaaaatagtaaaaagagaatgaggtcaaattaattttaacaatgtactttttggacctaaaatatccaaaacattagcatttcaacatgtaaacaagataaaacattgagatattttcttttattttgaatactaagtgttcgaaacccagagtgtatttttcactcactgcacatctcaattcaaagtggctgtgttttaagtgattaatggccacataggcctagagaccagggcaatgccacctgcatccctggaaactcacaaaaagtcctaatccctgccctcagtgagctcttggtcagtagaaggtacaaacaggcgcagaaacaatacagcgatgaggggaaggcttcagatacagcccatgccacctgccatgggaggaaaatggaaggaaaaagggtcctccctatacagagtcaaagaatgatccacagaaagaaggcctacctcatgctgccctggattgcagagggtctccaggcactgaggtgacagcctgcaggagctgtcgccagcgggagcccatgtctggaggctcgaccttcacctccagggcttcgccccttcaggtgacctcactctcccctttcagtgcccatttatttatccctctcctctgattcatatttactgatattgaaagatactcttagaaaacccaaactgtggaaaaaaaacttccttgataatgtgttacgatgacgacactaccaattataaaaatgtggttattgagtaatagtgctggggcaactaaggttactactgaaaaataataaaggcttttttttttttttgagatggagtctcgctctctcaccaggctggagttcagtggcgtgatcttggctcactgtaacctccgcctcctgggttcaagcgattctcctgcctcagcctcccgagtagctgggactacaggagcgtgccaccacgcctggctaattttttgtatttttagtagagacggggtttcactaggtttcaccaggatggtctcgatctcctgacctcatgatccacctgcctcggcctcccaaagtgctgggattacaggagtgagccaccgtgccactgtgaaggaaaaacttccttgctgatgtgttatgatgatgacactatcgatgataaaaatatgattattcagtaatggcgctggggcaactaaggttactgctgaaaaataataaagcttcttgcttatgctctccctataaggaaatagagactaggtctatcaaggtgtcaactgtaaagtatgaaatcacacaagtactgcatgagaaatttttcttacaagtttggagagagaaaggaccttctcagtctcacgagaaactaaaaagttgcataaagttaactatatgaaaattaggaagaaaactgcatggaagaaatcttgactaagatgaaaacaaagtaggagaaaatacttgcaatgaaaaccacactgcaaagcatagtttccttaacctataggaattcataccaaaaaaatctagaaagaacatcaacaagaaagtagtagacttgaacaacactattaacaactagactggacagatgtctataaaacactctactcaatcaaaacaagatacacattcttttaaagtgcacatagaacattctccaaaataaaccatatgcttggccataagataaacctcaatacacttaaaaggatagagataatacaaaatacactctcctaccacaatggaataaaattagaaatcaatagcaggaagaaactggggaacatcacagctatataaaaattaaatagcacactcctaaataaccaactggtctaaaaagaaatcaaaagagaaatcagaaaataagacgaatgaaaatgaagacacaacataccaaaacctatgggatacagctaacgtagctgaagtttacagagaaattgtctattaaggaagaagaaatatccttcctaaatgtctattaaggaagaagaaatatctcaatctataacctaataatccactctaagacactcgaaaaagaagagcaaactatagataaagcaagcagaaggaagaaaataatacagattagagcagaaattaatgagacggagaacagaaaaacaacagagtaaattaatgaactcaaaatctagttctttaaatagatcgatatattggcacaactaattgtgttaaaaaattagcacagggaaaaaataagactcaaattatagtcacgcactgcatgatgacgtttcggtcaacaatgaaccacatatgtgacggtggtcccataatattataatggaggaggaaaattcctatcgcttagtaatgtcataagtcaatgcgttactcaggtgtttgtggtaatgctgatgtaaacaaacctacttcactgccagttaaaagtatagcacatataatgaagttctatatataatatttgataatgataataaatgacttactgatttatgtatttttgatactatacattgtaatgttattttagagtgtactcctacttacaaataaaaaaggtaactataaaacagcctcatgcagttttccagaagaaggcattgttatcagaggacataggagttgacagctccatgtgtgtctgcccctgaagatcctccaacgcgacaagatgtggaggtgaaagacagtgatgttgatgaacctgtccttgtgtagacctaggttaatgtctgtgtttctttttttttttttttttgagaaggagtcacactccgtcacccaggctggagtgcagtggcgcaatctcagctcactacaacctctgcctctcaggttcaagcgattatcctgcctcagcctcagcctcccgagtagctgggactacaggtgcctgccaccatgcccagctaattttttgtatttttagtagagacagggtttcactgtgttagccaggatggtctcgatctcctgacctcgtgatccgcctgccttggcctcccaaagtgctgggattacaggtgtgagccactgcgcccggccaatgtctgtgtttctatcttagtttttaacaaaaaaatttttaagtaaaaaaaagtttaagttaaaaatacaaaaatgtttatagaatacgaatataaagaaagaacattttttgtacagctgtacagtttttgttttttaagctaagtgttaaaacgagtgaaaaagttttaaaaattaaaaagtttataaagtaaaatagttacacgaagttaatattgaaggaaggaaaaaaaaatttacagatttggtgtagcctaaatgtacagtgtttataaagtccatagtagtgtacaggaatgtcccaggccttcacattcactcaccactcactgactcacccagacaagatccagtcctgcaagctccattcatggtaagtgccctagacaactacatcatcttttttaaccttttataccatatttttattgggccttttctatgttcacatgtttaggaactcaaatacttatcattgtgttacaattgtctactagtacaggtttgtaatctaagagcaataggctatatcacatagcctagggatgcagtaggctatatcatctaggtttgtggaggtacactctatgatgtttgcacaatgatgcacttgtcagaatgagttcccatcattaactgaggcatgactgtattagaatcagaaatgagagagagcacattactacagattatatagaaataaaaaaattataaaagaatactatgaaacctgtacaacaaaaaattaggtaccttggatgaaaggggcaaattcctagaaagacacaaactactgaaactgaatcaagatgaaagagacaatgtgaatagacatatagcaagtaaagattttgacttagttatcaaaactactcctaaagaaaagtcgttttcacaagatggcactgaaagcaaagaaggaagctcctgcccctcctaaagctgaagcgatgcaaaggttttgaaggccaagaaggcagtgtagaaaggtgtccactgccatgaaaaaaagaatatccatacatcacccaccttccggtggcccaagatactgagactctggagagcacccccaggagaaacaagcttgaccactatgctatcatcaagcttccactgaccactgagtatgccatgaagaagatagaagacgacaacaacacacttgtgttcattgtagatgttaaaaccaacaagcaccagatcaaacaggttgtgaagaagctctatgatgtttatgtggccaaggttcaacaccctgattaggcctgatggagagaagaaggcatatgttcgactggctcctgattaccatgtcttggatgttgccaacaaaattgggatcatctaaactgaatccagctggctaattctaaatacatgtatatgttttcaccagaaaaacaaagttgaggcccagatgcctttaccactgaatgataccaaccatttcaagaagaattaataccaattattcagaaaccctttttaaagacagcagaggaaggagcactttccaattcattgtataaggacaatattactgatatgatttggctgtgtccccacacaaatctcatcttgaattcccgtaagttgtgggagggatccaatgggaggtaattgaatcatgtggggcaggtctttcccttgcagttctcatgataatgagtaagtctcataagatctgatggttattataagggggagttttcctgcacaagctctctttgcttgctgccatccatgtaagacatgacttgctcctccttgccttccatcattattgtaagacttccccagccacgtagaactgtaagttcaattaaacctctttctttgtaaattgcccagtcttgggaatgtcttcatcagcagcacgaaaaaaaaaaaaaaaaactaatacagtaaattggtaccagtagagtggggagctgctgaaaagatacctgaaaatatggaagcaactttggaactgcataacaggcagaggttggaacagtttggagggctcagacgaagataggaaaatgtgggaaagtgtggaacttcctagagacttgttgaatggctttgaccaaaagcctaatagtgatatggacaataaagtccaggctgagatgatctcagatggagatgaggaacttattgggaactggagcaaaggtgactcttgttatattttagcaaagaaagcaaagagagtggtggcattttgtcccttccctagagatctgtggagctttgaactgggaagaggtgatttagggtatgtggcagaagaaatttctaggcagcaatgcattcaaggggtgacttgagtgctgtaaaaggcattcagtttttttgtttatttgtttgtttctttgtttttaaccaatgttgcattcctaggataaaacttacttggtcctggtatataattctttttttgttttgttttgttttttgtttttgagacagagtcttgctctgttgcccaggctggagtgcagtggcatgatctcggctcactgcaagtccgcctcctgggttcacaccattctcctgcctcagcctcctgagtagctgggactacaggcacccaccaccatgcctggctaatttttttgtatttttagtagagacggggtttcaccgtgttcgccaggatggtctcaatctcctgacctcatgatccacctgccttggcctcccaaagtgctgggattacacgcatgagccaccgcgcctggccggcattcagttttataagggaaccagagcattaaagtttggaaaatctgcaacctgacaatgtgctagaaaagaaaacccattttctgaggagaaattaaagatggctgcataaatttgcataagtaatgaggagctgagtgttaatccccaagacaatggggaaaatgtctccagggcatgttagaggtcatcatggcagcccctcccatcacaggcccgaaggcctaggagaaaatagtttcctggtaggagtccagggtcttgtgctgtgtggagtctagggacttggtgccctacattccagccactccagctgtgactaaaaggggccaaggtacagcttgggctgttgcttcagaggtggaagccccaagccttggcagctcccacatggtgttaagcctgcaggtgcacagaagtcaagaattgaggtttgggaacctccacgtagatttcagaagatgtatgaaaacgcctggatgcccaggcaaaagtttgctgtaggggcagggccctcatggagaacctctgctagggcagtgtggaagggaaatgtggcatcagagcccccacacggagtccctactggggcactgcctagtggagctgtgaaaagagggccattgtccttcagaccccagaatggtagaactgctgataacttatacaccgtgcacctagaaaagctgcagacactcaacaccggcacgtgaaaccagccaggaggggcgctataccttgcaatgccacaggggcggagctgcccaagactatgggaacccgcctcttgcatcagtgtgacctggatgtaagacaaggagtcaaacgagatcattttggagctttaagatctgactgccctgctggatttcaaacatgcatggggcctgtagccctttgttttcgacaatgtcacccatttggaatggatgtatttatccaatgcctgtacccccattatatctaggaagtaactaacttgcttttgattttataggctcataggcagaagggacttgctttgtctcacatgagactttggacggtgaacttccgagctaatgctgaaatgagttaagactttgggggactgttgggaaggcatgattggttttgaaatgtgaggacatgagatgtgggaggggccaggggtgatagggtttggatacattctcactcaaatttcatgttgaattcccacatgttgtgggagggacctggtgggagatatctgaatcacaggggcaggtctttcccatgctgttctcattatagtgagtaagtctcatgatatctgatggttattataaggtggagttttcctgtacaagctctttgcttgctgccatccaagtaagatgtgacttgctcttccttgtcttctgccatgattgtgaggcttctgcagccacatggaactgttaagtccaattaaacctctttcttttgtaaattgccagctttgggtatgtctttatcagcaccatataaacggactaatacaattagcttaatatgaagaccagaaaaggacctcataaagaaagaaaactacagactaacgattcttatgaatattgttgcaaaaatttgcaacaaaatactagcaagttgaatccacaagcatacaaaaagaattataggctgggcacggtggctcacgactgtaatcccagcactttggaaggctgaggcaggcagatcacaaggtcaggagatctagaccatcctggttaacacggtgaaaccccgtctctactaaaaaatacaaaaaattagctgggcgtggtggcaggcgcctgtagtccctgctacttggaaggctgaggcaggagaatggtgtgaacccgggaggcagagcttgcagtgagccgagatcgcgccactgcactccagcctgggcaacagagtgagactccatctcaaaaacaaaaaacaaaacaaaacaaaaaagaattatataccaggaccaaataagttttatcctaggaatgaaaggttggttcaacatcccaaaataaattgatgtaacaaattatatcaatagaatgaaaaccaaaagtcacatgattatctcaaaaacacagagaaagcattttactaactccaacaccctttcatgataaaaatcacaaaataatctaggaataaaagtgaacttcctcaacctgataaagaatatctacaaaaacccacagctaacattatatttaatggtgaacaactgaaagatgttctccaaaaaagatatctgttttcactacttttattcaatatggtactggaggctctagccaggacaattaggtaagaaaaagaaataaaaagcatccagattggaaaagaaaaggtaaaactttctctatttgcaaattatattttcttatatagaggaaatcctaaggaagccattataaaaacattaagaataacaaacaagttctgcaaggttatagaatacaagatcaatgtacaaaaatcaattatatttgtatacactcacaatgaatcctaaaatgaaattaagaaaaggttttatccacaatagcataaaaaagtattaaatatctaggaataagtttaacaaaatcaacccaaaatttatagtctgcaaactacgaaacattattttaaaaattagagatgatttaaataaatcaaaaaaactcatgctttgggatcaaaagacttctcattgttaagatgccaggaacctctaaactgagcaacaggtgcaacacaatccctgtgagaaactcagctgattttagaaattggcaagctgatcctaaaattaatatggaatttcaaaaagcccagcataaacaaaataattctggaaaaggaaaacaaaaaagaaagattcatacttcctgatgtcaaaactcactacaagactgtgtggcactggaaagaggacagatatagatcaatggaaaagaattgagagtccaaaaatacacccatacctttatggtcaattggtttttgacaaggatgccaaggccatttaatgggaaaaatcatcatttcaacgaatggcaactggatagccacatgcaaaagaatgcagttggacgcttatctgatgccatttacaaaaattaactgaaaatgcatcaagagttaaagtacaaaactcttaggagaaaacatggggataaagcttcataaccttggatttggcaaaggatcaataagtatctgttgaatagaagaaccagaaac

SEQ ID NO: 71 - DNA, 5107 bp, Homo sapiens
  source 1..5107: mol_type = genomic DNA
tgccatctcaaaacatgtgtattttaatgagacaacaaagatcaagggaactttagtccttacaatgtaatgatcaaaaaagtgaaatagataatcaacataacattgcttgtagaccatgcaaacaatcttattgcatttgtatatttgtaatgaactgttttataataacaaaatgtaaaatgtgtattttatttgtccttttattgttttcctacttcttagacatgttaagaactatggaaaaagatatgggagtttgtgaaaatttaaataattcatatttatattacaagaaacagatattagaatatgtttgttttatatttcttttgtagcagaattttctagccaggcattgtggcttacacctgtaattccagcactttgggaggctgaggtgggacaatcacttaagcccaagagtttgaaatcagtgagggcaacatagtgagactctatctctacaaaaaattctctatctatatctatataaaggaattttgtgaggaaaactatatattttgtatataaatgaattttatcaggaaatatatctgtaaatgaattttataaaatatagcatcactttatccttgatttatttcatttaataattattttaaagtaatatactaataaactcattttaaaaactgctatgaccataaaactattagagataacataagagaaaatctaggtgaccttgggtttggagataactttttatatataacaccaaaggcgcaatcaatgaaaaaaaatgacaagctctatatcacatatcaatattaaaatgtgatctgtgaaaggcatcgtcaagagaacaaaaagacaagccacagactgggagaaaatatttgcaaaagacatatgtgataaaagacaattatcaaaatatacaaataattcttaaaactcaaaaataagaaaatgaacaactcagttaaataatgggcaaaagatctcaacagaaaccccatcaaagaagaaacacagtggcaagcatatgaaaatatgatctacatcatatgccattaggaaattgcaaattaaaacaatgagataccactacatttctacattggtgaaaattccaagtactgacagcactctcagtgctggtgaggatatggtgcagtagaaatccacactcatgccgggcacagtggctcatgcctgtaatcccagcactttgggaggctgaggcgggtggatcaccaggtcaggagtttgagatcagcctgaccaacatggtgaaaccccggctctactaaaaatacaaaaattagcccggtgtggtggcgggcgcctgctactcgggagtctgaggcaggagaatcgcttgaacccaggaggtggaggttgcagtgagccgagatggcgccactgcactctagcctgggcgacagagcaagactccatctcaaaaaaaaaaaaaaaaaaaagaggccaggagtggtggctcacacctgtaatcccagcactttgggagactgaggtaggcggatcacttgaggtcaggagttggagaccagccttgccaacatgacaaaaccctgtctctactaaaaccacaaaaattagccaggagtattggcacatgcctgtagtcccagttactcgggaggctgagacaggagaatttcttgaacccgggaggcggaggctgcagtgagccgatatcgcaccactgtactccagcctgaacgacagggcgagactctgtctcaaaaaaaaaaaaaaaaaaaaaaaaaaggaaagaaagaaagaaagaaaaaagaaaattccgtgattgcagtctttacgtatttatttgttattaagtacagtaaaataaagaaggatagatgtcatggaaaatgtcacgaaaataaaagagttaaaaaaaaaaaaaagtaggctgcaatgccagatgcctgaaaagttaatcaacgaaaggacttaaatgtccccattgaatttaggaacaaagaagtaattaatgaactgggcaaaaacactcaatgtaccagcgttatcgatttagaaactgaaactaagtatatctgatgttgcttttaggaaacaagtaaatgaggtcctaaaaagttaaactgtgaccatattttctttcctttttctaatttctccttgggccatttccaaaaagccctaataccccgactgatagaaatggataccttgctgtgcactggtactactgtgattcatggaaagctgatcatgcaacccaagacgccaaaattcccagccttactgttacgaaagaaagtttctaagcacaattgtctctagccaacttcctcttagtaagaaagaggccaggcagggcttcatgcagggtacagccctgagtttcttactgcgtggtaagtttctggggctgggagtaaagcagcgtgaccgaaagcagtacaaagttctaccggacacgcagatcccggtcctacaaatatgaggtccataatgagactgagatatcattcatccaacaaatatttattgaataccaaacattgggcttacggctaaaggaaaatacaaagttgtgttggatatgggttctgttttcaaggagcttataatctaataggaaagatgaggttactacattagtagcaatcagaccagatagaactggaagtgtgatgtaaatgaggtacagattgattgtagaattttgcagaaagaaaacaattctgaagaaatgttcatggaagtattagcagttgagatgtatcttaaaagataagtggggttcctgttggaaacattcaaaactctctcttctagctattttaaaatacgcaatatattattaactatggtcaccttactgtgctatagaacactagaacttattcctactatctaactataattttgtacccactaaccaacctctccctgtccctcctccccctattcatcccaccctctggtaaccactgttctactctctgcttcccaaaacaaagaaatgatcactgtttcggtgatggagatgtcaattaccctgatttgatcattacacattgcatacatgtatagaaatatcacatgcaactcttaagtatataccattcttatgtaccaaatacaaataaaattgaaaaaaaaaaaaaactttggctgggcgcggtaggtcatgccagcactttgggaggctgaggcaggcggatcacctgaggtcaggagttccagaccagcctggccaacatggtgaaacccaatctcttctaaaaaatacaaaaattagcttggtgtggtggcaggggcccgtaatcccagctactcaggaggctgaggcaggagaaatgcttgaacctggaaggcagaggctacagtgagccgagatcatgccactgcacttcagcctgggtgacaaagcaagactccatctcaaaaaaaaaaaaaaaaaagcctcctgagtaactgggactacaggcatgcgacaatactcccggctctctttttaaaaatgagaagtagaagtagtggtgactgtcaagaaagtattttggaaaaatactatgaataaccagaccaaagaaaccaaataccagttgtttcaggagcagtaaatcatttttgagggcttgagcaaaggtcttgctagaaaggtgcttaggggtcagattttggacataatgccaggccaagaaaatttgcactttatttcattaacaatgaggagctcttgaaagttttattggcaggacctaagatagttacagacccacaagtaacatgggtctagaccttgggaacaagaaaagtcaagatcgagtatgcagacttgggaaccgagtataactaatggttaagattaaataaaaatacataagaacactgagatagagaaatggctcattaatgctgcaaatgtctgcatgtttagggatgaaatagaaaaagaagtcagaaaaatacagttcaaacaataggaaagaaaaccagaaatgcatgattctaagaaatgaatgggtggacatggtggctcacatctgtaatcccagcactttgggaggccgaggcagaaggatagctacagcccaggagttcaagaccacccagagcaacacagcaaaaccccatctctacaaaaaacaaaaataaaaattagccaagcatggtggtacacacctgtagtcccagctactcactcaacaggctgaggcagaaggatcacttgagcccaggaggtgaaggatacagtaagctatgattgcaccattgcactccagcctggctgagagaatgagagcttgtttccaaaaataaaaaataagaaagaatttttagaatgagaggaaaacaacatgaaacatgagaaaaataacattccctgttatatggtaggtgcttcgcttatagtttctcattaattcatcatgtaatgtctctgggataaacattatggatttcctgcagaaacagaagctcagaattttatgccaggtgttgaaaggccatgtagctaatagatgatagaacacagactcacactctggtagtcctgagttaacagtagaaaagtcctgggctgggcgtggtggttcacgcctgtaatcccagcattttgggaggttgaggcaggcagatcaccagaggtcaggagtttgagaccagcctggccaacatgactaaagcctgtctctaccaaaaccacaattacccagcgtggtggcgggcacttatagtaccaactactcaggaggctgaggcagaagaattgcttgaacctgggaggtagaggtttcagtgaggcaagatcaagccacggcactccagcctgggtgacagaatgagactctgtataacaaacaaacaaacaaaatcagtaagaaagtcccagactaagaggcatcaaatcaggattctactccaactctgatgccagcttccaggaatacacttgataagttgtttcattcccataaatcttgggtgattcgtgtttaatgagagcattgaactgaatcatttattctatgactcagttctaatatttcacaattctatggttgtataatattacaggaaattcttgagaaggtgcagagggaatggatgaaaaaaaccacatgactaacataaa

SEQ ID NO: 72 - DNA, 4633 bp, Homo sapiens
  source 1..4633: mol_type = genomic DNA
atgatcacaagaagaaactgtgctctaaaatgaaccaatgaacaatatgtgtcgggatagacacacattaaacaataatataagtatctgcacaatatgtatctcaaattatcattttaaggtattatgagtattttaacacactggaaaatttacttgctaacagtttcttccattcacactggttaccttttgaatttatacttttgtactcatgctaccatccctcaaaatgtttcttggaaagctctcttaaagtaggttttagaacctccagcaggttattttttaaattcttgcacatggatcatgagtttgatttttgaaaacagtgagaaaaaaactcagaaacaaaaggaaataatggaattctgaaaaaattatgaattaattttggtagagttataaattcaaatgcctgcaagtgctgggtaggtaatgtaaagtgagtacagacagcatgctggacactgtagtagctggagagttcaggctatgtctaaaggatgctggaatgcaggatcagcatagcctggttttccagtcttgcagcctaggctgaaaatttacctattgtctggaccatctcaatgttttaaatgttggctcagttctttaaacacttgatttgcaaactctgctttacaatagtacattttcatcgtgcttatattctatgcagatttttcttaaacttttcataaatataaatgtcttcacactatttttttctcactaattcatcaatagcatatgacaaagagtgagaggcagaatggaaagatatcatatggtcttcccccatataaaatagcattttccttctactttaccctcacatatttttgccatcacattatcagcatttgacagattgtgcatttacttatttgtctttttcgctactgtaacctaagctctatgaagatttttgttgttgttgactgatttatacttagttcttagaatatttattggcaaataatagactcttaataaatattcattgaatgaatgaatattacacagataggcaactatatggaagaagtaaccagggaattatggatatttaactttgacaagaaaatacacaatcaggaatacatccgatggtatgttggagctggctcatactggcctgcaagaggtgatggtgtgcatctcttctcagctctgcatacagtgacgtcccattggttggctgaagtaagccatagtgagattaattccacctcagaaatcagcaaatgatacaaatattgtctcatttaccagcatactattggatacaagagttatgatatattggcttagtcaaaagaagcattttctaacatttagagctctctaacaacagaatggcctatctcacagtatttggtcctgcattaaagtttcacttactggaacttaacatcagctgtccccaatctttttggcaccagggactggtttcatggaagacgatttttctacagatgagggaagctgatgggtttgggataaaactgttccacctcagatcatcaggcattagttacattcttatacggaacgtgcaactagatccctcacatgcacagttcacaatagcttactgctcctatgaaaatctaatgcctcggctgatctgacaggaggcggagctcaggcggtagtgctctcctgcccgctgctcgcctcctgctgtgcggccaggttcctaacagactaggaacccatatccttccgtggcctgggggttggggacccttgctatacatcataaaacttattcaagcttgtagaatcgctgggacataagatattttgctcctttgaatatagtgtcatttttcctatggctgcttttaagatttttctaatcgtcattggtttttctaatgttttaatatggtatgtccaggtttggaattatttttatttataatttttaataatattttagtcatttactttagattcttagaacttcttgaatttgtggtttggtatcttttatcagttctagaaaatctcagttattatttctttaaatattttctctgccacattcactttgttctatttctgagatgttacactttctcattgtaccctcaaagtcccttccccttcctctatatttttccatccctttgtctactatttagtttcttctaatcttgcttctagtttattaattctttctttaactatatctaatcaaattataaatcccatagaaatttttttgcaaagttattacatttttctgttatttattttctatttggttgttttccaaatttgctatgtcaacttttatagtttatagcaccatactgaaatatttatacttgatattttatttttttctaaataatataagcatttatgtttttatagccttatacttcatttataataagcgtagtatatcaagaatagtatatatcaagcatttgtgggtatgtttctatttcctgttgtatcaacttggtttcattcctggattcttatttcctgtattcctgtttaagtgtgctggacattgtttttgagcattatttgtaagaataattggaaatctatgatgacaagcatattccttcaaagaagacttttgtttactttttccaagtaactggaaataatagtctgggaccatcttaatctcagttcaagctttaagattttctggattatccagatgacaaacgaccaggctaaaagtctggaaacattggtttatttatagttactgtttatgatggaagtacaacatttttatgtctcagtttaatgaaataaatgattaattagagtctccatttttagtggaacccaggctttgacttttcccttatagccccatgacattgcagaaagctcagctccacttcagagccttttctctgcagtgttagaatttacttattttggagttcttgtcttctcactggctctgctctgttaattctccaccttcttgttaactcatagctgcttttaagattttatttttatttcacttaatttgttgttttcctcatttaaaaggcttttctgaattctgagttctccatcactctaaattgaacagagattaatattttgagaatttgtatgtcttaaaatactcttatccttatttcactcttctacttaatggatagtttggttggttataaactactgtgctaaaataatttttcttagattttttgaaggcattctccacagttttctagattccagtattggtgttgagaagtctaactctagtcttagttccaatactttggctttatttcttcttagtgtaagctattaggattatacctttgtccttaatattttgtaaactttcatgataatgggccattctatgggtttcatttattgtgctttaatctctctaagtgtggaaatttatgtcctacaactgtggcaagctttctttgataaatttttattctccattttcttcctctcctcccctgaatcttccattagtcagataatgaggcttcctaggatgattttctaattttttatactttctcttctattacccacacttctctttttgttttaatgtgtgagaggtttctctgattttattttctaattcttctactggatttaaatttctgatgtatattttaatttccaagagctcttattctctgttcctatttttgtatatcaatctgctttgtttatttgtttgttttgttttgttttgtttttttgaaacaaggtcacattctgttgcccaggctggaatgcagttgcacaatcatggctcactacagccttgacctcctgggctcagttgatcctcccacctcagccacctgtgtagctgagactacaggcatgtgccaccatgctcaactatttttatttatttttggtagagatggggtttcgcatgttggccagttggccaggcttgtctcgaactcctggtctcaagccatctgaccaccttggcctccaaagagctaggattacaggtatgaaccaccatgcccagccaacctgcttttttttatggctgtggtattttcttttttgttgagagagagacagagagagagacagagaaagagagagaaacagagagagagagagagatatttaaatgccaattttgtgcttgtattatctccatatatttgtctttttttcctcttcctttatttttttctgtttctgtggttaaaagcagagaagattcttcctgtttcttagaagggggtagttgggataagcctagctatcaatggtgggagagaagagtctgaaggcctactcttcagcatgcagactttccttaacccccttgatttcctctgtccacaattgtccttcctgtactcttcttgctattccaaagttgagtctctcaggttctatttttcactaaatttcagactcctgtgaggcaattgggaagatgaatggaaacagtcatagcttatctttgtatggcagagttgtgagaatggaatcaacactaagctgcatagatacttgtcttcagaatcttgatttttagccacaatcctcactcccaccttctatacaacctgaaaaagagctttttgctaagagaaacccattgtcttctaattagatc

SEQ ID NO: 73 - DNA, 9640 bp, Homo sapiens
  source 1..9640: mol_type = genomic DNA
aagatattttatctttgttttctcaccctctcacaagagtgagaggggctgtcttttgtcattcataataagctcctttcaaccataccagaatttatactgatcaggtgactcttggtgggagcctagatagcttcaggatgggagctggttgccgaaaaaaccaaccaagtgattagatgtttggaaatttctgcctgacccctgacttacgggagggctgcaaggagagagggggtagagatttagttaagcacaaatgtccaaagacttaatcaatcatgcctatgtaacagaatcaaccataaaaattctaaatgattagggactgctctcaagcttatattctatctataagcaacgggataatttgatagaaaataggataacacaggaaaatgtctgtgaaaattgctatgaggacaacaatagagagctactgatagagaacgactgagaagctactttagattgacattcaagaaggcccaaaagacattttactgaagtctaaatgatataatggggccaaccatgtgaatggctatctgggaacatacactccacaaaaaggaaaaaaaaagattaaaatatcttgattcaacttctcaaattttctaaaacactgaagaaaagagaacacttccacactcattttaagaggcattattctgatatcaaagccagacaaagttaccacaaaacaactaagaccaatatcccttatgaacattgatacaaaaatcctcaacaaaatatagcacactcacttcaacaggattgtaacaggttatacactatgaccaactggaatgtattcctggaatgcaaggttgattcaacatacaaaatcgaacaatgcaatacaccaccttaacagaatggagaagaaaccacatgatcatttcaaatgaaaacagaaaaagcatttgattaaatttaacttcttttcataaaacacacaactaatatgaatagaaggaaactatctcaccatagtaaaagccatatacaaaaaacccaaagtaaatgtcatactcaaagcagtaagactgaaagcttttccacaaagatcaggaacaatgaaaggatgctattaggttggtgcaaaagtaatcgcagtttttgccattttttttttaaagtaatggcaaaaaccgaaattacttttgcaccagcctaatacttctgttacatatagtactggaggttctagacagagcaattagggaagaaaaacaaataaaggcatccaaactggaaaaaaagaagtaaaattatctctgttcacagatgatatgatcatatatgtagaaaattctaaagattccacaaaaaaaacctattagaactaataaatagggatggagacaagacggctgaataggaacagctccagtctaaagctcccagcgtgagcattgcagaagacacatgatttctgcatttccaactgaggtaccagattcatctcactggggagtatcggaaagtgggtgcaagacagtgggtacagtgcactgagcatgagctgaagcagggcggggcatcacctcacctgggaagtgcaaggggtcagggaattccctttcctagtcaaagaaaggggtgacagatggcacctggaaaatcaggtcactcccaccctaatactgtgcttttccaatggtcttagcaaacggcacaccaggagattatatcccgcgcctggcttggagggtcctacacccatggagcctcgctcactgctagcacaacagtgtgagatcaaactgcaatgcggcagcgaggctgggggaggggcgcctgccattgcccaggcttgagtaggtaaacaaagcagccaggaagctcaaactgggtgcagcccaccacagctcaaggaggctggcctacctctgtagactccacctctgggggcagggcatagccaaacaaggcagcagaaacgtctgcagacttaaatgtccctgtctgacatctttgaagagagtagtggttctcccagcacacagctggagatctgagaacagacagactgcctcctcaagtgggtcactgacccccaagtagcctaactgggaggcagccccaagtaggggcagactgacacctcacacagcccggtactcctctgagacaaaacttccagaggaacgatcaggcagcaacatttgctgttcaccaatatccactgttctgcagcctccattgctcatacccaggcaaacagagtctggagtggacctccagcaaactccaacagacctgcagctgagggtcctgacagaaggaaaactaacaaacagaaaggacatccacaccaaaaccccatctgtacatcaccatcatcaaagaccaaaggtagataaaaccacaaagatgcagaaaaaacagagcagaaaaactggaaactctaaaaataagagtgcctctcctcctccaaaggaacacagctcctcaccagcaatggaacaaagctagacagagagtgactttgacaagctgagagaagaaggcttctgatgatcgaactactccgagctaaaggagaagtacgaacccaggcaaagaagttaaaaaccttgaaaaaaaaattagacaaatggctaactagaataaccaatgcagagaagtccttaaaggacctgatggagctgaaaaccaaggcacgagaactacgtgacaaatgcacaagcctcagtagccgattcaatcaactggaagaaagggtatcagtgatggaagatcaaatgaatgaaatgaagtgagaagagaagtttagagaaaaaagaataaaaagaaatgaacaaagcctccaagaaatatgggactaggtgaaaagaccaaatctatgtctgattggtgtacctgaaagtgatggggagaatgaaaccaagttggaaaacactccgcaggatatcatccaggagaacttcctcaacctaccaaggcaggctaccattgaaattcaggaaatacagagaacgccacaaagatactcctcaagaagagcaactccaagacacataattgtcagattcaccaaagttgaaatgaaggaaaaaatgttaacagtagccagagagaaaggtcgggttacccacaaagggaagcccatcagactgacagctgatctctcggcagaaactctacaagccagaagacaggggggccaatagtcaagattcttaaagaaaagaattttcaacccagaatttcatatccagccaaactaagcttcataagtgaaggagaaataaaatactttacagacaagcaaaggctgagagattttgtcaccaccaggcctgccctaaaagagctcttgaaggaagcaataaacatggaaaggaacaaccagtaccagccactgcaaaaacatgccaaattgtaagaccatgaatgctaggaagaaactgtatcaactaacgagcaaaataaccagctaacatcataatgacaggatcaaattcacacataacaatattaaccttaaacgtaaatggactaaatgctccaattaaaagacacagactggcaaaattggatacagagtcaagacccatcagtgtgctgtattcaggaaacccatctcacgagcagagacacacataggctcaaaataaaaggatggaggaagatctaccaagcaaatggaaaacaaaaaaaggcaggggttgcaatcctagtctctgataaaacagacgttaaaccaacaaagatcaaaagagacaaagaaggccattacataatggtaaagggatcaattcaacaagaagagctaactatcctaaatatatatgcacccaatacaggagcacccagattcataaagcaagtcctgactgacctacaaagagacttagactcccacacaataataatgggagactttaacaccccactgtcaacattagacagatcaacaagacagaaagttaacaaggatatccaggaattgaactcagctgtgcaccaagcggacctaatagacatctacagaactctccaccccaaatcaacagaatatacattcttttcagcaccacaccacacctattacaaaattgaccacatagttggaagtaaagcactcctcagcaaatgtaaaagaacagaaattataacaaactgtctctcagactacagtgcaatcaaactagaactcaggattaagaaactcactcaaaaccgctcaactacatggaaactgaacaacctgctcctaaatgactactgggtacataacgaaatgaaggcagaaataaagatgttctttgaaaccaacaagaacaaagacacaacataccagaatctccgggacacattcaaagcagtgtgtagagggaaatttatagcactaaatacccaaaagagaaagcaggaaagatctaaaattgacaccctaacatcacaattaaaagaactagaaaagcaagagcaaacacattcaaaagctagcagaaggcaagaaataactaagatcagagcagaactgaaggagatagagacacaaaaaacccttcaaaaaattaatgaatctaggaactggttttttgaaaagagcaacaaaatagaccgctagcaagactaatagaaaagagagaagaatcaaatagaagcaataaaaaaatgataaaggtgatatcaccaccgatcccatagaaatacagactaccatcagagaatactataaacacctctacgcaaataaactagaaaatctagaagaaatggataaattccttgacacatacaccctcccaagactaaaccaggaagaagttgaatctctgaatagaacaataacaggctctgaaattgaggcaataattaatagcttaccaaccaaaaaaactccaggaccaaaaggattcacagctgaattctaccagaggtacaaggaggagctggtatcattccttctgaaactattccaatcaatagaaaaagagggaatcctccctaactcattttatgaggccagcatcatcctgataccaaagcctggcagagacacaacaaaaaaaaaagagaattttagaccaatatccctgatgaacatcgatgcaaaaatcctcaataaaatactgacaaaccgaatccagcagcacatcaaaaagcttatccaccatgatcaagttggattcatccctgggatgcaaggctggttcaacatacgcaaatgaataaacataatccagcatataaacagaaccaaagacaaaaaccacatgattatctcaatagatgcagaaaaggcctttgacaaaattcaacaacctacatgctacaaactctcaataaattaggtattgatgggatgtatctcaaaataataggagctatctatgacaaacccacagccagtatcatactgaatgggcaaaaactggaagcattccctttgaaaactggcacaagacagggatgccctctctcaccgctcctattcaacatagtgttgaaagttctggtcagggcaattaggcaggagaaggaaattaagggtattcaattaggaaaagaggaagtcaaattgcccctgtctgcagatgacatgattggatatctagaaaaccccatattgtctcagcccaaaatctccttaagccaacaggcaacttcagcaaagtctcaggatacaaagtcaatgtgcaaaaatcataagcatttttatacaccaataacagacaaacagagagacaaatcatgagtgaactaccattcacaattgcttcaaagagaataaaatgcctaggaatccaacttacaagggacatgaaggacctctttaaggagaactataaaccactgctcaatgaaataaaagaggatacaaacaaatgcaagaacattccatgctcatgggtaggaagaatcaatatcgtgaaaatggccatactgtccaaggtaatttatagattcaatgccatccccatcaagctaccaatgactttcttcacagaattggaaaaaactattttaaagttcatatggaacccaaaaagagcccgcactgccaagtcaatcctaagccaaaggaacaaagctggaggcatcacactacctgacttcaaatacactacaaggctatagtaaccaaaacagcatggtactggtaccaaaacagagaaacagaccaatggaacagaacagagccctcagaaataatgccgcatatctacaactacctgatctttgacaaacctgacaaaaacaacaaatggggaaaggattccctatttaataaatggtgctgggaaaactggccagccatatgaagaaagctgaaactggatcccttccttacaccttatacaaaaattaattcaagatggattaaagacttacatgttagacctaaaaccagaaaaaccctagaagaaaacctaggcaataccattcaggacataggcatgggtaaggacttcatgtctaaaacaccaaaagcaatggcaacgaaagccaaaattgacaaatgggatctaattaaactaaagagcttctgcacagcagaagaaactaccatcagagtgaacaggcaacctacagaatgggagaaaatttttgcaatctactcatctgacaaagggctaatatccagaatctacaatgaactcaaacaaatttacaagaaaaaaaaaacaaccccatcaaaaagtgggcaaaggatatgaacagacacttctcaaaagaagacacttatgcagccaaaagacccatgaaaacatgctcatcatcactgaccatcagagaaatgcaaatcaaaaccacaatgagataccatctcacaccagttagaatggcaatcattaaaaagtcaggaaacaacaagcgctggagaggatgtggagaaataggaacacttttacactgttgatgggactgtaaactagttcaaccattgtggaagtcggtgtggcgattcctcagggatctagaactagaaataccatttgacccagccatcccattactgggtatatacccaaaggattataaaacatactgctataaagacacatgcacacgtatgtttactgtggcactattcacaatagcaaagacttggaaccaacccaaatgtccaacaatgatagactggattaagaaaatgtggcgcatatacaccatggaatactatgcagccataaaaaatgatgagttcatgttctttgtagggacatggatgaagctggaaaccatcattctcagcaaactattgcaaggacaaaaaaaaacaaacaccgcatgttctcactcataggtggaaattgaacaatgagaacacatggacacaggaaggggaacatcacacaccggggcctgttgtggggtgtggggagtggggagcgatagcattaggagatatacttgacattaaatgatgagttaatgggtgcagtacactaacatggcacatgtatacatatgtaactaacctgcatgttgtgcacatgtaccctaaaacttaaagtataataaaaaaagaactaataaataaattcaacaaagtagcagtatacaaaatcaacccaagaaaatcagatatatttttatacattaccaatgagcaatctgaaaaggaaactacaaaaaaaattctatttacaatagaaatagaatttctttattttaaagaataaaatacttaggaattaatttcaccaaggaggtgaaatatctgtacaatgaaaactacaaaacactgctgaaaaaaaattttaggacattaataaataaaaacctatcatatcttcatagataagaaaatttaatgtttttaagatgcccatgctacccaaagcaacctacagattcaatgtaatccctatcaaaatcccaatgatgtttattgcagaaatagaaaaacttatcctaaaatttgtatgaaatctcaaggggccccaaaacaacactgaaaatagaagaacaaagctaaaattctcatagttcctgatttcaaaacttattacaaagctatagtaatcaaaacaatgtgatattggcataaacacagacagatagatgggaggaacagagtagaaaacccagaaataacccttgtatatataatcaaattattttcaacaagagtgtcaagaacattcaataggaaatgaacagtattttcaagaaacagtgctggcacaactggatatccgtgtgctaaagaataagtagaatccttacctagcaccatatacaaaaattaattgaaaatgaatcaaagacctaaacataagacctaaaactataccactcttgggaaaaaataaaacagggcaaaaacctcatgataccagatttggtaatgatttctcagatacgaccaaaaaggcacagagaacacaagaataaaacagacaaattggacttcatgaaaattaaaaaaaaaaacctgtgcatcccaagacaatatcaacagagtaaaaagacaacccacagaatgggagaaaacatttaaaaattacgtatctgataagacattaatatacagaatatatagagaactcctaaaacttaacaataaaaaaatcaaattcaaaaatgggtaaaggactcgtatggacatttctccaaaggtatacaaatggccaagaggcacgtggaaagatcctcaacatcaccaatcataagacaaatataaatcaaaaacataatgagataccacttcacacccattatgacggctattatcaaaagacagaaaagaacaaatgttggcaaagaagtagagaaattggaaactttgtgtatagctaatgggaatgtaaaatggtacagcctctgtggaaaatagtatgaagattcctttaaaagttaaacataaaattaccttttgacccagcaattccacttttgggtaaatactcaaaagaattaaatgcagggtctcaaagaggtgtttttgaacaagtttcacctcacgatgaacgtacacccatgttcatagtagcattattcacaatggctaaaaagtggaagcaacccaaatgtcattcgacagacaaatgaataagtaaaatgtggtagaaacatacaatggaattttattcagccttaaaagggaaggcaattctgcaatatgctacaacatggctgaaccttgagtacattatgctaaatgaagtaagtcggtcacaaaaaaaggcaactaatgtatgatcctgcttatatgaaatactcagagttaccaaaatcacacatctagatagacagtagaacagtggttgccaggggccgaggtagcacacaatggacagttagtgcttaatgggtacagagtttcagtcttacaagatgaaaagagttagggggatggataatggggatgcttacacaactttataaatgtatttaatgccactgaactgcacacttaaaaatggctaagatggcaaattttgtttatgtgtatcttggcacaataaaaataaaactgagggggggaaatgccttgattcaagaaaaagctcaccatatttgagttgaataaagaaggctgaagtttaatgcaccagaagactagctctagatgagatctgagagacaggcaaggaccagatcatgtaaggctttcctggccataggtaagcagtctggattatctgaaaattccggtacttccagg

SEQ ID NO: 74 - DNA, 15072 bp, Homo sapiens
  source 1..15072: mol_type = genomic DNA
aaattaagacacaaaaaattctgaaaaggctctggttgaattaaaaaaatcagtggggcatatttgtgtgggtctatttaattcattcctttttattactgagtagtattccatcgtatggctataccacaatgtgtttataccttcacccattcttgaacatctggttgtttctagctttgggttattgtgaataaaactgctgtgaacattcatgccagctattgtgtggacacatttttctttctttcttttttttttgggggggggacggaatcttgctgtgttgcccaggctggagtgcagtggcacaatctcggctcacttcaagctccgcctcctgggctcacaccattctcctgcctcagtctcccgagcagctgggactacaggcacccgccaacacgcccagctaattttttgtatttttagtagagacggagtttcaccgtgttagccaggatgatctcgatctcctgacctcatgatccacccgtcttggcctcccaaagtgctgggattacaggtgtgagccaccgtgccccgccgacacgtttttatttcttttgggcaaacacctaggagtgagattgagggattgtatggtaactgtatgtttaactttacaagaaacttgataagaaattgccaaactggtttgctggtgagaatgctgtgggtgaaggattacctaggtgccgaggcaagagactgaaggcaaaaactgtttcagtataataaaatagttagaataagaacagttataatacaaattagatatagagatgatcgtggacattatcaataattagcataaacattattaatcattagtttttaatattactctttgttgtattactaatataaccaaggaataaccagcgggtatagggttaggtgctgaagggacattgtgagaagtgacctagaaggcaagaggtgaaccctctgtcatgcccgcataagggccgcttgagggctccttggtcaagtggtaacaccagtgccttggtaggcacccgtacttagcagaccgtgaaagagagtcttcctttccttggaggagtcagggaacactctactccaccagcttcttgtgggaggctggatattatccaggcctgcccgcagtcatccgcaggactaaacccctccctgtgatgctgtgcttcaatggtcatgctcctggtccactttcatgttcctcccgtactcctgattcctctttgaagttcttagaagataatggtagaagaaatagtgaaagtcttaaagtctgtgatctttctgataagtgcatagaagaaaacgctgacgtatgctgccttccctctctgcttcagctacctaaaagagaagggccccgtgtcctacgatcacatgacttgcttggccttatcaatcacttagatgactcaccctccttaccctgcccccttgtcttgtatacaataaatatcagtgtgcccagccattcagggccactgccagtctccgcgtcttggtggtagtggtcccccaggcccagctgttttatctttatctctttgtctcgtgtctttatttcttatgatctctcatttccgcacatggggagaacacccacaaagccccgtagggctggaccgtacagaatgcaaaaaccattttgtattctcaccagcagtaactaagagttccagttgttctacatctttgtcaacactttttattgtcagactctaattctagccactctagtgggtgtgccctagtatctcatattgactttaaaatgcattttcctaatgcttaatgatatattgagcatttcttcatgttcttacttgccatttgtatatctttgcatcttttcctcatttttcattgggttctttttcttattagttgtgtgtttttaaaataccacgtaagtattttgagggagattatctcaaaggaaccctaaagtggttttttccagcctcaaggaaacttaggtctttaagaaaataaaacttgctccttatttttaaaaaagagggagaaaaataaatctcctaatttatttggtgtatctatttgaatgtccatgtacagcactaagttgtttaaagaagatatatgacaaagtagctaaaaaacatggctggatatggtggctcacacctgtaatcccggcactttgggaagctgaggtggatggattgcttgagcccaggagttttaaaaccagccttggtaacatgacaagaccccatctcaaaaataaataaataaataaaaataaaaagcataatgcttactattcatcatttggtgaattaaagtgaatgcaatattttggtgattcattttgctgatccaatgtgaatgacaactcttttaagccacatgttaccatttattgaataactcttcttaatgacttttctgacccctctcaaaggtaataattcatttctctacctttgaaaagcctctctgtatcttgttaccattttattgaataactcttcttaataacttttctgacccctcccaaaggtaataattcatttctctacctttgaaaagcctctctgtatcttgcagtacgcctcctctagaaatggcaggaagtccttggccggcgcggtggctcacgcctgtaatcccagcactttgggagtccgaggcgggcagatcacgaggtcaggagatcgagaccatcctagctaacacggtgaaaccacgtctctactaaaaatacaaaaaaatacaaaaagttagctgggcgtggtggcggacgcttgtagtcccagctactcaggaggctgaggcaggagaatgccgtgaacccgggaggcagaggttgcagtgagccgagatcgcgccactgcactccagcctgggcgacagagcgagactccatcgcaaaaaaaaaaaaaaaatcagttttatttacagcttaatgtgattgtatcacaactctttagaggcagtatggcatagtgaacagggattgggttttagagtcacttgcaacctctctgacttgatcctcagtttcttcatctataaaatagagattatgataccacatgtaatgtgaaaattaggactaggtaaacaaagtgcctgctgctatgtttggctcaataaataataactattattctcatgttttgatcttcctagtctacaacttaacctcttaaaaattagaaattggccgggcgcggtggctcacgcctgtaatcccagcactttgggaggccgaggcgggcggatcacgaggtcaggatatcgagaccatcccggctaaaacggtgaaaccccgtctctactgaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaattagaaattgtgaggccgggtgcagtggctcatgcctgtaatcccagcactttgggaggctgaggtggccacgtggatcacctgaggtcaggagttcgagaccagcctggccaacatggtgaaaccccatttctactaaaaatacaaaaattagccaggcatggtggtgagtgcctgtaatcccagctactcgggaggctgaggcaggagaattgcttgaacccaggaggtggaggttgcagtgagtggagactgcaccactgcactccagcctgggtaacagagtgagactccgtctcaaaaaaaaaaattagaaattgtgataagattttaactttaaagttatattttgttatagatcattttctgtaattggacatttactatgtgccaggctataactggacatttacttgtgccaagtgctttatatatgaaatctcacaaggcaggtaggttttcttattcttattttacagacaacagagacacacaaggatgaagtaacttgctcaggattcttcaggaagaggcagagtttgaattcaaactaaagccagattctgaccctggcattttagccactatggtttcctgcttcccacttttgtttttatttgcattccaagctttacctaatctaaaactcgtgttactttaaatctagcctcatctatgtttgcacgtatccttgcagatattatccatctacatcactggaattgttacgtgtataaacttgaacaatatgtgatctgtttagcacatccaggttttctctcctacaggacctaagatctagaagttgacttcatcaaattccattccatttcattctatttattctattttttttttttttttttagatggagtctcgctctgttgcctaggctggagtgcaatggtgcaatctcggctcactgcaacctctgcctcttgggttcaagcgattctcctgcctcagcttcccgaatagctgggattacaggtgcctgccaccatggctggcaaatttttgtatttttagtagagactgggtttcactatgctggccaggctggtcttgaactcccaacctcaggtgatctgcctgcttcggcctcccaaagtgctaggattacaggcgtgagccactgagcacagcccattctatttattttaatttaaaaatattgcctgggcgaggtggctcacacctttaatcccagcactttgggaggccaaggcgggtggatcacgaggtcaggagatcgagaccatccgggctaacacggtgaaaccacgtctctactaaaaatacaaaaaattagccgggcatggtggtgggtacctgtagtcccagctactcaggaggctgaggcaggagaatggcgtgaaccctggaggcggaggttgcagtgagccgagattgcgccactgcactccagcctgggcaacagagcgagactccgtctcaaaaaaaaaaaaaaaaaaaaaagcaaaaaattcccaaagatggtgtattagccattgtcaaagaaaataaattcttaaggattactatagagaatgaatattggtattggttaatataactctgatttttaattaaaataataaaaagaaatgaatgagtttgaatattatccttataactttttatttcttttgtttacctttaagccctttacaattgtaatttccaaattacaattttgattactgtttcagaaattaaaatcccctacaacacagcctctaatgattcccattttccattttaacctggcttcttccccgggcaagtgcccaacgaaatggatgattcttatttccatgacctgaaggtcaaagaactctagtcattccaaacctgtagcaggagggagcagattacaagaacaagagccttcctgcttctaaatcacatgcatacatgtttagctcagttctagttttgtttttttttttttttttttttttttgagacagagtcttgctctgtcgtccaggctggagtgcagtggcacaatcttggctcactgcaagctccgcctcgcgagttcatgccattctcctgcctaagcctcccgagtagctgggactacaggcgcctgccaccatgcctggccaattttttatatttttaatagagacggggtttcaccatgttagcccggatggtctcgatctcctgacctcgtgatctgcccgcctcggcctcccaaagtgctgggattacagcgtgagccaccgcgcccggcaagctcaattctagtttttaggtttgttttaaataattcacacattgagaaggtacatagacatttgatattggtaaaatattgagatagtattataaagttttatttatataatacgactttaaatcaaatctgcttgagacagggtcttgctaactagattgtgaactattcaaatcaaagacagttttcttctttgtattacccacagcaagtaaataatggaattctctttttttttattttatttgaggtggagtctcgatctgtcacccaggctggagtctggagtgcagtagcactatctaggctcactgcaacctccgccgcccagggttcaagtgattctcctgcctcagccttctgagtagctgggactgcaggtgcccgccaccacacctggctaatttttgtatttttagtagcgatgaggtttcaccatattggctagactgttctccaactcctgaccttgagatccgcctacctcggcctcccaaagtgctgggattacaggcctgagtcactgcacccggcctggaattctcaatagaatcatagaacctggactttaccactcatgtgctcccatttggcatttcaaatagcccagtgacaagagttcccaatgcaggcagcaactatttctactgttgaatacttctaattgtttttttttttaatgaatgaatgaaaggacagaagaaagaaaagaaaagaattataaatttgaactcaaatgtgataatttgcacacatttttcattttattcacagaatgattattgaagttctgaacacatcatttgtgtttcccttcagacctctcctctccaggtgaaaagtcagggtactttccactgtacctcaaggactggggagcctgtcagcatcagtgggttgggtgcagggtcttgggagactttttcaaactacacaactctctcaaacagtggaagctgacataccctcagagttagggcaagggagccccagttaaaggttaggttctcccagaagcaggtgctgagaaggagttgggaaaacaaaaggtttattgggagtaaatcctttaaagggaaagggaaggagaagaattgggcaagtggagccatcagaaagcactgcagacctgacagagtccgccatccccatgaggagccccagtgcagagactgcctgttacaggagtctggcactaagctgaaatggctaggcgtttgtaccaccctgttctgtcattggctaggggtcctcccaggaagagcaagctcttggcctaaaagctgatgcagattctaaaggagctgacagctggaggctgttgggaaaccacactctgtgtagctgggcagagagtcatttctttcctttttggtagagatgagatctcactatgttgcccaaggtggtctcaaattcctagcctcaagcaatcctccgacctcggcctcctaaatgctgggattacgggtgtgtgctactgcgcctggccatgggttatttcttgaagatggctgtgagcagcacgcatgtctttgtcttccctaaaaaggcaggaagggaagaatctgagagatagtttagagaagtcttgacaagggttggtgattggtcagatgtatagagggagaggtcaaagataaccttgatggctaggatagcattaacttcaacaaatgtggtttggctgagttataacctcttcacaccatgcctacagctgccttttactgaaagcagcctgcttatttattacacaggttgccatggcttgtgccatctgtgttgagtgaccaaccacactccttacctgcaatcgatagtgctggccaggggattgatctgcaggcaaaggcagcaaagaggctggaggtggcttgatgtgaaactgtcccattttgaatggggacaaaccaactcaatactcttttgggaagactcaagtggtaagtgaacaaggagagattgaagcacgtgcccaggctgtgtcctaaagaacactgagctgttgttctcattctctcctgctgcactgagctgtctagacagcagtgagacctagaagccctgttgttacttgaagaggcaacatatcctttgctgcctgatatatccttgcagcaaactccagtaatcataggtgatctgggcatattgcttccttaaggagagtatcctctgaatttgaaagtgataatgctgatgattattgtgtttttgtataataaaagtgggtaaaagatgaggattgaccctgaacctctaagaactgtcccttgagtctcagttttggccgacttgtataaactttgaacatgtccagcttgcctctgcacctctgtgattatttttcccatagcaggagctgtcacctctctctctctctctctctctgtctttctttctttctttctttctttctttctttctttctttctttctttctttctttctttctttcctttctttctttctttctttctttctttctttctttctttctttctttctttctttctttctttctttctttctttccttctttctttctttttgagatggagactcactcttgtcgcccaggctggagtgcaatggcacaatctcggctcactgcaacctctgcctcccgggttcaagtgattctcgtgcctcaacctcctgagtagctgggattacaggcgcccaccaccatgcctggctaatttttgtatttttagtagagacggagtttcaccatgttggccaagctggtctcaaactcctgacctcaggtgattcctctgcctcagcctcccaaattgctgggtgtaagccactgtgcccaaccacatctctcatttttgaatgccaggctgatctgtctgcttcactttcatggtcttccaaaaaactgtcaggctacccaaagtagcctgaagtgattattgtctatatgtttttctgcatcattttgctccctttgaactcagttccaaaaagatggagtgattcgtgaagtgaatttctacttttgctttgccataaaatagtcctactatctgttctttcactcattcattcatttgttcatccagtttcctccctgtctccactcccattgccactgcatgtatcctgcccaacacagttcaaatgtagtgagaaggtaggtgtactttaggacctttgtgattcagcctgcccttactgttaattatgacttagtatttttaatcatgtcactcaagaaaccagatgtgacacttaaatgtagcttggataggataaggataagacaagatagaataagggataattacttgctttgcagaggattctttttaatttttaatttttaaaaaataaaagtattggccaggttcgatggcttatgcctgtaatctcagcactttaagagggaaaggtgggtggatcgcttgagcccaggagttcaagaccagcctgggcaacgtgataaaacaacatctctatgaaaaatacaaaaaattatccaggcgtggtggtgcatgcctgtagtcccagctaccggggggcactgaggtgggaagatcacctgagcctgggaggtcgaggctgcagtgacctatgattgcaccactgcactccaacctgggtaatggagtgagaccctgtctcaaaaaacataaataaataaaataaaataaaaattaaaactattcaccacagggtcatctcagaatgtctccatgatgcatttaaactctgtgatttacaatacttaaatttatacttcattttctcaaaagctagctatcaagttaagtagacatatgtcctgaaataattgttatttataattataggttacacatcgtgatagctttactttttttgcataaacatggctgaaaatacatgaaaaaaatgaagaaacactgaagtacaacttaaaagaagccaaaagactctcaaaataaggaatgatcatcaaaaacaatctgtcactttactttgcacaaataacaacagaactcaattttacactaaggataaataagatgtagtgaacatgacttttgagtatgatacttatgtaaagtaacggtggagcagacattatacatccccatttgggggaaggagggaactggccatgtctttcttcctttctttctttctttcttttctttctcagggtctcaatctgttcccctggctgagtgtagtggcaagatcatggctcactgcagcctcaagctcccaggctcaagtgatcctctcacctcagtctcctgagcaactgggactacaggtggaagtcaccatgcccagctaactttttattttttgtagagatgggggtctcactacattgtccagatttgtctcaaactcctagacccaagcaatcctcccacctcagccttccaaagtgctggcgtgagccaatttttatatttatttatttatttatttatttttcaaaatggagtttcgctcttgttgcccaggctggagtgcaatggcacgatctcggctcaccgcaacctctgcctccagggttcaagtgattctcctgcctcagcctccagagtagctaggattacaggcatgagccactatgccctgctaattttgtatttttagtagagacagggtttctccatgttggtcaggctggtcttgaactcccgacctgaggtgatctgcccgcttcagcctccctaagtgctgggattacaggtgtgaaccaccgcacctggtttacctggccaatttttaaatgttttaagtagctattattttcacataattcaaaattcaaaagctataatacaatatgcagttaaaagtctccctttcagaaatagacccacataaaaacagtcacctgattttttttttttttttttgagatgaagtctcactgtgtcgcctaggctggaatgcaatggtgcaatcttggctcactgcaaactctgcctcctgggttcaagcgattttcctgcctcagcctcctgaatagctggggttacaggtgcacactaccatgcaaggctaatttttgtacttttagtagagactaggttttgccatgttgaccagctggtcttgaaatcctgacctcaagtgatctgcctgctttggcctcccaaagtgctgggattacaggcttgagccactgcacccggcaagtcaactgatttttaacaaaggagcaaagacaatacagtggagaaaagagagtcttttcaataagagtgttggaacaactgggcatccatgtgcaaaaaaaaaagaaaaagaatctagacacagactttataccttttacaaaaattagttcaaagtgaatcacacacctaaatgtaaactaaaatagtataaaactcctagaagataagaaaggaggaaatcgaaatttcctctaaatctaaaatccatttgggggaaggagggaactggccatgtctttcttccttgggtttggcaatgacctttcagatatgacatcaaaggcatgatccatgaagaaaaaattgataagctggatgttattaaaaatctctgccctgtgaaaagcactgttaagagaataaaaagccacagacttggaaaaaagttgcaaaagacattatctgataaggaacttttatccaaaatgtactcttaaagctcaacaataaaaaaacaaacaactggcagggtgcagtggctcatgcccgtaatcccagcactttgggaggccgaagcaggtggatcacctgaggtcgggagttcaagaccagcctgaccaacatggcgaaaccctgtctctactaaaaatacaaaaattagccgagcatggtggagggcgcctgtaatcccagctactctactcaggaggctgaggcaggagaatcgcttgaacccggaaggcagaggttacagtgagctaagatcatgccactgcactccagcctgggcaaaaagagtgagactctgtcaaaaaaacaaaacaaaacaaaacaaacctgactataaaatggactaaagaccttaacagaaacttcaccaaagaaggtatacagatggcaaataagcattatgaaaggatactccacatcatgtgtcatcagggaaatgccaattaaaataacaatgagatctcactatatacctattagaatggccaaagtccagaaccctgacaaaactaaaggaccaagatgtcctttgataggtgaaattgattgatagataaactgtggtccattgagacaatggaatattatacagtattaaagagaaatgagctatcagccatgaagagaagtggaagaaacttaaacgtgtatttctctttagggaagactttttttttattgtctcctgtatccttgcacctgggaatggtgcctagtgctaggtaggtgcttaataaatatttgtcaagtagggcatgctggctcatgcctgtaatccaagcactttgggaggacaaggtgggagaattgctgaagcccaggagttctataccagcctgggcaacagagggagacatctgtgtatgggttgttgtgtaaacataaacgttcaactcttttggtaaatactaaggagtgtgattgccggattgtataagagtatgtttagtttttagctggatgtggtggcatgtgcctgtagtcctagctacttgggaggctgggctgggaggattatttgagcccaagaggtttcctgaacaaggtagaaaccatatgactctcttgagaaagcttttgggccagagggaacaggaaatgtaaaggcatattctaggaagacttgtttctttgactgatctactgtcagggtaacttctgttccttttccaaagaaagactcaagggagaaatcaccttctcagtgttgtatttaataagaggttaaacgtgagttggtcatggtgccatcttttttcatacctagcaacaatctgtattaattggaccatttacttttaagaaaggattattttggctgggcgcggtggctcatgcctgtaatcccagaagtttagggtgccagggcgggtggatcacaaggtcaggagttcaagaccaacttggctaaaatggtgaaaccccatctctactaaatatacaaaaattagctgggtgtggtggcgggcgcctgtaatcccagctactcggtagggtgaggcaggagaatcgcttgaacctgggaggcggaggttgtggtgagccgatattgtgccactgcactccagcctgggtgacagagtgagactctatctcaaaaaaaaaaaaaagaaaaaaaggattattttatgtataaatatattttgcttaactaagaacttttttgaaaaaataatgtacatgttgattggatttttgtaagccaaatattttgaaaacattgtatcattttttagcatctctggacccagctagtattgtgagtacttctactctcttttcagtgacaaccttagagcagtagctcttaagtgggggcaatattgtaccccaggggacatttggcaaatttggtgacatttttggttgtgacaactttgttggaggaaggggttgcttctggcagctagtgggtagagaccagggatactgctaaacatcctcctacaatgaacagggccacccaccctcccccacaaaatattatgtgacctcaaagaaaaatagtgctgaggtggagaaatattgctctaggatctaaaacttacagaacagaggagaggactgtggcacatgcatcctatcaggttaaaacagagggtgtcagccaggcatggtgactcatgcctgtaatcctagcatgttggaaggctgagacaggaggatcacttgagcccaggagctcaagaccagcctgggcaacatagcaaggctccttctctacaaaaaataaaaaattagctgggcacagtggtgagcacctgtagtcccagctactcaggaggctgacaccgcaggattgcttaaatccaggagtttgaggctgcagtgagctatgatcgtactactgcaccactccagcctggtcaacagagaaagaccctgtctgtaaataaataaatagagggtgtgaggccatgccctctgttgcttttagtctaattcactcaatcatttattcattcatttgttcaataaatatttactgagtgctgagtatttaaaaaatattactgagtacaaattacttcagaacttagcaatttaaaaccacaaaaaccaggagctttttcacagtttctgtgggtcaggaattcggaagagatttggctgggtgttttcattcagggtctcccatgaagttgcagtccaaatgccggccaagatgcagtcatctgaaggctgggctggggatggagcctgcttcctgggcgctcacccacagggctggagaatggatgcaggctgctggccaaaggcctccgttctttgccacgtggagctttccaagcctgcttgaatgtccttaccacatggctcctctcacagcaggtgatcctacagagagcagggctgaagccacatattttattacctaatcttgactgttacacactgtcatgtctgcaacattttactggttttacagaacagctctattccatgtgggaggggactgcacaagggtatgaataccagaaagtgacaatcactggacagtatatttcaagctggctaccacagtgcctagacattgcaggactatggtccaggctctggtccagggccatggaccaggcttcattcctggtgaggagagataagcagttgataaactaatgaatgaacggggtaagtgctggaaaggaaataaataaagcagaatggtgcaatagagagcaatgggctaaggaggcaggagtgcagatgtagatggggtggtcagggaaggcctcactgagacctgaatgacaaggaactggccctggaaatacccagtgatagagtgttccaaggagagggaccaacacctacaaaatattatgaatagtcattggtggaggccaggtacagtggctcacacctgtaatcccagcactttggaaggctgagttgggaggactacttgaacttaagaagttgagaccagcctgggcaacatagtgagacctcacctctacaaaaaactaaaaaattagctggccatggtggcatatgcttgtagtcccagcgttgggaggctgaggtgggaggatcacttgagtctgggaggttgaggctggagtgagctgtgattgtatcactgcactccagcctgagtggcggagcaagactttttctcaaaaagaaaaaagtaactagtagaatcttgatatgtacatgagggctgagaa

SEQ ID NO: 75 - DNA, 13250 bp, Homo sapiens
  source 1..13250: mol_type = genomic DNA
gccttctcgtaaatctgttttaaaagtgtcctttattctgaataccattttgatccgtgatccactgatggaagtcaatgatgttgaactaagaaaatacataggttactagctatgaaccattcttcattagtgcacttgcttggtaatgggttaatttgaattgggaatgaatcttagtccacaaactagaggtgcagagaatattgcagtttgctaaatagacttaatcttgactttaagcttctactgctttcaggtagcagaaagattcacctcgattattcttggatttctttcccatatcaccctcccagagttgtgccaaggttccaggctttactaatgtcatgatgtcaggaaggcctgagaagttatccgtttacaccagtccctactgcttctgggctgcatttgaggctagggagggtgctttgtcagcatccagccatcctcctggggttgctgcacacctcagggtgcagccagagtgcaggtatggccatctgccactcagagtttcacagtcattcacttccaagatctcccttaagtgtgagagatcttgctatcttctcacctgcttttctcctcaagaaggtaagccagagccctcgacccttgtgaatgaggaaatttcagagagaaaaacattggaactccccctgccccagagttggtaactgctcaaatgctggctgccgccaggtggtgcaagaggcgctgcttctctgtggtcacctagcagcagtctcctgtggccagttccccacgtagaggtggcaactgcccttcttcatggctacttgctggaggtttgtgggaggaggggagtatggggggtgtgtgtggctttacctgccccaaattgtcaggaggatttgaggcatttctttgttgttgttgttgtttggctgtttccaaaacccatttggaaacctgttattccgtaagagtagccttcaaattcttaagcattttctataaatcttcagtgaactaataaaagtatttccttttcccttttctggcaatgggtagtctagttctgttaatattcctgcaaagaaactcatctaccagcctcactcacactgtgcacttttgccctcagaatcctcagtggctagcctaattgactacaaccagtttagatgatcagctaccttccttttgccattatttcagatgctgccttgcccatagcacaaccaatgcatttaaaaaataaaaacatttggggtgggagaactatgattaaataaaggagatctctgtagagtatggcaaagcttgcacacaactttaataaaaatatgctgtcttgagtaaccagcatattacagaggctctgtgaatgcctcttcatctagaatttcagtacaagctgtacataaaatatttatacagcacagtgtgctttgcccctcacaaaagcgtgggttcagatgtacactgttactatagacgtcactaacatataagccggtgaagaacctttaatgtatttgtaatgttagcaaagtatctgtcatcagattaaacttgtagtgactgataatgtagccttggctcctagccaaaaatattttttttgatatcagaatgacacttaatagtaaagatatgtcatagaggaaggggaagaagagaatttactagagaaacttaaaagactggttggtgcagaacctagtaacttggtttgtggctggcagaaatgggagtagtccctgggattacttctaaggaggaaattttactacaaacacagctgggaataattctgttaccaagtcttttttaggatcaatacagagcttatttgtaaaaattaaaatctaactatcactttattgtctatgggtatctgttacattttatctgtaaaagaggaatggaaatgcctgcctagtaggttcatcataaggactgagaggatacgggaccttattaagtcctcagtaagtagcagcaattttgcttttgtttttatgatgattacttccactcatgactttacctgcatgttctttaatcttcaaaatagattagtgaagtagtgatgtttccattttagaaataaaatacgctggggaaacgaattgtaatacacatgacaaagcttaatattagtatccttctatgaaggatccctcagtatccttatataaagatcctttatggctctaatatgcttcagttgattttgttccttgtaggcaaaagtttcaataaatatactgttttctctccattatcaaggatatatggattaatattaatatataaatatataaatccattatatagtaatatatattaacatatacttcctttattaatatcctggatatatgaaattaatatcttggatatatgaaaaggtattccagatcaataagatgaacacagtagtagaaaaatagagaacatgaacaagagtgtaaaaaggtgcgaagtgttcaaccccaaagatatgctaatcaaaatttaaaaattaaatctatacaatacaatttaaaaaataacattacccattgttagagggggtgtggaggagtgggtattgtcatgtgccactgggtcaaacattgtgtagggcaaattaacaatatcagatcctcacattttctgtacatttgaccttgaccttatcccaggcaaatacttgatggtatagtgaaggatatctttctcagcattacatatataatcaaaaataagaggtgacttaagtgcttcaagggaatttattaaaatggattattgatcagtcattaaaaatgaaagcatacaagactattaaatggtacagaatttctatcagaataagtgggaaaaacaagttacaagtaatatcatatgatttacttttagtgaaacttacatgcacttacacatttgtgtattatgtttatgtgtcatgcatacatataaaagtggaaggcggttcaacaaagtgctaattatcctcatgatttttattttttctttgatttttatgaacttacagtaaagaacaaagtactactttgaaggaagaaaaattattttttaataattcagcataaattacataggttatccaaagatagtaatatggtatttgatctgaacctagacttctgttctgttgatttgacacattttggtgtctttccttttatgttaaataagtaactatcatttacctacagcagaagaagaatataacttagcatttgagacttgataacatagagctgttgaatagttctgtaagatttgttagggaaccaaaaccaggcatgtgaggatggtgctggaagagaaaaggcgggaagggtttgcagtcaactgtcagttatcttcagctttcaggctcgctgcacatggacaggtgaggaccaagggaagaagagcaagcttgggtatttggttgagctgttaagttcagggttagaaaatgaccagcacaaaccttttggcttgagagccaaagttcttggcaggaagtctctgcttgtttccgtttgccttcctcccagtttctcctcaatgccttgcagtcagcatcctgtatctgccattttgaaaactgcccttaggggtcatgagtgacccccttccttattgttaaacccagtgacattttgtccttatctgcagcatttgatgtgttactcaactctctttgggcttgtgtgcctctccacccttgtggttattctcctgcctctgtaaccactcagtgtcttcttccatgtcccttgacccttcactgtgtcttctactgattccccttagaactttcatttacccctggagcttcaaccatcatcttcaggtaaaactctagcaacaagtcatctttgcccgctgtgcatcatccttgctgccattgagagtttggtcttaaaatggtacttgcaattagaacacgttcactttgtcacaaaatctgacagacattggacatacttagaattcatatctggcttcctgagacagctgtcagattgtctaccaatggtctacccattgatgatggaacaagctccttgtatcagcctcaaataaaaatgatggaattaataaaagacgcttaccttaaggcacaaaggcctatgaatttcaaaaagcattgacagaaccgatccaaaaaatatgtagtttgtaaaaactctaatacaatccacactgaagtaaaaagcttaacttagaataatccaaatagtctttgtcagctggacagctaatcttggtgaacatggaagagtagacaataatgttaaggcattgtgtgagggttaaattgtttgcgaggtcggcattgctggggcttcggattcaaactgggccttgaaagagggggtaagaaaagtctatggggaactgatgggcacaaaggcagggtgtaagtgtttgttcttgggaaaatgatcagactaatctgattgaatagaagacgtttattggaaattaaaggaagataaagtagtgatagataatggaagaactgaaggtcaacaggggagtttatatgtgatggaagagaaaatcattatcactagggatgtagatgtaagaaaacgttaggtttggaagttataagacaagagaacttcaaagtttgtgggattctgtaaggtgggatgggaataagcaatattgttgagtacctgctgtgtgatctgtaaggcataagatgtcattattattttacagcaagctttggagtagatgtactagttcccattttatgcatagtgagatggaattttgagcagacatacttgtctaagtttggcagagtggctggaccaggattcatgcccagtgacatctgacttcaaagcacagtgaggatggagaatgttgagaccagttcttcattttacagtcaaggggatgggcccaggcctattcaaggttacaggaataggatgaaagcaatttctctgtaagagagagtggataggctgtgatctgcagagggtccaagttagaggctcttgttataaacagatgaggtatgccaaggaagttgggttcagcagtgtgataggagtgaaaaagaaggggtagagagcagctggacattcggggaaagtggtggtgactgttagtggaaggtaatgacgagagagatgacttgaaaacagttccgaggttttagtcccagggaactgccattaacagttttaggagaaaagccatgtgtgtgttatggagtggtctgagtaagtatgatagacattaaaaaatacataaaaatagagtggtatgcatgtgctgaattatgtttgtactaccaaacacacggaggaggagaacagaacagaaggtggaaagctatgagggatccagcgcttttctttgcagtggtggagagtcacgagagcaaatagctagcctttacctaaagcaaaagggactctttgcatgatatcttaggctcccttttattctggcctgcccctgcacccccagcaggaaagtggcttaactgtactttgatttccaaaatgcgtagcagtctctagtattgattcccctctcctgcagatctcaagcctaaaaatgagtattgttccattacatttccctcaaaaacatttctttttcctttcagaatgatggtcactatactggatggacttctgaactagtgaattactttcatcttttgatcacactaggaaattgtccacggagttgaaatatttattgcagtaatttctggccttacataattaagataacatatcgtttttttctttataactatcatgaagttgtcatgtttgtttcctttaactttgctttttagaggtacgaatctgttccctagtcttttatgctccaatgatctgttcagactgctcttgatctacaaatgtatgattgagaaaagacttttataggatgaaatatgagcaagctgttttactctgaagaataaaagtgaattgtattactctgcagattaagtcaataaataccccattttcataaacacaatatgcacagactagataatactagggaaacttgatacatcaaaaggagtattaagactgaaaaaaatggagatactcaatttattgcaggctttattcaataaacctagaaaatagagagtttaaatcaaaatctgttactctgtttctagagataatcaatgttaaaattgtactatattattttccaagtttttagaatatgtgcatgtgttgttgtgttagctttctctatttttgcaacttgagtaacatttattacatgcttgtgctgtgccaagctaaataccaagcattttatatatattaatttattctcataacccttggtacttttattatcctcatttacacacaggacaattgaagctcagagaaattagccaggcacagtggctcactcctgtaatgccagcactttaggaggccaaggcaggcagatcacttgaggtcagaagtttgagaccagcctggccaacatggcgaaaccccgtctctaataaaaatacaaaaattagctgggcgtggtggcacatgcctgtaatcccagctactagagaggctgaggcaggagaattgcttgaacctgggaggcagaggttgcattgtgctgagattgcaccattgcactctagcctgggtgacagagctagacttggtctcaagaaaaaaaaaaagaaagaaagaaagaaatgacttgcccatgttcacatagctggtaaacccacactggttcagaacttaaaccagtgagataccaaagcccatatcagtgggcttttttacatacttcttttccttaataaaatgcttatttcttttttctacagcatcattttaaatgacagcatagtattcagttatatggaaatgtaatggtttctctatcccatctccttttattagacatttatattgtttcttgttatttacttttagaaataacattgcagtgaacatctgtcatgcacatctatgattatttccttaggataaattgccagaagtggcattgctgaacaatgatagaatgtagcactcaggtgttgatgtattctgttaatttactctgttgatgtactgttttctcgaaaggccacaccagtttataatctcagtagcagtatattgaagtacctggtaactttcagctctcagcaacattggtagttagcaatttgaaaaaaaaaagtgtttgtttttaaaaaacattctaggtattcctttttaagtccatattatctcttgcctctaatgctgtagtagtcatgatctccttactggtttatttctatctagcacccactttgccactaacagaatcggatagggcacggactgtagagttagatgcctgggttcaaatcatgactgtgctgtgcctcaatttccccgtaagtaaaatgaaaatagtaataaaagccctctggtaaagtactttagaacagtgcctgacttttggtatgtgttcagtaattgttggcctactagtattgtcttccagaagtccctgcttatatgattaaaaaaacccaaggttatacttgtttttgaattgtaattattaccaaatcagtaaatcacagtagaaactaaagtgctgaccttgaagcattgttagtgttaacactgtgaccaacctgaagatcacaaattaccttccgtgactcagttgatgctgagaggtcagggatagagtaataacaggaataactagaatgttaaagtgctttatattaagctgccagtgcacttccacacacattatctcattcgatcctcacaacacagctgtgaaggagatggagcgggtattattaatctcatcttacagaggaggaaattgacttggaggattaagtggcttgctcactgatggttgtggaaatggtcagtggcagagctgaatgtgtactctgggccttctgactgtaaatacttactcttgatgcttcataacatcatgataagctaaggaggtgcaggtgtagatgcccaggtctggagatttgctggaaaagaaggagcaaaagaggatgccactgggaggagggagcagagttggggtaaggaaacttagatatactaaaagagagggaggtacccagcggggagagaggtggggaaggagtcataaagaaagggaaaaacagggggccaggacttccgtgactacagggctggctgaatagatcagggtggagggcttcatctttgagactgaaggaatgcgtcccctgagccaggaaggagggaggagatggagcaagtagacacaggtgatttgaaatagaaaggaacattaagagggctgaaggattgtggcctgaatgaagaaagaaggaagtatttatttctggagagtaaaagtggtaggtttggggttttagatttgagaaagggaaaccatttagagtatctgtgtgggaaatgggccaaggaattagaaatgcctgccagagacctctgcaggatgcaggaaggacccagataaaaacgtctgggctccaagtcgacagattctgtgaaccccttaggcatgctgaggatttccttgccagatgatgtaactatctgaggatgtttctttgtgagctcagtgctagacaggcacaggagcagtattaggatggaaacatttcttaattgcttgaggagtgaggaaaaaaacggcactctgcaataaccctcttgtttccaaataccaaagcagctgttgggctgtgctcctgtctaggtaccttttcctcaggagttaagtgccacatgatgatatttatggttgctttttagggggtacatggttttttaattagtgaagaccgagtagcaatagttttgttttgtgttctaatagcctttgttattatagtcagggaggtgaagtgaggagatgatagatgctttcctaatctgtgaaatgaggagttggactaggcaggtgctccccaaagtccctttctaacattaccattttctcatccaactccagtctacgctgcctcctctccatttcctcctttaccagacagtttagtgtgtctcaagttatattttatggtgctttagatatatatatgtatatttttgcttagagacttcatgcattattattagagacttcatgcagtatgtagtgactgtagaaaaatgaaagatgtatcgataaataaaagacctgttaaaaatatgtaactttaccaccattaaataaccactgtttatattcttccggagatttttttttttaggtgtgtatgcctaaataagattcttaaatacagaaatgcaccctgcttttctcagttgaaaattataaacctctctgcttatcagtagtcactgctgtgtaattattaaaggttgatgaagactctgtttcaggaatgtattttaacaaatctcactttggacatatgcattaatgtacattcttctaactgtatttgtgaggctgctctgaattattttcttataaaattaggaaagaggtttaatatataatacacattgcctggaagactgaaccgatttacagttccatcaccagtatgcgagaggtctcttttcccacacccttaacattggatagtggagtttaaaacaaacaaacaaaaaaaccttaccagttttatagacagatgaacatcttttcatatgccatttatattcctttgtgagttttctgttcatatcctttgcccatttctccagaggggtatttgctatttttgttactgacttgcagcaacgagattttaaagatttaaaatttttaaatgtcttttattataaaagtatgttagttgttttgataatttctttgaatttttatactgcttttaaatgtatataaatatttaattttaggttgtcaaatctttttctttatggtttccatataggctaactaggaagtaagaatgccttggtatttgttgcccattgtcagttctttacatagcagagtaatctctttcaagtgtgatcacatcttggcatacccctgcctgagctcgtcatggcattcttgttatcatggcctgcagggcctggcacgatcttgcttttcctgctgtaaagccccacctcttgtcactcacccttgaacactatgttccagccccactggtctcttctcagtccagggaatatgccaacctccttcctgtccctgaaattctgcaggtgcagtttctttgcttgggaaatgtgtgcacacgcgcacacacacacactcttttgagcacttgtcaatatgcaattatttatttatttttgagatgcagtctcgcctaggctggagttctgtggtgcgatcttggctcactctgcaacctctgcctcctgggttcaagtgattctcctgcctcagcctagcaagtagctgggattacaggtgcccactacgacgcccagctaatttttgtatttttagtagagtcggggtttcaccgtgttagccaggctgatctcaaactcctgacctcaggtgatccacccacctcagcctctgaaaatgctgggattacaggagtgagccactgtgcccagccacaattatcatttcttattaacttactcttttcctgtttccccctccagcctgtaacaccataggggcagggaccttgtctgtgttgaccacagcgaggtctctagtgcttaacatgtggtatttgtaggagatcggtcagggtggtggaagaaattgtaggaaaagatgcaaaccttcttggaagaggttttgcaaaagcttcaaaaaagggtttggctgaaggcagccaaattctcttacctggagcctgagagcaaaggttagataataaggggatgtaaaggaattgatctagataagttagtttacttaggcctcagaacctggcctttaatcatctgtgcgcaggactgctctttcccagggagcagcgggaagccgggggagggggaaccatgttaattacccacaagtgtgttgactcaaagactttgtcattacatccatactgaataaatgcccgcagcactggcttgtcagggccacagctgctatgactctttctttctgtgagcaccccgatcccctagtccgctctttcactggatacctgtgtctaagtacgttttttcatccatcgctcagccagaatctgccggtcagacctggcaagtatttatagaagaaatgaatcaatattacatctctaaccacaagattgcacaggcatttaactatatttaccttattgtagttttatggtttcatctcacattttaaaatattttatctgtatgaaacttagtttgaaatgtgacttgagataggaattaaaattaatttctttcccaaatgaatagccacctgcaatttttgtagttcttgtttattagagagtccttactcaaagtatagtccttaagcactattatattgttttttctttcttctgtttgcttttctctccttgggtagtcctttgtgcaaaacgtaaatgcagaaactgctcattgacttgagccaaattgctcatgagcatgctggttcaataccaagaaagatgatcttggcgtcacccaccatagcctaccttctaagaagaaagaagacatcatgtgactgacttagggagttgtactatttgttcaatatctaatgctagtagacaatcttgttttagataattctggccgccagtttttttaaactgttggaacctggaaatttgaacattccagtgactacctttcctaactgcctcttatctctagatgtggaataaaaatcctttggcagaccatgtgttccagtttttggtttggaaaatatggattattattcttttccttattttaactctgaaaattaaaattaatgacaaaagtcagatgtgcccattctcacatattcaaacaataaaacatacagacaaaaaaaggattcttgtatcccactttttgatcctattcctaatataaccactgctgagtttattgtatatactttcagacattttttatgcttagtggatatattagatctttatacattccccccccccatatacttgcatttttttttttgactaatgtcataaactttgttatacacctcagtgggatttaaaaacacctgaagcctttgttttttggctggtggcaaaaaaaccagagtaacttagagaagttacccattgatgttttcacagggctttaaacacgaagacctgatttgtttgtgtaaatcgttggatgtaatcttacagaggaccagggcttgagcaccttcagaaacatggtatcatctgatcatgatgatttccatcccacgacagaggaagaaatggagactccaaagggacagaagtgaattcttccaaatttatgaaaatgaacacttagctaaaatgtgttcactgggttatgacaagtaactggacttctagggaatgggatggcaggtggggtgctatcagtttataaaattttttgtaaccttgtctcttatttctgcttccctcccccagccatgggaacacaagataaatttggagtaggtgagggtggagagcaaagtgactccctgggctgtgcccttcacactggttttagaaagcatgcagctgactgccctggggtctgatctatggtgctgcgctcgagagaactgtaaggtctgctgtaagtgatgggggctgtggacttatgcagaagtgcacttgttgggggttttcacagtacccaccttattatactagagaggcaggtttcattgcttaaggggacaatttatggcaataggcttatctccttgttttagctctttatgtttttctgcctttaataaaatgtgaagtcacaaagcaattaaatagtagtgtagttttcaggcaggaggtggagaaaggctaactagggggaaaaggccaacatgattgacagaggctggctggagatttacattgagaataactcgttcttcaaaactttcttcattttctggtgagaattagggacaaatcatataccagaaggatggatgattaaaaatgtaggagttatgatttctttttgactttgtaagtctctaaatcctccaccttaacatagagttctcatttcaaaatgggaaccagccctgccagagactaaagtgagccagaaatactctaaagtcttaaatagttaataagtgtgagattgtttatattttgtaaaatgtcttaagatacaatgaaatggagaatc

SEQ ID NO: 76 - DNA, 17767 bp, Homo sapiens
  source 1..17767: mol_type = genomic DNA
acctctctgcttatcagtagtcactgctgtgtaattattaaaggttgatgaagactctgtttcaggaatgtattttaacaaatctcactttggacatatgcattaatgtacattcttctaactgtatttgtgaggctgctctgaattattttcttataaaattaggaaagaggtttaatatataatacacattgcctggaagactgaaccgatttacagttccatcaccagtatgcgagaggtctcttttcccacacccttaacattggatagtggagtttaaaacaaacaaacaaaaaaaccttaccagttttatagacagatgaacatcttttcatatgccatttatattcctttgtgagttttctgttcatatcctttgcccatttctccagaggggtatttgctatttttgttactgacttgcagcaacgagattttaaagatttaaaatttttaaatgtcttttattataaaagtatgttagttgttttgataatttctttgaatttttatactgcttttaaatgtatataaatatttaattttaggttgtcaaatctttttctttatggtttccatataggctaactaggaagtaagaatgccttggtatttgttgcccattgtcagttctttacatagcagagtaatctctttcaagtgtgatcacatcttggcatacccctgcctgagctcgtcatggcattcttgttatcatggcctgcagggcctggcacgatcttgcttttcctgctgtaaagccccacctcttgtcactcacccttgaacactatgttccagccccactggtctcttctcagtccagggaatatgccaacctccttcctgtccctgaaattctgcaggtgcagtttctttgcttgggaaatgtgtgcacacgcgcacacacacacactcttttgagcacttgtcaatatgcaattatttatttatttttgagatgcagtctcgcctaggctggagttctgtggtgcgatcttggctcactctgcaacctctgcctcctgggttcaagtgattctcctgcctcagcctagcaagtagctgggattacaggtgcccactacgacgcccagctaatttttgtatttttagtagagtcggggtttcaccgtgttagccaggctgatctcaaactcctgacctcaggtgatccacccacctcagcctctgaaaatgctgggattacaggagtgagccactgtgcccagccacaattatcatttcttattaacttactcttttcctgtttccccctccagcctgtaacaccataggggcagggaccttgtctgtgttgaccacagcgaggtctctagtgcttaacatgtggtatttgtaggagatcggtcagggtggtggaagaaattgtaggaaaagatgcaaaccttcttggaagaggttttgcaaaagcttcaaaaaagggtttggctgaaggcagccaaattctcttacctggagcctgagagcaaaggttagataataaggggatgtaaaggaattgatctagataagttagtttacttaggcctcagaacctggcctttaatcatctgtgcgcaggactgctctttcccagggagcagcgggaagccgggggagggggaaccatgttaattacccacaagtgtgttgactcaaagactttgtcattacatccatactgaataaatgcccgcagcactggcttgtcagggccacagctgctatgactctttctttctgtgagcaccccgatcccctagtccgctctttcactggatacctgtgtctaagtacgttttttcatccatcgctcagccagaatctgccggtcagacctggcaagtatttatagaagaaatgaatcaatattacatctctaaccacaagattgcacaggcatttaactatatttaccttattgtagttttatggtttcatctcacattttaaaatattttatctgtatgaaacttagtttgaaatgtgacttgagataggaattaaaattaatttctttcccaaatgaatagccacctgcaatttttgtagttcttgtttattagagagtccttactcaaagtatagtccttaagcactattatattgttttttctttcttctgtttgcttttctctccttgggtagtcctttgtgcaaaacgtaaatgcagaaactgctcattgacttgagccaaattgctcatgagcatgctggttcaataccaagaaagatgatcttggcgtcacccaccatagcctaccttctaagaagaaagaagacatcatgtgactgacttagggagttgtactatttgttcaatatctaatgctagtagacaatcttgttttagataattctggccgccagtttttttaaactgttggaacctggaaatttgaacattccagtgactacctttcctaactgcctcttatctctagatgtggaataaaaatcctttggcagaccatgtgttccagtttttggtttggaaaatatggattattattcttttccttattttaactctgaaaattaaaattaatgacaaaagtcagatgtgcccattctcacatattcaaacaataaaacatacagacaaaaaaaggattcttgtatcccactttttgatcctattcctaatataaccactgctgagtttattgtatatactttcagacattttttatgcttagtggatatattagatctttatacattccccccccccatatacttgcatttttttttttgactaatgtcataaactttgttatacacctcagtgggatttaaaaacacctgaagcctttgttttttggctggtggcaaaaaaaccagagtaacttagagaagttacccattgatgttttcacagggctttaaacacgaagacctgatttgtttgtgtaaatcgttggatgtaatcttacagaggaccagggcttgagcaccttcagaaacatggtatcatctgatcatgatgatttccatcccacgacagaggaagaaatggagactccaaagggacagaagtgaattcttccaaatttatgaaaatgaacacttagctaaaatgtgttcactgggttatgacaagtaactggacttctagggaatgggatggcaggtggggtgctatcagtttataaaattttttgtaaccttgtctcttatttctgcttccctcccccagccatgggaacacaagataaatttggagtaggtgagggtggagagcaaagtgactccctgggctgtgcccttcacactggttttagaaagcatgcagctgactgccctggggtctgatctatggtgctgcgctcgagagaactgtaaggtctgctgtaagtgatgggggctgtggacttatgcagaagtgcacttgttgggggttttcacagtacccaccttattatactagagaggcaggtttcattgcttaaggggacaatttatggcaataggcttatctccttgttttagctctttatgtttttctgcctttaataaaatgtgaagtcacaaagcaattaaatagtagtgtagttttcaggcaggaggtggagaaaggctaactagggggaaaaggccaacatgattgacagaggctggctggagatttacattgagaataactcgttcttcaaaactttcttcattttctggtgagaattagggacaaatcatataccagaaggatggatgattaaaaatgtaggagttatgatttctttttgactttgtaagtctctaaatcctccaccttaacatagagttctcatttcaaaatgggaaccagccctgccagagactaaagtgagccagaaatactctaaagtcttaaatagttaataagtgtgagattgtttatattttgtaaaatgtcttaagatacaatgaaatggagaatccctgagtgtttttttgatttcctaaactctgatccacaattatagatgtgtctgaaggttcaaaaatattgaacgtgatttcagttgtttctagaatttaaaaaaattaataatttttaataatgacactttaaatgaggagaaggcttttaaaaccaaatataaaaatctggagagttcagattccctgtctctcctctttcaacctttaatgtataaaacaaatccttttgattcagccactgtgtattgataatggcttatttattacaatcagaggaattaaacaaagatatgtagatactttgtcatcttttcttattatagaaacagtttgattttaagaatttttattcagaacgcagattcgaaaagaaaaaaaagaatttttagaaaagttgccttttaatttaaatttcttgttttgtcctaataatcacattgaaatagccaaaacaaataatataaattaaaatgcaacgatggcccggcatggtggcacatgactgtagtcccagctactcaggaagctaaggccagcagattgcttgagcccaggagttcaagaccagttggggcaacatggtgagaccctgtctctacttttaaaatgtggtgattggtacctgttgagagaagggttaactgaaagttattcacatggcccagaaagtggctgaaaagtgctctttctggtgtgaatttctcttgctgtgaaagcactctgaaggggagacctaatgccattgcaggagcacttcagctccaaacttgagcgttgcaatcagaacaagaacccgaggaaaagcctgcaaaatgagcctgctgcgatatagggtgtgcttttggacagttatacataagaatttttttcttttttcttttttcttttgtttgagacagtgtctcactctgttgcccaggctagagagcagtggcgtgatcattgcttactgaagcctcaaattcctgggctcaagcagtcctcccacctcagtctcctgagtagctgggactgcaggaatgcaccaccacatctggctaatttattttttgtagaggtgaagtcttgctttgttgcccaggttggtctcaaactcctggactcaggtgatcctcctgcatggacctcccaaagtgctgggattataggcatgagccactgtgcccagcctcatgagaagatttatgatgatagatagaagaattattaatttccacagtttgacaaatgataacaaatagcttttacagtttgagcatcccctatcccaaacgcttgggactagaagtatttcggactttggacttttttgaatttgggaatatttgcatatacataatgaaattccttggggatgagacacaagtctaaataacaagttcgtttatgtttcatatacaccttatatacaaagactgaaggtaactttatacaatatttttaataattttgtgcatgaaataaagttttgaccgcattttggctgtaacctgtcacatgaggtcaggtgtgaaatttccacttttggtgtcatgtcagcattcaaaaagtgttggattttggagcatttctatttcagatttttggattaaggacgttcaacttgtatgccaaattagtaaatattttttgagttcctacccacatccctgtgtatgggctctagaagcagccatggtttagtttcctcacctgtaagggagggtgtagaacttcttttaatgtacatcactgtaggttaagttcgggtagagaaaagactaaaggcaaccaaggctggctgtcctctgagcccctatgctaagctgaactaggcttttgtttctggcaatggatcattttgctgtcacggagccagtgattatttaccacccctggttttgagtaggtttccttttcccctggcaatagctcttagagtgtttcacagagaggcaacgggattcagaagatgcccgtttacactggtaccactgtctcgttatgtcatggtaaagtaatgaagtccaccatcattactttaccagttccccattggtgttttggtcttccctatacattttttttaacttttatttatttttaatgagatgaaattcacataatataacaataggcagtttaataattgacaattcagatgtatttagtacattcataatattgtgtagctgccacctctctctagttccaaaacatttttgtcactacaaaagaaaaccccgtacccagtaatcagtaacacactattctctcctctctctcatccctgacaatcattaatctgctttcagtctctatgaatttacaattctagataccacatgtaaaataaatgttctcatacaatatgtgaccttttgtgtctggcttctttcacttagtatattcatccatgttgtaatgtcttagccattttatggctgaatagtccatggtacggatatatcataatttgtttatccattcatctgttgatagatttttgattttttccccaccttttaattcttatgaataaggctgctatgaacatgggtgtgtaagtacttgagtccctgttttcagttcttttaggttcatacttagaggtgtaattgctgggttatatggcaagtctgtgtaacctttttgcaaaactgttttccacagggccaaaccatttctagtcccaccaacaatgtacaaggttccaatttttccatatccttgcaaacatttattttccctttttaaaaaaattatagtcgtccttgtgggtataaagtagtattttattatggttttgatttatattttcctaatgattaatggtatttatctttccatgtacacattggccatttgtatatcttctttggagacatgtctgttgaagtcctttgcccatttaaaaattgttatttgttgttgacttgtaagagtgctttatatattctggatactagacccttaatagatatgtgatttgcacatagtttttctcatttttaaggttttctttttttttaatttttatttatttttttttagacagagtcttgctctgttgcccaggctggagtacagtggcaagatcttggctcactgcaacctctgtctcctgggttcaagtgattctcctgcctcagcctcctgggtagctgggattacaggcatgcatcaccacgcctggctaatttttttgtatttttagtagagatggggtttcaccgtgttggccaggctatcttgaactcttgacctcaggtgatccacccgcctcagcctcccaaaatgctgggattacaggtgtgagccaccacccctggcctccctatgttttcttctaagaagttatgcttttattttttatacttaggttgttaattcattttgagttaatttttcatatggtatggggtaggggcccaactttattcttttgtatgtagatatctagttttcccagcaccacttgctgaagagacagtatttccccatttgaatggtctttgtacccttgttaaaaatctattggccatatatgtgagattttatttctggactcttttttctattggtccatatatttatccctatactagtactacaccgtttttgattactgtagctttgtagtaagttttgaaattgagaagtgagagttcttcaacttttttcttttttttagtgttgttttggctatttggatccctttcagcttcatacgaatttaaggatctgttttttcatttctgcaaaaagggctgttggagttttgataaggagtacattgaatctgcagattatttggagtaatattgtcatcttaacaatattaagacttccaatccatgaatataggatgtatttccatttatttaggtcttattcttcagcagtgtcttgtaatttccagtgtgtaagtcttttgcctcctgtgttaaatttgttcctaggtttttttgttttgttttgttggttttcttttttttttttttttttttttttttttttgagacagtctcattctgttgcccaggctggagtgcggtggcacgacctcggctcactgcaacctcctcctcctgggttcaagcgattctcatgcctcagcctcctgagtagctgagattacaggcgcacaccactacgcccagctaattttttgtatttttaatagagatagagtcttgacgtgttggccagactggtctcggactcctgacctcaggtgatccgccctcctccatctcccaaagtgctagaattacgggcatgagccaccatgcccggccatccctaggtattttattctttatatgcaattataaatataattgttttcttaatttactttatgaatgatttgtatttattattattatttttttttttttttgagacggagtttcgcttttgtcacccaggctggagtgcaatggtgcgatcttggctcaccacagcctccacctcccagggtcaagcaattctcctgcctcagcctcctgagtagctgggattacaggcacacaccaccatgcttgactaattttttattgttagtagagacggggtttttccatgttggtcaggctggtcttgaactcctgacctcaggtgatctgcccatcccagcctcccaaagtgctgggattatagttgtgagccaccacacccggcaagaaatattatttttattttttaaaaaataatctctagtggttattttaaaattcaaggtaagaaccccactattcctccaaatattctgtagagtggtctctgttaagtttgatatacatccttctacatgttttccatgcatttatatacaaacatactttcttactgtgaataaagtcatatactttgtctaaattttaacttactattttacataattatagattgtgtctttctctgctagtttacttatttctcttaaatgctgcagagtaacccatcatactgatatgctacgtagctgacccttgaacatcatgggtccacttatatgcaggtccacgtgcaggtctgcttttatgcagatattttcaacccaacatggattgaaaatagagtacttgagggatgcaaaacttgcataaagagagaattgacttttcatatacgcaggttcttcagggctggctacagaacttcagtatgtgaggatttgggtatttgcaggcagtcatggaaccagtcctccttgtatatcgagggatgactgtactttgtttaaggctttattttaatgatcatttagtgtggtgttggtgttttatagtataaataatgcaacagttaacaattttatacccacatcaacgtatgtccatgtaagtctttaaggtaataagaattgctgaggcaaaaaaaattaccttaaatttttttaaagttttgtgttaggcataacacataatttactatcttaactgtttttttaattgcacaattcagtaatgttgtttacattcacattattgcgcaaccagtctctaaaactctttttcatctttcaaaacaaaagcgctatatctgttatacaacaactccccacccccctcttcccctggcagccattctactttctgtctctgtaattttgactattctaggtacctcataagtggaatcacacgctgtctgtctttttgtggctggcttattttacccagtgtaatgtcctcaagggtcatctatgttgtaacatgtgtccaaatttcattcctttctaaggctgaataatattccattgtagcatcacattgagtaattaaatgcttggaaagaaagaagaaaaagaagggtatgtctgactcttttcattcccatacaatgtggtaacatacgtaataatctaaatagaatataaataaataaaatgaagtccttttaggtatgtgtatgagctatataaacaggtatttttaaatgcattgtggatccaacttcatattagtaggtgaggaaacaactagtagcacataaatgcttcttgggcttcttgcacacttgccctccatacacctcacctcatgcccaacataactttcattatccctccacccattgctggcagtcatttttaaatagctttggattttatgccaaaagatcttctacttgttgacagattctgtgaatacccagtgttcgcttcttttgcactttccaagaaagatgagtttgggaatttgctaacatgttctaaagttaaagctttttgttctgggataactgaaaagtttagttatccaaaaggcagcccaccttcatttttcaggagggtcactgtgatgttctgtctttctgagtctcatgtctcatacctttctgtgctctgtcataattaactaaagcagaaggagggagatccttttgtaaaatgcccaaagaaaagaaagccagatggaagtgaggagtaagagtaaccacagttgctttcctcttccatcagtctttaaaaactttttattttgaaataatgttagatttagagaaatgttgcaaaggtagtacggggctcccatacccttcactcagtttctcctaatgttgttatcttacataaccatattgaactatcgttaatataattatcaaaattgggaatctaaattggtctaatacttccagctaaacaacagaccttactagcattctatccagttttccgctatcctttctttatgttccatgatccaatccaagatccacattgtattgagtagttctgactctttaaactcccacagtttgtgacagttccttgtcattccctgtcagttatttctggttagttattttgtggaatgactagatttggggctgtctgatgtttcctagtgtttacctttaagttatgcttttttttgttttgaaagaagaccacaaaagcaatgatgtatcttttttattgcctcataactggttacttgatgtcagtttcccttattgctagtgctattcgtgtggactcatcatggacagttacttcattctgtgggttataacccaatattatcatcattattttcttcttcaaattattctagctttggccactgggagctccttcaggctgactctgatgtccttttgacatgcttccatcttttttcaagtacttcctcacattatggcatcccctgatgctctaggctaatcttgtattttccttgccctacttttggaatcagtcacttccctaaggagcctgggtccttttactggacaatggtgtttagaaaccaatatctgagtaccagacgtgcacattgcaactggggtggctttttgtcttccatgagttttatggtgagctctttcctgtgaacatggttgtaccaggtctgaaactcgtttttaacacttctaggtagtcagtcactttgatgtaaagtcattttgatcacttaatgttgagttgttaaaatcaatgcacataccctgtagaaaaataggttctttatcaatggaatagattaactttttgtggaaaaatacttttacattgataggatagcattagcatccagacatttttgacattccttcaataactattcctgagtttctgactctcatttttagcccattccatttttatttattttattttattttattttttgagacggagtctcgctctgttgccaggctggtgtgcagtggtgtggtcttggctcactgcaacctcccgctcctgggttcaagcgactctcctgcctcagcctcccaagtagctgggactacaggcatgcaccaccatgcccagctaatttttgtatttttagtagagatgtggtttcaccatgttggccaggatggtctcaatctcttgacctcatgatccgcctgcctcagcctcccaaagtgctgggattataggtgtgagctgttgcacccggcccccattccatattttaatgagaatatcttttggttagttatagaggtaaatacctggatttacaatgtgtaactacagattcatcatcctataataaagtaactctttttgcataaacttttgataagttatttttgtccttataattttatgtgtgaagtctttacggtcagaggacattgacaaaatattttagattgaaagcctgttctccttgatgattcagtataacttcttttgactgcgcttttagttcttgcaaaatagatcttgtttagatgagattccagcatgactcctttgtaatttttcatatttttgctattacatctcaactcttgaagagctatttctgtgaaaaccaaacatgcagtcaaggcacattccacgtgtggctgatggggttatcatagttacaaatcatatttatccacagtgataattatcttccttagcgttttgttctacttcagagctcatttgtgggccttaccacctgtttcttacatatggggaaagagtctcttattctcttttggaatatagatctaagagtagatttatatcaggatttgaaagatgaatctttttcaaggatgtttttcctctggaccgtggcattgtgtaagaaatttccctactcatcccatccctggggcacattaatttggagatgatgttaaatgtgtcagagtgtggcacaaatctcaactggcagataaagcctagtattgaattgttttcagttcagaaacgtggctggctgactttgaccctgaatgtgtaaattatctttgcagcaataagaacttgaagtagctttgatagctaatcatagtatgataactcagccagaagaattcactaagagcagtttgtgtgtcttccatctaatgtaaaggttagtaatgtaagtcatattcttggtgcctttagacctagttatgcagagagacatcacattgacattcagtaattcttactcttaacagttccttaactctaaaatcatctttttccttacctttccctagttctagaacagcaaaatattttacttagattctatcattaattaatatactcgtttgaatttttctcttctaaaaaatgtaggccaggcatggtggctttacacctgtaatcccaggactttgggaggtcgaggcgggcggatcacctgaggtctggagtccgagaccagtctggccaatgtggcgaaacccaccccgtctctactaaaaatacaaaaattagctgggtgtggtggtgtgcgccatagtcccagctactctggaggctgaggcaggagaatcacttgaacccgggaggcagaggttgcagtgagccaagatcacgtcactgtattccagcttgggtgacagagcaagactctgtctcaaaaaaaaaaaaaaaaaagtaaaattattttggccttaccatgcttggtttctttgtctttgttttttcattcactttatgtttggggaggagaatggagtgtcagtgatttcagcaaaaagttggggtaccagttcataataaattagtgtctaagattaatgttacagctgatattcaaagtaccaaatacgttattgttctgattattctggtccttaaatttgtctctttcctggagacgtggtaaacaataatgatgattctaataatgaccatttattgaatgagcactatgtgtcagacattgtactggtgatgtggtttggctgtgtgtccctacccaaatctcatctcaaattgtaatccccacgtgttgagggagggacctgatgggaggtgattggatcatgaggatggtttaccccatgctgtcctcctgatagcgagggagttctcatgagatctaatggtttaaaagtgtttggcagtttcacccttgcacccatgtctctctctgtctctcctgctgtcatgtgaagaagaggtccttgcctccccttggccttccaccgtgattataagtttcctggccgggtgcagtggctcacacctgtaatcccagcactttgagagaccaacgcgggcagatcacttgaggtcaggagttcaagaccagtctggccaacatggcgaaacctgtctctactgaaaaaacaaaaattagccgggcgggtggcgcacacctgtaatctcagctgttcgggaagctgaggcaggagaatcgattgaacctgacagatggaggttacagtgagccaagattgtgccactgcacttcagcctgtgtaacagagtgagactctctcaaaaaataatgataatagtaagtttcctaaggcttccccagccatgcagaactgtgagtcaattaaaccttttttcttcataaattgctcagtctcaggtagttctttatagcagtgtgaaaatggactaatgcaattgggcaatgtctgacagtttgcaaataccatctcatttgtttttaatagaaacctcctgctgagagtggtggctcacgcctgtaatcccagctctttgggaggccgaggcaggcagatcacatggtcaggagtttgagaccagcctgaccaacatgatgaaacctgtctctactaaaaatagaaaaattagctgggtgtggtggtacgcgcctgtaatcccagctacttaggagactgaggcaggagaatcacttgaacgtgggaggcagaggttgcagtgagcccagattgaaccactgcactccagcctgggcaacaaagtgagactccgtctcaaaaaaaaaaaaaaaaaaaatctaatactagccatgaggaaagataatcactctcagatagtaaagcatttgcttagccatatgttaagctctgaattcagatgaaggggcatctaaaacaggcagagagcatcaggaagggcttcctggaggagaaagtgcgtacactcagtctttaagagcacgtgggaggaaaaaccagtgaagtcctcctgctgtagacagaatgatcagcctgggcaaaggtgtagaggggtaagagagcgttaaacatgaggcagctgtgtaatattgtttcctgtaatctcttctgtacaggtggagaggtagcaagagacccaaatgatgaatggctgtgagtgccatgccatagcaaaattctgggttttaaaagagaataagcatgatcaggctggggatgttgaggaggggaaagaagggggatagagatggagaccacccagtggcccgctctccctcagtgctttggattatggggaaatgaacagagagccactgtgcccagattttattatgggttgagcagtgatcaagatgggagagagaaatggtaatgggactaactggcccatacaccagatggcatttgaggggaaggccgggtctgtgttgtcagggggccctgtgttctgactcccttcccattagaataggtggtgattaaacaagctatgccacaccctaaattctggttctgggttttactattcagtcagttttatcaaattaagatgatcatgtcttcccttctgaaaaattataggggaagaaaaaccatagaactttcccccagtatatagcattgaattacacatattcctacacacacacacacacacacacacacacacacacacacaccactcacacatatatacgtacatacatatataatagaatttttatataatatgtaaaattttaaaaatatatatttttagaagggctgggggtggtgggggcggtggctcacacctgaaatcccagcactttgggaggccgaggtgggcaaatcacctgaggtcaggaattcgagactagcctgactaacatggtgaaaccccgtctctactaaaaatacaaaattagccgggtgtggtggtgcatgcctgtaatctcagctactcaggaggttgagacaggagaatcacttgaacccaggaggtggaggttgcagtgagctgagatcccgccattgtactccagtctgggcaacaacagcaaaactctgtctcagaaaaaaaatatatgtgtgtgttttataaacctataaaatatgtgtgtgtgtgtgtgtatatatttatatatttatatatattacatatatatatatgtttagaaaataaaagatgcagtatgtcagtgctttcttatgacagttgcagctacaaaggaagattaaagctttttaaaaagtagaatttttatctgtttgtggagaggactgaaaccagtaagctcttgaaatgttttcatcctctcatcaaatatatatggacctgccatatgccaggtactgttcttactactgtggaaatagcagaaaggaaaaacaaagtccctgctctcagaaggtttagaatgagataaggcaggctactgagttggcttaaaaactaagaggaaactagtgaagtgtagttgcccgttcacatttttatttttttaagtattttatgcccacggaaaactgtgggactgggacttgaattctaattttatgttttcttgggttattctttaaaacagggtcttagactagtaattaatacagtgtcactctctttcaccttcctcaattcctttgcatgcttgttaggtcattcagagtggcactaaggtaaactttggcatatcaaaatccacttgaaagcagatggttagcaaggggcagtgacttatgcctgtaatcccagcattttgggaggccaaggcgggtggatcacttgaggtcagaagttcaagaccagcctggccaatatggtgagaacccgtctctactataaatacaaaaattagctggtgtggcgacgcacacctgtagtcccagctatttgggacggtgaggcaggagaatcgcttgaatccgggaagcagaggttgcagtgagccaagatcgtgccattgcactccagcctgggcgttacagcaagactccatctcaaaaaaaaaaaaaaaaaaaaaaaggagatggctatgcttgttaaacactgtttcagttgagtacctctcctgtgggcttgttggttcttgtgcagattcctgctcctgcccaagtccaggactagctgcacatacctgcacatgtgcctcacccagtccaggacggctagccttgttctcttcacccagcccagcagcagagtgctaggaaactttgctggcagggctgtaagaacctctgtagtttcttcccatttccttgttctcctaacttactatgctgggaggaaataatatggtgtggtaacgattttaggcaaagaaaaaaagcgccgaaatggatgtggtggtaaaattaggccaatcttttggaagcaccttagcaacctcctttcatgttcttggtacctttacctggttgtattgtaatgttcatttttccttgtgaacatctctctgtgtgtgtgtatgtgtataatttatctagtaccatggaatctttgaaggaaagactaaaaaactttcagaattattattattattattattattttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgaaaactttcagaattataacaataagtttcatttgttgtatagcacattctacgtgaccatagaccaactctcctttatcaatatttgtgtattctcttaaagagctaaaagaaatcattttttaaaaattctttatatctaatgttggccaatgttacctataagaaa

SEQ ID NO: 77 - DNA, 3551 bp, Homo sapiens
  source 1..3551: mol_type = genomic DNA
agtgtagtgtggtgtgtcattagaagcatgatttgttcttaccaatgcagtgattacattggttcttctacattcagtagaatgctaataatgtggtaatgctagtcgccagtcttcttaatctctataacagaggaagcagaagtagagcagatcctatcctagccttgtaggtctagagaccgaactatagtgtcttctgggaaagcacttaaacaaaacacaggtttataaattgttatggtcactaatgtttcagtcaagatggtgactacctatgatttgtgtgtatgtgctacccttttgagaagcattaattagtccgttctctcactgctataaagaaatactggagactgggcaatttataaagaaaaggggtttaattggctcagggttccgcaggccaggaagcatggtggcttctggggaggcctcaggaaacttagaatcatggcagaaggcaaaggggaagcaggcacgttttacgtggccagagcaggaggaagagagaggagagaggtgctacacgcttttaaataaccagatctcacagtaattcactgactcactgtcaccagaacagcacccaggggatggtgctggcccattcatgagaactctgcccccatgatccaatcacctcccactaggccccaccttcaacactcgggattactgttcaacatgagacttgatggggacacagatctaaaccatatcaagcattaatattactattaacctgtgtgaaaaggaactgaattctgctgtgacattttttgtttaagaattaggcctagcaggtgtggtggctcacgcctgtaatcccagcacttcgggaggccgaggtgggcggattgcctgagctcaggagttcaagaccagcctgggcaacatggtgaaaccctctctctactaaaatacaaaagaatattagccaggaatggcggtgtgcacctgtagtcccagctactctggaggctcaggcaggagaattgtttgaacctgggaggcagaggttgcagtgagcggagatcacaccactgcactccagcctcagcaacggggcaagactccatctctacaaaaaaaaaaaaaaaaaaaagaattaggcttagggagtgcatggtggctcacgtctgtaatctcagcactttgggaagctgaggtgggcagatcgcttagggtcaggagttcaagatcagcctggccaacatggcaaaaccccgtctatacaaaactacaaaaattagcaagccatggtggtggacatctgtaatcccagctactgagaagtctgaggcaggagaattgcttgaacctgggaggtggaggttgtagtgatccaagatcataccactacactccaggctgtgtgacacaatgagactgtgtcttaaaaaaaaaaaaaaaaaaaaaaggccttaagataaaaaacagtgaaataaaagaagtcatatttttaagaaatgaaatccctaatgtttaaaaattatttaatgtataaaattatcaatttttatacattagggatttcatttttttaaatatgacttcaggctgggcgtggtggctcatgcctgtaatcccagcactttgtgaggccaaggtgggcggatcacctgagatcaggagttcgaaaccagcctggccaacgtggtgaaaccccatttctactaaaaatacggaaattagccgggtgtggtggtggcatgcacctgtaatcctgaccagccagctgagatcgtgccactgcacttcagcttgggcgacagagcaagactccatctcaaaaaatgtgtatattatatatatatgacttcatagacacacattggtctatacaacaaaaacaaagcattaggaaattatctcatgatttagccacaaaattaaaagatttatttcaacaaacacttattgaatgcttacccatttgactggatgatgcgtaggaataacaagaggtctgaggcatagtagtagacccatggagctgatagtttcagggcagggtagacatctaataaagtctttgtttccttttgtaagtttctctaagtttgtttaggatacctattttgacagccatacagatcttcagaaaatagggattatcaccagacaccacaaggaaataggtggaaaaatatttaaaaataaattgtaagccaagcatggtggcccatgcctgtaatctcagcatgtgatttgggaggccaaggctagaggatcacttgaggccaggagttcaagaccagtctgggcaacatagcaagacctatatctacctaaaaaaaaaatttaagaaaatttaaaataagtaaataaattgtagtaaaaatgtaggttatgtttcttcgtctgaaaataagctattctgaaaagctaagctttcccaatggtacatgagttctctctctaattatatcttctgtattcctctctcacttgaataattttcttttgaaaactttctgaagttatatgctttcagactttgtaaaataatatgttgaacatgattaatcatctctcagttaggttcattattttcaatcatattattgtattgtgctgtgataacaatgtccctagaaactggacagtttatagagcagttcgcctgatcatttttgttttttaagtatctttttttttttttttaaagacagtctctctctgtcacccaggctggagtgcagtggcacgatctcagctcactgcaatctccgcctcccgggttaaagcaattcttggtctcagtctcccaagcagctgggatgggactacaggtgcatgccaccacgcctggctaatttttttttgtatttttagtagagacagggtttcaccatgttggccaggctgctctcaaactcctgacctgaagtaatccacccgcctcagcctcccaaagtattgggattaccggcgtgagctactatgcacaccccttaaacatcattgtaaaaatcacttcccttgctataggaatttggctttgagttactaggccttccagaagccatccccatgactttgttatctggcctaagccataggtggggagtggggagggagacatccaaagttaattagaaccaagtataaatttgccatggatttaagccttctgtataagataaattcatccatagtatttttggattactttatttacttgattatttatttacttatttgattatttctgttctcattaattttctaattatgactagacaactaagttctgggtaagatatgtcattattacgtaatgatgtcttattcttggcattataaatgactatactgtgttgtagttttattatatttatgacatatgagaaataaataataggaactttaagaagactctatcacttcatatctctttggtctctttctctgtctttaacattggtcaggttccaaactagtgaaaactacagaaacaagtgcagttttctagtatagtctttcatcttacgaaaatatatttaatccccactcttttttaagtttcactttgccttaagggg

SEQ ID NO: 78 - DNA, 9360 bp, Homo sapiens
  source 1..9360: mol_type = genomic DNA
aatagaaaccgaaactttttaatggaatgcaggaaaatcttaaaatggacgctagagccctttgataattattataattttatgacagcaatgttaagaataatggtgttaacaaaacttttatattttgaatgtgtttgtgtatttgaatgtatttggctacaaacagccataatgtaactagcactcattgaacacttgctatgtgctgggtaggcatgggattaggcacttccatacctaattttgttcgatcatcagagcaactctaagagagtaggtactattaatattgccatgttaatttataggggcagtgaggcttaaggaaggctaagtgatttacgtaaagactcatagccagtgattagtaggtagagtttggattcacacctgggactttctgactacgagaggcgaggctcttgagcactatgctatgtcaatgtttttaattttataagaaaatgaactttgtttctcttattataaaatgtttttctatggataaaataaactagttcatcttacctgaaaaataattccttgtaagatattgagttcttcctaaaaaaagaattaagtattgccatttctaaattgatctacttgtgagagtaattgcgataataaatatgttaaagattttaaaagaaaaattctgtattatatgaagtttgtaccatttgttattataaaagaggaaaaatatatttttctctacccatcttagggtcaaggctgaggtcactataacaagagacagatttaacaggagaaaggcatacacatttatttaatataaatttttttgagacggagttttgctcttgtcgcccaggctggagtgcaatggcatgatctcagctcactgcaaccactgcctcctgggttcaagcagctctcctgtctcagcctcccaggtagctgggattacaggcgcccaccaccacacccacctaatttttgtatttttggtagagacagggtttcaccatgttggccaagctggtcttgaactcctgacctcaggtaatccacctgccttggcctcccaaagtgttgggattataggcgtgagccactgtacccggcctatttaatataaattttatgtgacataggtgccttcataaggaagtgaagaacccaagaaacaggtaaacttggatatttttatgctaggtttgatgaagagtggaaagttgtagagaaatatgataggacaaagagtgtggtccagtggtaataagctagagagaacttagcaaggcctgcttgttcagattcttctctgtgatcctttagcttcagagatcaggtatagggagggcaccccttacgtgatggtcttatgacctgcattggggtaaggggtaaggggagggtcagagtgaccttcctgtgtttgatttgagggtagcgtgtcctgaccccctcattattttcatattgcttattcttttactctctgattagagtaaatttctaagaatagggctctagggaatagtcctagtgatttttcttatatcaggggtgtccaagggagttcttagtttctgtttcaggttgtgccagtaaagccccctccctcatccctcttttctgcttatcagtagagacagaaactaaaaaccatggcttcaggctgctaaaagcctaaaacaaaacataacaaaacagaacaacaacaacaaaataaggcaggttggatgagcttgtcttacatcatacccgtcttgaaatatttgaattattttactaaattaatttctttaatttatataataccttttctctgatgactcaaaattcacatacccagaactttcacacaataggtaaacttctgttaattgccagtgggttattttttgttctgggaggtttttataaagcacatagccacttcttttttaattaatagaagtagattttgccattgagaaacaaattcgtatttctgggctttgtcaaccactatcagctgtgaatttacttttctaaatgcacaaatgagtctttcttattacttttattttccattttaggctgttatccagaagttcctctatctaggtaggtagatgcatgtctctatgctaaatattaaatagaacctttccctgtctttttcttgggtatggctctatgtatttatcctaccatatattaaactctgtggatgataatttgctttgattcattatttttttaacagtctgaagcatcaagcccattggtggcacattatttaaaggttctatttgaaatgcacatgactccctctagtcataaattctaagctgaggaatggaaggccaaaggtgaagagatcttcatgttcaaccctcttgtactcattcggtatctgacatactgccctgccatgtttttgtgacaaatgtatagtagagtctcaccacacgtgctggtgatgtactcacattcaattccattcactgagagagagagaaacagtaatgcagaatattctacactgcctcccattctgttcagtgagcccaggactgagtgaactcaagatggaaagatgcatgtgttacttcttgtggagctgattctggagcgtaaagagtagtatttctttctcagtgggggcaaaatgtaaaccaaccacttcagctgagaaaggacagctatagggggttgattcaactttatgtgatttctgcctctggtgcagaattcagaccctaatcatcaaattagctatggcattttctactagtcatatcttcctgttcagattataaacaatctgagggttgggggaaagcagcttttagtatttcctctcctagaagtatctttaaaaaaaatctctcccaatggcaaggaagatacttattgacacaaaaggattttatacatgattccttgatttttctttcaggagatgatcgaaatattgaagaggtttatgtgggcggaaagcaggtggttccgttttccagctcagtgtaagaccctcgggcgtctacaaagttctcctgggattagcgtggttctgcatctcccttgtgcccaggtggagttagaaagtcaaaaaatagtaccttgttcttgggatgactatccctttctgtgtctagttacagtattcacttgacaaatagttcgaaggaagttgcactaattctcaactctggttgagagggttcataaatttcatgaaaatatctccctttggagctgctcagacttactttaagctcaaacagaagggaatgctattactggtggtgttcctacggtaagacttaagcaaagcctttttcatatttgaaaatgtggaaagaaaagatgttcctaaaaggttagatattttgagctaataattgcaaaaattagaagactgaaaatggacccatgagagtatatttttatgagggagcaaaagttagactgagaacaaacgttagaaaatcacttcagattgtgtttgaaaattatatactgagcatactaatttaaaaagagaacttgttgaaatttaaaacgtgtttctaggttgaccttgtgttttagaaatttgcacttaatggaatttgcatttcagagatgtgttagtgttgtgctttgccttctttggcgatgaatgtcagaaattgaatgccacatgctttcataatatagttttgtgcttcaaagtgtttgacagaagttgggtattaaagatttaaagtctcttaggaatattattcatgtaactccatggcataaatagttgtatttttgtgtactttaaaatcaacttataactgtgagatgttattgcttccattttattagaagagaaacaaattccatgctttatggaatttatgtagactggagtcttcgtgaactggggcaaatgctggcatccaggagccgccaatactaacaggacaggttccattgccatggcctattccacccaaacaatatgttgtagtttctggaaattccatactcagatatcagtctgctagaactttaaaatgaaggacaaatcctgttaaagaaatattgttaaaaatctttaaaccctgtgtattgaaagcactctattttctaattttatccagttttctgtttaactccttataatgtttaggatattaaaattttaggataatgaagagtacataatgtcctacttaatatttatgttaataggacttaattcttactagacatctaggaacattacaaagcaaagactatttttatgcttccataacctagaattaaaaccaaattatgaccttatgataaatctttaagtattggtgtgaatgttatttaaattctatatttttcttatttaattacaaatactataaatgagcaaggaaaaggaatagactttcttaatatattataacactcattcctagagcttaggggtgactctttaatattaccttatagtagaaactttatgtaatatagctaactccgtatttacagaacaaaaaaacacagttccccctcctgtagtataaattttattttcacatacttagctaatttagcagtaattggcccagttttttccctaatagaaatacttttagatttgattatgtatacatgacacctaaagagggaacaaaagttagttttatttttttaataaacaacagagtttgttttgtgagataagtatcttagtaaacccaatttccagtcttagtctgtatttccaatatttctaattcctgagccacgtcaaagatgccttgccaaatttctccccatttctctacggggctagcaaaaatcttcagctttatcactcaacccctgccaaaggaacttgattacatggtgtctaaccaaatgagcaggcttaggaatttagatgagatgtgtaagattcacttacaggcagtagctgcttctagcatttgcaagatcctacacttttaccttctttaagggtgtacattttgatgttgaacatcagttttcatgtagacttaggactcatgtgcagtaaatataaataagtgtagcatcagaagcagtaggaatggccgtatacaaccatcctgttaaacatttaaatttagctctgatagtgtgttaagacctgaatatctttcctagtaaaaataggatgtgttgaaatatttatatgtactttgatctctccacatcacttataacttatgtgttttatttctccaagtgcggtgttcctgaatgttatgtatgcttttttttctgtaccacaggcattatctatacctggggccagattttctgcactttgaaatgttgcctttgcctaatgtaggttgactttctgaattgtggagaggcacttttccaagccaatcttatttgtcactttttgttttaatatcttgctctctgacaggaaagaaacaattcacttaccagcctcctcaccccatcctccaccatttccttaatgttccatggtattttcaacggaatacactttgaaaggtaaaaacaattcaaaagtatcgattatcataaattcacaaaatatttttgcaaccagaacacaaaagcaggctagtcagctaaggtaaatttcattttcaaacgagagggaaacatgggaagtaaaagattaggatgtgaaaggttgtcctaaacagaccaaggagactgttccctaatttattctcttggctggttctctcattgaattatcagaccccaagaggagatattggaacaggctcccttcatgccaagggtctttctaagttaatactgtgagcattgagcccccattaaaactcttttttacttcagaaagaattttacaggttaaagggaaagaaatggtgggaaactctccccgtaatgcttagccaactttaaagtgtacccttcaatatccccattggcaactgcagctgagatcttagagaggaaatataaccggtgtgagatctagcaatgcattttgaatcttcactccctaccaggctcttcctatttttaatctcttcacctcagaactagacatatggagagctttaaaggcaagctggaaggcacattgtatcaattctaccttgtgctatacgtaggagagatccaaaatttggatgcttctggagactcttagacatcttttcattgttgtccatttttaaagttgatgattgctggaaacattcacacgcttaaaagcaatggtgtgagttattaatgggtaaactaagaagtgttataggcaatgacttgaaatggtttttaaattgtatggattgttaagaattgttgaaaaaaaattttttttttttggacagcttcaaggagatgttagcaatttcagatatactagccagtttaggtatgactttggaagtgcagaaacagaaggatactgttagaaaatcctaacattggtctccgtgcatgtgttcacacctggtctcactgcctttccttcccacagacctgagtgtgaaagactgagagttgaggagttactttgtggatcttgtccaaatttagtgaaatgtggaagtcaaccagaccaatgatggaattaaatgtaaattccaagagggctttcacagtccacagggttcaaatgacttgggtaacagaagttattcttagcttacctgttatgtgacagtgatttacctgtccatttccaacccaaaagcctgtcagaaagcattctttagagaaaaccactttacatttgttgttaaactcctgatcgctactcttaagaatatacatgtatgtattcataggaacattttttctcaatatttgtatgattcgcttactgttattgtgctgagtgagctcctgtgtgcttcagacaaaaataaatgagactttgtgtttacgttattttttgttgtgagttctctctgtttggttttgttgtgaattctatcaatctgctggaagaggaattgattttacaatgtttttcttcttttagcatgaatttaaaaaaatagaatagaatactcagctgtgagccaacatgtatctaacatcctataatagtcactatacatagcttttaaaaattaagctcgaatgttcagccttttagaagcagattgctattgcttttgatttcagcatagtgtatattttatatattttaagacattacccagagtgagtaatgcactctatatgaagaatcagttcacacagacatatgtgcatgtgtatttaaaacaaaagtttcacagaaaaatactttctctatttgtgatgccctgggctattttctatactattttagtctatgtcattttattttattctctacttttttatggtgctgatgattccccagttggtttcttgagcttctaaggaatcacctgcaattcagaagcaatattccagtatcttttgatctatgtttgaatctaagtttggccattgccttgctgggtggcagatatgttactttaagtgtccatttctaactctgtgatatggagataatatgagtgcctgccttacagtcatgaagattaaataaaaggatacatagacagcacttaagctagcagctggaacacagtgagtgctcactatctggtagctattatcctaaaaattaatatagaccaaataaaaatagaaataattttataaatatttttatcagtatatattttagaatctaaatcaagtgatattacggatcctcctttacacagaaacactttgcatctgatttttcaacagtattatatattctttttttatttgtaatatgaaacataaagacagtagtagattaggtctataaattcatcccaatgtctgagcagcttacagaacaagtcttcggattgcactggtgacccagctcatcccctctttctctcttgtagttctcagaataactgtagaatgtgctggaaatggaacattctcagataaggaggaactggccagatcaaactaagctgtgttcccatccctcctgaaacaggatcttatggtgctttagcccaggacgtcaagtatcccctaggtatgaaacccagagtggagcatgctttgaaggtccctcagctacatgcagactagactgcatgtagctgactctaactgccctgggaaactatcctgagctttgacagacctgccatgaatcttaagcttttattgtcccttgctgcctatctgtgaggaataaagttgcttcacttactttgctgtgtgattgttctgtctcaccagactcatgcgagaggtagaaactgcagtcccaagatgcagtgggcatgatgaaactgcttcccacaaattactgagcactttatttttctcctaaagatcaatttagtataaaatatccagaaaagaaatttcacatgcttaatttagcaataatgtatgtccagtttgcacattgtagacactgggtattacaacagataatatataaacgtgcaaattattgcatggtactaaattcaggatttaaattaaaaaaaagatttggatataagagttagtgggtgcagcacaccagcatgtcacatgtatacatatgtaactaacctgcacattgtgcacatgtaccctaaaacttaaagtatagtaataataaaaaaaaagataaatacctcccagtagcaaaacaggacttgtgttatggtgttctaagactccatgaagaggccacttagttactggaactactggaacagaactcacaggtaacgctcaccaatggcagcaggtgttttgttttgttttcatcttattttaaaacaggataaaagggagatgttctctgtctttgatatgacagtattttaaagtgtaattaattttttaaactaattcagacttatcacttttatctccagccctgccctaacctactaccacatcattgtaagactacattgcatttatcatacttaaaaaattgttcatgcgtctataatagttgaatctaaattttggagcaggagtatagatagagagataaaagcattttctctgtagcaaaaactttgttgggaaattcttcaatggtaactaaaaaaagtaaaaaataaatgttttctctccagtacaaaatgcaattaaaaaaaaaacaaaaaaacaaaacagatcacacagaatttcatactccacttgggccctcctctattgcctggcttctgtagagaggaagcaaacatttgttccctgtctgtagaaggagaacccaaagtcataagcagtcaaatcaaactgcagaaataacggccctggaagatggttatttggtcagatgacatccactcacttgaaaactgaacttgtagcttcactgtgaaattaacttctgtccttttagtctgggcc

SEQ ID NO: 79 - DNA, 307433 bp, Homo sapiens
  source 1..307433: mol_type = genomic DNA
cttcaataggatcagattagtttcatcagcatgcaaactatagtaacacctccatcctgaaaaagtctcatagatccctcatacacttccagccatcactacattttaatgaactaacagagactgatttctaggaggtactttttttttggcagggggacagagtctcgctgttgttggcctaggctggagcgcaatggcgcgatctcggctcactgcaacatccacctcccaggttccagcaattctcctgcctcagcctcccgagtagctgagattacaggtgcccaccaccacgccctgctaatttttgtatttttagtagagatgaggtttcatcatgttggccaggctggtctcgaactcctgacctcaggtgatccacccacctgggcctcccaaagtgctgggaagaggtattgttaactgcaaaaactcaagtgcaagaatatatataaaatgctactagcataagaaagattggaaatagttgaacaaataggtatagccttaattttgcagacagaaacatgaaggataatctagaaactaatgagactcactaacaccctcaagggtgggaactggagggaagagattagagggaggaagtgggtactgacacttctatgattatatctctttgaatagtttagacttctgaaaccatattaatatttcatatatcaaaataaaataaataggagtgaggaaacctaacattacctctaatgaataaaacacaaccacaataaagaaataacctaagtaactcttcacacaatatgtttagtattgtatattacagtattacataccttcagtccaaagatataaagtacagctactccttgacttgcaatggggttatatcccaataaactcatgggatgttgaaaatatcacaactggaaaatgcattttacagatgctcctcaacttaaaatggggttacaatttctactgaatgcgtatcacttttgcaccatcgtaaattgaaaaatcgctaagtcaaaccatcattaagtgagggactgtactgtcaataggtaataagctctggataaaaggtatgtttaccacagtggtatggatcagcaactctgaaattactttcagtaagttacaggattgagcaaatgagtcaatatactgcaggtactacaaatatggaaagggagaaggtaacaatgaaccctgtggtgataaactggaaatggaggtaacaatataaactcatggttttcaacatgtaagtacagaaatggttgtaaacatgtgtgtgtgaatatgtaatgtaatttatctacttatttcttaggtctgtcttgagaagcaaagacacccatgtaacagtgagcacatgttgtacccagatcttggttcttcaataccattccccactaataggaactaagaacttgcacctgtggctgcaatggagtaactggtactggatcccctccctcaaaatatatgaaatggctcagctattgatcaacaggcagtaaaagactaccatctgggatcctgtgactgtccctgttttcttcctgaagacacctgacagactggtagaaggcaggggtaccccaacaaagcactgtggtcttgctgatcgagatcagcgtgcagggaggctgaggtggctggaatttacagggcagataaatggaaaggtggggtaacctctcagaggaagagctccagtaaaatgcactagggttccctaatgcttaggctgaacagtaaactcccaattcatagaaaattactagagaaagaaaaaacaaccagggagctatgaaatgaacaaatcctagagattacactgagctgaaaggcattcacgctatgaccagcaggaatagagagaacttgtcaacacctatgtccagctggactgatcctccaggacagtaactaccttctgcagcaaaaccacactgaataagaaagatacctaataggcatgtgtcctatctgtcacaaaacaaaaccaattgacagttatttcacataattctaaagaaaaaaaattaccaaatgtttacagtcacaaaaaggtaacaaacataatatccattaatataaaatttaatgagtaaataatactggtattaatcatgttgcctttttctttagagaatgtaaaaatattgactacctccatctctttcaaccttattttaccccgaaaagcaatacattattcaaatgaaacttcaactcagggagtttttaagaaccataaacctcaagatcatcctaattggtgctggccttcaaatctagcattcacccaaatgacactatcactgaacaaaatacttctcaaactatgagttgtacaactgtttccagatcactcaccaagcacacaagaaaaaatgaacatttttatttttatgtcaagaaaaacagcctccatggccaagcctctccagcttcttcctgcaaagcccagtgtaactgacccctgctcctccagctggaacaaacagagaaaactggagtgtgaaccagaagacagcaaaaaacagcctgcaggccagtctgcacccagcttttacatcttttctaagggttgtaaagataaaacaaagaatatgtgacaaaaattgttaagaggcacacaaagcctaaaatatctggccttttacacacaaaatttactaacctcagtctagactaatgccagttcccagagaaagccctgagaaggcaaactactactgagtatcaatttccagaagcagactgacaaaaatctaattttttctaacttttgaagtctccctttctaactgccggagctctactcaagctgaccaaagttctagagctgaattccactcccctggcctcatgcaagaggggtctcctgcaggaaggaccccttccagcctcccactgcccacaatgctcacctcaccacataactgggcagccttggagaaaggggactgagagaaccacctaggctctctgaccagctgcccacccactagggggggcccattctctgctcaccccaacagaggcagctgtgctcctccaagacatcccttgtggtagcaggtgggagagagaacttgaagtccatctgggaacacatcaaagccatatctttgaaacaggtttaacggtaagtcataaagctaatgttttaatctccactggttaaatttactggtaccctagatacaaccttctatttataagactgacaatatctcaagaacaaatcactcttcttaaccacacaagccacctacgcatgctctgtatcaaagcttgttttatttaaccatgacattttgccaatgttacttcctcaacaaccaaaatggttcacagtcatcccatgaactatttgctaagtgccttctatgggccaggcactgttctggcaataggcctctgtcctaatgccaacgaaaggagcttatctgcgggggaggctgactgataatcaataagtaaaaaataaattcaagaacagaaacgttcagagatgaagctaaaatagaaaaatgtgatggaggctgggggaagcagggagacctgctttggtttaagtgatgagggaacagctatttaagatgacattagagcagaggcctttctgaacacaaagagaacactgagcacaacgagttggagagaagaatgagctttgtcaagcagagagagtaagaaaggcagtgggaaattggtgggaaaaggcaatgtggccagagtaggcgagacctgacacacttggtatcagtttcctggtgctgctggacaaataactacaagcttaaagggattacctgacaattctaggtcagaagtctaaaatgggttggcaaggctgcattccttctggaggcactagggaagatgagctcccttgcctttcccagcttctaggggctgtccacattccttggctcatggccccttccttgcttctctccaacttctgcttcctgttgtcatttctcctgctcagagtcctcctgcctccctcttgtatgaacccttgtctttacattgggcccagtggatacatcaggaaaatctccccatcgtaagatcttcaccttcctcacatctgcgaagttcctgtttccatgtaaggttccagcattaggacgtggacaactttgggggtcatttctgcctcccacacactttatttctgaacagtgtctgaaatagcagagtgatgtgatccattaacttttttaagatcacttgggctgctgtgtggggaaagggcaagagtggaagcagattagtcagcaggttattactaatatatatttcctattccttaaaatctctacagatcctaaaatattatacaggtaggctttttaaaaaatggaattagagtcagaaatgaattagcaacaaccaatcaatcattacttacacagaaagggcacgagtactctgagtcatttttaacggcatctctgacgtgctcaaatgaaaacattaaaatttaagtgcagctgacctttgaacaacatcaggtctatttgtacacagattttcttccacctctgccacccctttgagacagcaagacaacccctcctctttctccttaacctactcaacatgaagatgacaaggataacctgtgtgatgacccacttccacttgatagtaaatgtattttctcttccttatggttttcttagtaacattttcttttctttagcttactttactgtaagaataaagcatataatacatataacatacaaaatgtttgttactcaaccctttatgttaccagtgaggcctccagtcaacagtagactattagtagttcagtttttgagaagtcaagttataggaggattttcaactgtgaggggtgggggcaggggtgcaggtggaggtgtcatctctcctaacctctcatgttgctcaagggtcaactataagaaaagaagggcctcaaatcagttatctaaacttccaccttaggaagctagaaataagagtaaattaaacccgaggcaaacagagagaagaaaataatgaagaaatcaatgaatagaaagaaaagcaaaataaaggaaaccaaaagccacttatttgaaaagataaacaaaagtgactaatgttttgctagtatttaagaaaaaagacacaatgtatcaatatcaaaaataaataatcagacatcggccaggcacagtggctcacacctataatcccaacactttgggaggctgaggcaggcggccttgaggccaggagtccgagaccagcctggccaacatggtgaaaccccatctctactaaaaatacaaaaattagccaggtgtggtggtgcatgcctgtaatcccagctactcgggaggcggaggttgcagtgagctgagattacactgctgcactccagcctgggtgacagagcaagaccctgtctcaaaataaataaataaataatcaatcagatatcattatagattcaatgtagtaaaaggataaggaataatatgaacaattttatggcaattaacttgaaaacttagataaaacacaaattaccaaaactcactcaacttaaaagacacaaattaccaaaactcactcaaaaagaaatgtaaaccaaaaataaaattctgagttcgccaactgactgatggaccctcccctccaccaagggcaatccaaagctaacctgagaaactagttcaggccatgatggaaagtgggagtgggagtaggacattcttcattatactctcctcccgttggaattcaggcacagatgaccagcattaacatcaacacaggacctgaagactgacagaacaggccctttaagtctgacaagaaacatttacaatctattttctctgaagcttcccacctgaaggcttcatttgcataataagaaccttggtctccacaactaagacactgcctttcactgattccaggtctttagataaattctttcaaccaattgccaatcagaacatcactgaatctacctataacctggaaggccccctatccctcactgcttccagttgtcccacctgtccagactgaaccaacgtacatcttacatgtattgattgatgtcttatgtctccctaaaatgtataaaaccaagctgtagactgaacaccttgggcacacattctcatgatctcctggggctggtcactcatatttggctcagaataaatctcttcgaatatgttacagaatttgacttttcaaacagaagaaactcaagtagccctgtatttattaaagatatcaaattcatagttacaaatcttcccacaaagaaacttcctagaccaaatgacttcgttggtgaattttaccaaacaattaagtaagaaataataacaactatgcaaacttgttcagggaaatagaaggaaggaacatttcccaattcattttatgagaccagcactatcctgataccagaactacagaccttacaataaaagaaggcaaaccaatttcccttatgaaaagttataaaatcctaaaaaacttaagcaaatcaaatccagcagtatataaaaaggattaatgatcgagaggtctgttccaggaatacacaattgttaataattgataatcaatcaatcattcaccatattgacaggctgaaaaataatatgagaatcttaatagatgccaaaaagagatttgacaaaattcaatacatgttcatgaaaaaaaaaaaatgcctcagcaaactacaaataaaaagaaacttttcaccctgatgaactgcatctgtgaaaaaactacagctaacatcatacttagtagtaaaagactggatgccttccccataagattgagaaaagacaaagacgaacactcacactgcttttagtcaactctataatgaaaatgtaatggatatataaaaaaaaataaaaggtgaacagataggaaaggaagaagtaaaactatctttattcacaaatgacttgactacctttgtagaaaaccccagagtatctacaaaaaagagtcctagaagtaaaaagtgcatttaacaaggttgcaggatacaaagacaatatacaaaaatcaatatactagcaatatactagtaataaaaaattgggagtaaaattaagaagaaatgccacttacagtaacatcaaaatatatgaaaaacttagaaataaatttaaccaaacatgtctaagacctgaacatggtaacagacagtgcggtattggcattaaaaatacccagagaaggccaggcgtggtggctcacgcctgtaatcccagcactttgggaggccgaggcaggtggatcacgagatcaggagatcgagaccatcctggctaatacggtgaaaccccgtctctactaaaaatacaaaaaattagccgggcgtggtggcgagcccctgtagtcccagctactcgggaggctgaggcaggagaatggtgtgaacccaagaggtggagcttgcagtgagccaagatcacgccactgcactccagcctgggtgacagagtgagactccatcgcaaaaaaaaaaaaaaaaaagtacccagagaaccctgacataactcacacatatactgtcaactgatattttagacaggtcccaaaataatgtaatgggggaaaagttggtctgacaaatggtgctgggagaattgaaaatgcaacaaaacaaaaaccccaaaaaaagccacctgtgtataaaaaaaatacttcgtcgtttttattccaggttcctggcccaaagctcctaaaaccctcagaatttcctgagtgacagagtgtcttttgttattcctaacatgcccttctcaaccaaacctgagtttatgctaatgaactgactcttagagggcccctagatagctccaggacaggcgctggtcaccagaaatatcaagccatgatcagagggttagaactttcagtgccctacccacaccttcagggagtgagaggagctggagattgagctcagtcgccaatggctaatgatgtaatcaatcattatgtaaagaggcctccataaaaaatccctgaaacagggcttagggagctcccaggttagtgaacacatggatgtgctgggtaagtggcacacctggagagggtatggaagctctgcaaccctccaccctaactttgctctaagtacctcctccacttgactgttcctcagttttctcttttataataaactggtaatagtaaataaagcactttcctgagtttcgtgagatgctctagcaaatcccattcctgagaccaattatgacgtctttttttctaacaccacttctgacaccaaatgtctgagggtttccacaccaattcttcaacatcaagcgggtatccaacaattcagttaaattctgccaccatccaaaattagtgggatcccacaagttaaggggtcccacaaggctgccctcacttcagatgcaactcacaagtcccaggggcaacccatatgtctgaaacaaccagctatagatttggggattcccctaaactcctcaggttacttaattcactagaatgactcagaatttaaaaaaaaaaaaaaaacactttatttactatatgcaactcaggaacagaccaatggaacagatgcatagggcaaggtatgggaagagggagtacagagcttccatgccctctttaggagtgccaacctcctagaaaatcaatgtgttcaccaacctagaagctccctgagccccattttttgttttgtttttttgagacagggtctcactttgtcacccacgctggagcacagtggcacaatcacagctcactgcagcctcaatatctcaggctcaagcaatccttgcacctcagccccctcaagtagctgggattacaggaatgtgccaccacacccagttaagagggttttttgtttgtttgtttgtttgtttgtttgttttggtagagatggggttttgccatgttacccaggctggtctcaaactcaagccatccacctgcctcagcctcccaaagtggcagaattacaggcatgagccaccgtgcctggctctgaaccccgctgtttaagggtctttatggaggtttcattacctccatagggagacatgaatgactaaatcactggccactggtaactgagctgaatctctggcccctttcccctctggggggagagggtgctaaaagttctaatcctctaacccatggctgctttttctgacaagctgcccccccatcctgaagctatctagggtcatctcattacacaacaaaaagcacttggaccattcaggaaactcccagggttttaagagctctgtaccaagaacaagggcaaagaccaaatatattttttattctctttcacaacatatataaaaattaactcagaatacttcagagtcctaaatataagatataaaaactacaaaagtattagaaaacaggagaaaatctttctgactgtggggtaaaacaaaatttctaaaattcacaaaaaggtacaaaccataaaaggaaaaaaaaatgataaatcagtcttcatacatgtatacatacgtaacaaacctgcacattgtgcacacgtaccctagaacttaaagtataataaaaaaaagaaacaatatgtaaatttttaaaaaatcagtcttcacataaaaaacttttgttcttcaaaacaaattataaggcagaaaaatgacaggccatttagtggaagaaaacttaccaagtataacagataaaagtcttgtatcaagaatataaaaaaaaacaaaaaaaaaaccttacaactcaatgagatgagattctaagaaaaacattgggaaaaaattcaaataaacaagtcatcaaaacagatatacaggtgacacatatgaaatgtaaactaaaactacaatgaaatatgactttgtatccattaggatgcctacaatttttaaacctcatattatcaagtgttggtaagcatgtggaacgcctgaaactctcatccgttgctagtgggaatgcaaaatgataccgaaaacagttggcagtttcttacaaaactaaacacacaggataaaaccagtaattctacttctgactatttacctgagagaaataaaattatgcattgccaaaaaggtgtgtgtgaatggtcacagaagtgatgcataaaagccaaacgatggaaaaacccaaatgaccatcacctaatgaataaacaaaccgtgaaacagtcatacaataaatactattctcagcaataaaataaaatacatgccaataaaatgaaactagtgaaacatgaatatggatgaagctcaaaccattatgttaaatgaaagaggtcagacacaaaagactacccatagtatgagtcaatttattttaaaattacagaagatgctaaactaggagcagcaaggagattagtactttcagagatcagggcaagggaaggggcttgactgcaaatggacacaagaaaactttttaagtaacgaatatgttctgtatcatgattctgatcatggtttaaatacctgtcaaaattcatcaattatacattttaaattggtaaactttattccaagtaattcatacctaaataaaacattttttattccaacaaacaatatatgacaacaacaaaaaaacaaaaccctatatagctaaactaatacaaacttgttaaactactacaaatttgtggtatctatcccttcacgttacttatcaaactctctgaaggactaacagttaaatacataaatatgacaatctaagattctgaaacaacaacggccaggttacttcatagtccaacgtgcccacacatctatccagatcatgacatttttatccatatgaacagcacacaacattcaataatgcatgttgacaattttagtgacaagtcactctttagtcataacataatttactagaattcaaaagcagaagcaaaactacctttacttttttataaaacccacactggtgtaattcagtgaaacaatttagggttctacatatagcaatcaattaccaagaattgtttatcatatatcttaggaaatttcaaaagaaaaaatcctcattctcagtaatttctcacaaaatttcatttcaaaaatgttctggtaaaaacaatgcatgtgcactttgttactttgaattagaaaagtaaaagaacaaaaataaacagatgacggtgatttcacatttacatccaacgcagcagcccaatcagacttctttagaattttgtgattggcaaatattaaaattttaactacataaacattttgaaatagcagaattgttttgacttgtgtgtgtgtgtatgtgtgtgtgggtgtgtgtatgtaaggcagagagacagacacacacacacacacacacacacagagagaagagagagggagagggagagagagagaaggtaaactaaaagtgattaaacagtttttagaatatgtaaggaggcagcacacattcagtccaatctcacataatccatgtagccaatgcttcacaagaagctttgactaacaaaattatttttcttagtattctaagagaagtacaggcaagccatgaacccagaagtggtgttctaatctacaagaaagaatacacaacagtgattcccaacctgaagggtatgactgtgatcacacatttacatccaatgtagccggccaaccagaaagacttttccagaatgtcacgatcaacaatatattaaaatttggggtatagcacaccatgtgaaaacacattatgtatgggaaacactgtctgtatctgtgacaactatgacatatttttatctgtatttacatattactgtggttaatagaaacatccattttaatacattactgtaacaatgacattttgacattacacaccttctcaatgtagggccactaaaatgtctaagtgtataaaattttaagaactttaaagagacacctcatattccttctaggttctagattagaaaccacagtctaagagaaaactctgtcctaactgtcaagagaagtagtttcagctaagccaccacctttaaccaggtctttcacttcacagggattctataaaattaaagggtctgaattattctataggaactcttttagtctaaaatttatcttctcaaatgttgtaatgggtcgggcacagtggctcgcgcctgtaatcccagcactttgggaggccgaggcaggtggatcacttgaggtcaggagttcaaaaccagcctggccaacatggtgaaaccccgtctctactcaaaatacaaaaattagctgggcattgcagcaggtgcctgtaatcccagctactcgggaggctgaggcaggagaatcacctgaacctgaaagtcagaggttgcagtaagcagagatcataccactgcactccaacctgggtgacagaacatgatttcatctcaaaaaaaaaaaacaaaaagaaagttgtaacaacaatttaggaactcagttaatatcccaattttagtttccaaaaaaagaaaaatacactaatatactttgtatttttcaaaattatttactttgcatatatttgcttaatataatttgttaatataacgaagttatttcagaaagtttgaagacagaaaaaatatcacctttaatccatgatcttttttttttcattttttcaaacagggtctcgctctgtcacccaggctgaaatgcagtggcacaatcacggctcgcagctttgatcttccaagctcatgcgactctcccacctaagcctcctgagtagctaggactacaggcacgcaccaccatgcctggctaattttagtatatttttggagagacagggttttgccatgttgcccaggctggtcttgaactcctaggctcaagccaactgcctacctcggcctcccaaagtgctgggactacaggtgtgagccacctggcccatgaacttattggcacagacatagtttacacagctacagtaataatggccataacattttatatacaactctctctatgcttgtaacaggttattttccacactccatgtatatcactttataagtatcgtatttatatgtctttatatgtatgactttaaatatctacttaacattctaatgagcgcatcggtatataataagtcacttaaagagaacatcctggtagagtccttagaaaatttcatccttgtataaacatcattgagtatatatacacaaacctagatggtataggccaggggtccccaacccgagttgatgaatggtactggtctgtggcctgttaggaaccggtgacacagcaggaggtgagcacaggcaagggagcattactgcttgagctctgcctcctgtcagatcagcagccgcattagattctcataggagcacaaaccctaccgtgaactacgcatgcgagggatctaggttgcacgctccttatgagaatcaggccaaggtggcctgatgatctgagatggaacagtttcaccctgaaaccatcccctacataaataggatatatggtataacatatttctcttaggctacaaacctgtacagtgactgtattgaatgctgtaggtaactgtaacacaatgctaagtatttatatgtacctaaacagaaaacgtacagtaaaaatacagtattataatcttatgaggctgggcacagtggctcacccatgtaatctcagcactttgggaggcctaggcaggtggatcacctgaggtcaggagttcaagaccagcctgggcaacatggtaaaaaccccatctctactaaaattacaaaatttagctgggcatggtggcacacacctgtatcccagctactcaggagactgaggcacgagaatcgcttgaacactggaggcggaagttgcagtgagacaagatcacaccattgcactcctgcatgggtgacagggagaccccgtctcaaaaaaataaaaacaaataatcttatgggaccagcattgtataatgcaggctactgttaaccaaaatgttgttatggagcacatgactgtatttgtgtatatatatacatatatataaaataaagtaaaatactaggacaaaaataataattatttatattaggggatgaataaagtagaggaagtagggttagagagagttctctctgtatacattttcatacattttgacctaccatgctacttttttaaactaaaaattgattaaaaaacttaaaatgtaagtgaagtacttaataatgctaaataatagatttctgagaagtcagaaatcacttggcccaacctccaatgcaatgtaggaatctctttaatgtttatctgttttcctagcattttagaaaaaagatgtagccaaatttactatcagtaaataggagagtggtatgagacaattcagagaagctgcttattatatcccaaccattcctgaaaaaaatcagtgaattaaagcacagtttaaaggctgattaattccagcaaataaatgctgagtccctgttgtttgctgtgttctgagaatgtaaaagatgattctcaaagaataagaggagttcctatgctcaagaaatttgaggcaagaccatttgctaagctttaaatatttagaaatgagcaaggtatcactggaatacagtattaatatatacagagaaacctttgtgggagaagaaaaagaagagggaaaatgatgactttcaagggatggagaagaggctaaaaggataatcaataaacggtacactgtgtttttgaggtttcttttttttttgagccggagtctcacactgtcacccgggctggaatgaggtggcgtcatctcggctcactgcaacctctgcctcccaggttcaagcaattatcctgcctcggcctcctgagtagctgggattacaggcacctactaccacgcccagaaaattttttgtatttttagtagagacagggtttcactatgttggccaggctggtctcgaattcttgaccttgtgatccacccacctcgacttccaaagtgctggaattacaggcatgagccaccgcgcccagcagaggtttcttttaatattactactttggagtacaaattaaagctttaattatgtgaaagaccacattcctcaacaataactgataaatgtggcctgattaagatgtttatactaatataggctgtaagtttaaatattctttaaataatgtaaagagattttatttacctataattttatttcatatgtacatgttaaaagacagacctctttgggaggccgaggtgagcggatcacgaggtcaggagatcgagaccatcctggctaatacagtgaaaccctgtctctactaaaaatataaaaattagccgggcttggtggcgggcgcctgtagttccagctactcgggaggctgaggcaggagaatggggtgaacccaggagccgagatcgtgccactgcactccagcctgggtgacagagcaagactccgtctcaaaaaaaaaaaaaaaaaaaaaaaaaagacagacctactggtcagcttataaatgtaaatacatgtaaaaaagaggccatgtgtggcctgtaattccagccctttgggatgccgaggcaggtggatcacctgaggtcaggaattcaagaccagcctggccaacatgttgaaaccccgtctctagcaaaaatacaaaaatttagccaggcgtggtggcgggcatctgtaatcccagctacacgggagggtgaggcaggagaatcacttgaacccaggaggcagaggctgcagtgagccaagatcgtggcactgcactccagcctgggcaacaagcgtgaaagtccgtctcaaaaaaaaaaacaagaaaggaaaacctttcggagaaatctgaaagaacagttccatcatatacactgaattactaaaagagaatgatatgccccaatttttctataattaagacactgacttttgttgacaaaatacagtcacaaatcttgagttaaaagattatcctgattgtacgaaagtttaaaagcacataaagcaaagtaaatagattaaattaacttgttaaaaagtactcaaggctaacatgttattctaataaacagcatgtggtatattatttgaggacattttgcatgtcctcaaaaaggcaatctgtaacagacatccacaaactgtgctaaagcattaaagcttttttcaaagtatattcctaatgcagaaatctagaacaaatgggctgcaaaagaatatgtaaaataaaaagaattccaccagtaactatagtgcaataattataaaacctactgccaacagaaaaacaatgccgggatgaccactaacacttatttttaaaatgttaatctgtcttcacaacattgatatcactcctcaaaaattcatataattgggccttctttaaaaaccctaaagctactctgtatcttcccaataagccatccaatgacctttagagaacctctcaaccatcagtcatgtgttatactcctttacctcaagatcatattcacctggtgaatatgatctagacataagaatcctaattctcttgatataagtctttcacattgtttaaaaaaacaaagaactcaaaatatacataaaacccttataagcactcctactaagcagacagtattactcacatttgacaaatgtgaaaacagaaatctgtactgcataacaccataaccctagcagctgggagtaataaacctacactctttggttactcaactggaattaaaactaattcttttcggtatcctacattttaagaaatgtattaaggaggcaataaaaccttatcaaaagccaaaatacactgcatatttctaaatatcacactattctgcaatattttaaggcagaagccacagagattgaagctttaaaaaattgagaatccttaagaatgaaactaggggccaggcacagtggctcacccctgtaatcccagcactttggaaggccaaagatggtgggtcacttgaggtcagcagttcgagaccagcctggccaacatggtgaaatcctgtctctactcaaaatacaaaaattagctaggcgaggtggcaggcgcctgtaatcccagctactcggggggctgaggcgggagaatcacttgaactggggagacgagggttgcagtaagcgaagatcacgccactgcagcctgggtgacagagcaagactctatctcaaaaaaaaaaaaagaatgaaactaaagaatattggccacaattaagacacaacaaacaacattgtactacatgtactacaggtactacaaacaagtattttaatggctcaaagattttttttcaacttccaaaacaatctaaatgttgcaaaagcttctttctaatgctgacagactaagcatgtttttttcttgtgaatcagtaaaacacagacaaagaggagttgttggtaatggggttcaaaccaaagaacattctaatggaaaacagattactattgaggaaaaatcagactacagtttaatttcataatacaacatatttacataccagcacagaatatccctgggacttcactcctgattattatggtccgtactttcttatcagatttcaaagcatccacagcttttgatagctaaacagaaataggaagcataggaggaaaaagagaaaaaaaaaacaaaacatttttacattgatgacaataatatatcttaatattagaagcaaacagtttaatctttacactcaccatttttataagatttttactgagtgaatttttgccataagctctgtttattccaagcaccacaattcctagttaaaggggaaaaaaagtacaagcacttgagtgagcaaggcattcagagaacagactctacatcacacatctagctagcttcgaacttaacaaatcaaagaaattcatgacatcacgttcccttcaatcgatctcttcttaagcaccaagataatttgcaacattttggtaaattttacatcactaactcaaactagagggaagactagacttattagtgaaaattttaagttaaaggatactatttaaaatgtggtttcatcatcttcaagtagataccaaagtaaccgctaataaaccttgtcacatgcaggtattatagcatctgctttttctaggaccagttgttaatatctccatttttttgttgttcatactacacagttttcagtaattctatcccaagcttctctcctgatttctgtctgatatacttaacctgagggcacttccatttagatgtccaagaagtacttccaactcaacctatacaaaacaaagttcattatctctcccacaaacccagctgtcactcctaactgccccactttttaatcaaagaccatcacctaaacccagcctcccattccttccagttaccaattttctaaaaacagtactatgcatagaatgcatcccctacttaaaatcctttcattatttatttcaaaatatccaacttcaaagatcctaatttgatattcaaagttctacacaacctctactaaccttcttgttcttggagtagacaaattttcacagtgtatcagaaataccttccactgagtcagggtgggtatgtttcttatttgcaactgagctaaactgaagacaacaaaatgtacacatgccttcgctgtgcaagaaactgtgcagacccattctttaaagtataaagatgaacttctgctcacaagagtaaatttgcaagaattccaaatgctctcagtacagagaaaagcataaaggactgctatctgacaggatctgtattaaacagctgaatgactttgggtaggtcccaatactactgacaacagctaccaccagtaggcctcaggcactgctccaggtgctttaagcgaattaactcatgtaatccccaccacaacccaagaggtgggcactacttttatcaatagttaacggataaagaaatggagacttggagaggtgaagtaacttccttcagctattaagtggtaatctaactctatacttgaataaaactgtgttacactgttcaagcttcagtttcctcaggaagaaaatcaagcagctaagactagatgtgtccattcattcaaacatactgagtacgtactatagtgatcagcagccatggaactagagtctaggagggaaatacaaacattaataatcatagaaatcattaataatcataaatatcattaataatccattcaaactgctttacaagctgtaagtggtgctacagtaacttgtaaccagaattgataatggtctggggcaaaaggagatggttagggaaagcttaccccagacagtgaaggttagaaggataagtaggagtcaaggtgagagtgaaggagaggggctgactgccaggcagaggaaacaggaaaagcataaactagtcatggtcccactgaatgtcctgtaacctacgagggggagaagagagtgaccaatgaaagtaaagaggtcagcacaagccagaaatatccttacagaccttctaaaaagtctggtcttcatcctaataaccattgaaggagtttacgtaggtataaacatatacacatgcacatataaaactggcgggggaatagtttctatacttggagatcataccagaagtagacaggggtgggagcttcaagacacaattcgagtccaatcaacagataacaggtttggctgagattggtggtggtaaaaataaaggaaagtgaaaggattcaagaactattcaaaaattttaaatgagttaatgatgcctagactgaggactgatttaactggaagaaagtgttaaggagtatttaccaggtttctggcttcaccaattggatgaaagatgacatttaatgagacaaaatcataaaactaccaaggtgagggtggaggggagtaaagctcatgagtttctgtttttaattaaagtgaatctgaagtgcctttcagacatccaagttgatacaacgtccaagggctaagaatgcaggctctaaggtgtgattgctggggatgaaatcccagtctgccgcttactagctattcggcaagttacttaacctctgtgatcctcagtttcttactctattaagaattcggcaagttacttaacctctctgatcctcagtttcttactctattaagatactaacagttccacactccatgggactgtattagaatcgaatgatatgatacatgtaaaatttacaacatgaggacccaattaacctcccttctagcatgaacacctctcatgcagtaagtattaaaagtttcaccataatttctgctagatatgataatgctgacattattactgaagggtaaagtgccatcaaaatgtttctaacacagttaattccagcaattttggtcccatatctgagacttgatgttttgagtacttccacttcaaaaagctagaaattagctctgcaatctgaaatgaattatctaatatgtaacaactgtaccatcaaatgtatctgtaggcttttggtattctaaaatggaataaaaccttagctttattcagcaaagtctaaaagtttttttttataactgtctcactttaattcacaattcaatcacttctcaagaactcaattatcatgcatcctcctcacataacctagaaagtttaccaaactcagaaaagcttaggcgttcacatgccaaccttaattttcctgacttttcacaaaacatacaaaaatcttcagtgaatctgtaacaaggtcacatcacagcatgaatcctgctctataaagctcacacaactgaaagatgaatgtaacaactttgctgagactttaaaaacaaaacaaaatacgttctgcttatacaaaatgaaaaaatacactcaaagtgaaagtcctccttccctagaaccagctcattcccttccccagaagaagccacagttatcacagttacatgtaatgtaaccttccagaaaatgttcaacgtatctacatacagaaatagagttgtatattaccatttggcttgttgttgctattttacataaatggatcatatgttctgttggagctattctacataaataggttcatacattttttctttttttttaagagacaaggtcttgttgtgtcacccagactggagtgcagtggctccatcatagctcactgcagcctcaaagtcctgggcagtctccatctcaaaagaaaaaaaaagaaaagaaaaggaaatttggttatagagctatgcctcctacaacaaattacaaatatggagcccagataacagatgagacctggtgtattctgcactacttacccccacccacctaaagtgctgcatgctgtttgaggctcctgtgactaggagagttatcctattccttagaggctgctgagagcaccaaattttggacccacctctaagagaaataaaggcacccaggaaactccttcacctgtagtacccttgacctcatgtttttctttgcactgcttattgctggttcaacagtaaagcaaagcaaagcctaggtaatgttagccaagcctgagtcgtcattcttgccaattctcaaaggaggcggggtcaactttaagaaaccatgatgtatgtcctatctcatcaggaaatcaaggctaaagaaaaaaaaaaaaagaaaccatgatacccaaaaaaattttcgtttattatcttttattatctgatattctctcttctgtccattcagatcctaacttaaagtctgtccagacattctgcacaaatattcctttaattgcattcaagtcataacgaccaaaaaaatagaatatggtgcatattagtagctgtacttgcaatccctttatatctaacatattgttggtacacttaacggaagtgaagtcccggcatgactaagcttacccaaaagatgatggcattcaggctctaatcactccagtgctagtctatgcttccagctgaatttcttactattctgcttatgccacacttgccttatgttacgtcccaaatacaccacacatgttcacatctccatgcctttgaccatgttcttgtctctgtctggaataataagtaaggaataaagtcattcatcacactcctgaagcactgctacgtgctagtggcaatttacattaacaatctcatctcatcttcataacaaacctataaagttggtattgtttttcctgttttacacgtgagataagtctgcccaagaaccctcacaaatggcaaaatccactgcctattaaagaatgccttggaacccctttcaaatggcgaaaccctgcaggtattacagccctttcctcttaccatgccttgaaagttcacacagcctactaataaccaggatctgcttcactacactaaaaccaatcacgacttacacgcttttcacttctgcttaacagattataggtgctcaacaaatgcatgtcaaaattaaaacactggtcctctggcttaacccggaggttaagggtggaaactgctattccacccttcacgacccttttagcttttccctgcactgccagtgaaaggaactgagctgtaacagtattccctaggattgtcagcctccttcaaagccttcaaagctctgtattgtattgctaatgatgtctcctcccgtagaaggtagctcaagggcaagatccataccatccacattcttatcgccagagctgaggaaaataaaaagtgctcaaaattgtttaaatgaagtggaacagtccctcaagactaactttctaagagaaaatgaacaagaggaaaaattgttccagctgagcagcttcaaatttaagattctccgtaataataaaaggcagtttcaccgcagcttttacaactccaccactaatagctgagtttacagaaagccattacacagcaacaataaagcctggtagcaaggattaaatccccagggtatatattgaccttggcttgtctggagcggagggcgtaagctgcacttctgtttgccgcgctgaatgcggtcactttacaggtaagctgctcgggggtacacgtttaggttattaaaagcaagaaataggtgcacaaggaagcggccacgctgggtgagtagggaggtgagaaaggggagggacccaggttcggtgcgcctgcctgacctcgaccccgcgtcctgccggcggacgctgcaccttatgcccgtcctgagagcgagcggccgcccgctgccccgcgcctgcccagcgttcgcacctcacctcggttctcctcctccaggtgccgcacccgcagctcgtcctccgtcttcatctcagagctgtagccccttttcggggcgggacccccggccgcaggtacccagccctgggcccagatcgccgggcccgctcgccggcctgccaacgagccgggcagcctcaaccccgggcagagccacgcactgcaagcggccaccaggcgggcgccgccagcatgcagggatcccaaggccccaggtgccgccgccaccgcggccgccatgttgtctgtttacggcgtggacctgcgacggccgctccgcccccgcccggcgccgacctgccgcgcgcacgcgcacggcgtccggacccgccgcctcgctccggcttggccccgccctccggagccgtgttcccgcccctcactgccccgccgaagcccggtgacccgaggccttgccccattctccaagcgagattggatggtttgtccaatacaaaaggaaagaaagtagttttccaaggttatggaataattcagggaagacttttctataagaaccacccggagggaattatctccccgtactccctggaccatgccctgcggtcctgtgttaagtaagctgcaaaagtgaacaaaaaagttttgtctcctcaagttggctgaaagtgtggcagcccatcgttggtcactgccttacttatggatctcaggttgttggtttagcgtccctgataagcataaatgatgtttactacgtggcgttcaggaaaaggatgagaacagcaaacaggcaaaggagttctttctccagcccacccactcgtaccgatgtcccatggcccttcctggacggaaagagtcttacaggggttcaaacaagccatacgctgagatgggatttagagtatgtagctcttccagaaactcgggatatcaatttagtgtgtaggtactcatcaaagcacgttgcagtataattaatgctacctagcttttatcagatctctaatgggaaagcttgcatttaagaatactgggcagggggcggtggctcacgcctgtaatccaagcactttgggaggccgaggcaggtggatcacctgaggtcaggagtttgagaccagccgggccaacgtggtgaaaccctgtctctactaaaaatacaaaattagccaggtgtggcggcacacgcctgtaatcccagctactcgggaggctgagacaggagaattgcttgaacccgggaggcggaggttgccctgagctgagactgcaccattgcactccagtccaggcaacaagagtgaaactctgtctcaaaaaaaaaaaaaaaaaaaaaaaagaatactgtttgaaaagtgtgctgctatgagcatacgtctagtgccacagaaatttcttgtattttttagtcctaagcaaaacatccttcattatgtcctcaacttttatccaatgtagaaacaaaaagtagactgaattccattactgcatctgctgtaaaatgatgttgaaggcacttttatttttatttttattttttattttttgacaggttctggctctgtcggccaggctggagtgcagtggtgtgatcgcctctcgctgcaacctctgcatctcaggctcaaatgatcctcccacctcagcctcctgagtagctgggatcacaggcacacaccaccacacctgggtaatttttgtatttttagtagagatgggtgtttctatgttggccaggctggtcttgaacacctgacatcaagtgatccacccaacttgacctcccagaatgctgggattacaggtgtgagccaccatgcacagcccactttttattctatcttttgtaaagttccatgcaggaaaattttcctgaagtttactacaaggaaaactttgcttcctttgtatctttcctcttttctgataatgatgtacatgttgactgctgggtgttgtgatttttattgttatggtttctttctaatttggtcttgtggtcaccagagggagggtaaatctggaggtgacagggagttcagccagtggaagggggtcaaggaaggggcacttgtggagctaaagcctctgttggggtccagcgtgttacccaagcagtttcccatggaagttctaattggtgagtttagaacaagcaggcacaagttccatggagtcaccctgtcactgtgaggtggtcactggagcccatctacacagtccatgtgggttatggaggtcaacaggtgagtcaagcaggctgcatttacctgtcccatagggagatggtcaccaggaagcagttgcattaagcagatatctggatggatcacattgaagaactgggaggaagcagagaactggaaactgtatcaaaggtgattgagccctgcttctcatatgagaaagttaaacatattcaaaatggataccaaggcaaaataaaattatgagaattactgtactagagatggcagcggctgctccagacggcctactgctgcagcagggaggcatggccagggctgcacgctctctggcgggagccagggacaagcgggagacccaccccttctgagttggggtgggaactccctggttgcctctgcagcacagctgcagactggggcctcctgctccacagagcaggcagaagcaccacccaaggtgtggctgcagatctgagcctccctgtgctcttagggggccaggagcaggcaggagccctgccctccccgagggcagctgtagccacccaaaccacggctgcagccccaggcatccctgcactcttgggggcccaggaaggccctgcatgccctcacaggctcagaaatgcctgctcctgctgcctggcttctccctgctgttggcacctgctccattcttggagcaaagttgaggctgaacccaggcaccatgaatggcagtgggaggcagacagactcctgggcagaagggggtgggtccccagtgaggccccagcttctggccaaggagggcctgaaggctgggggttgggctgccagccccatgaaccagagtgggaacttgtggtgccttttccgagcctgcccatggctgcccatggaccaatcagcggcaggcacttgctcccctctgaggcccataaaatccccaactcagccagagctgagcagatgatgggacaaccagctgcagagaggagctaccctctcagctgagagcttcagagacttgcagagatgtcagaactaccagcttcagagaggagtgaccctctccagggcctcctctctgctaggagctgggcagatgttaggacaaccagctgcagagaggagctaccctctccagggcctcctctctcctaggagctgggcagacttcaggacaccctgcctacagagaggagctacccactgcgggtctcctccgagctgttttaatgctcaataaagcttctctttgtcttgttcaccctccacttgtctgcatacctcattcttcctggacccaggacaagaactctggcaaaggtgccaccagccacagaggtttctggccaggaaatcgacacctcaaaggttccgtaacactaggaaactcacaattgtatttacagatcaaccattgcaattattgcaattatataattactgtttattaatattggtctccagttgttttgatatctttatgtcggttcatcaatagatggtaaatttagagaaagcagttatacagagctcctgacagtgctatttaaaataatataacttcagataatactgataattgactaggacagctgcagaaagataatcatagattgtttgggttatagaagaaaacaaaggaccacccattgtttctaaaggcatagagcctgatggaaaaaatgcaacatagaggactatccccttccctaacatttgggactctcgtccttatttgcaatagtcatgcacgtatctcaggtctgtgaccaaagttgattcttaaaaattaatgcaactaataaacatcaccatgactatcacaacctgtcaagcatgacaactaacagcaaattgccaaatatcaggaatttaacaaattccaaaccaaatagacatggctttggatccctgctctataattgctccactttgagacatcagtgagttatttaaatacttcatgcttcctcttcttcatctgcagtatagctaatatatctatttcactttatgaattctttttttttcttttttcagacagagtctcactctgtcacccaggctggagggcagtggcgtggtctcaccttctgggttcaagtgattctcctgcctcagcctcccgagtagctgggactatgggcaggcaccatcatgcccagctaattttgttttttctttttgtagaaacaaggttttgtcacgttggccaggcttatctcgaactcctgacgtcaggtgatccatctgcctcagcctcccaaagtgctgagattacagtcatgagccaccatgccccactgaattatcttcaattccttcacctataaaatgagaataattatgcccatttattgggttgataagtatgtaaaacacttggcaccaagaaagaaatagagcagcgtggaaatattagctaccatttaccaacttccttcttagtctatttaagaaggcatttcgctgtcttatttaatgttcaggaaactttcaagttggtattactacccccatttttatagatgaggaaactgagattaagttacttaccaaagactgcatctgggaagccatggagctggaattcaaatactgatacatctgactccaaagctcatgttctttttcttttttaaaaatcttttaatttttttttttttttactagaaacaagggtgtcactatgttacccaagctggttttgaacttaggctcaagccgtccttctgcctcagcctcccaaagcgctggattatatgtgtgagccagtgggcccagccaaagcccatattcttaatcactagttagaacagcctttcaataaatgttaaggtactcaataaaatgtcatgacctctggaatttctacttttcaatgaaagattgtcaagtatgaaacaggaataatgagtatcagtttgggaaaaggcgggtagggcttgttgtttgaaatgagaagagtatagccaggtgtggtggtgtgcattgggaggttgaagcaggaggattgcttgagcccaggagttcaaggtcaatctgggcaacatagcaagactctgccactgaaaaaaataataattaaaaaaaaaaggaagaaatggcaagagtgaaagagtggaaaagctggagtattcagagtactacacccactaatctcctgacctgcttctacttcttctacatccagcagaactgtgaggcaaacaaacctcctttctttagaaactacccagcctcaggtattcttttatagcaatgcaaaatggactaaggcaaggaccaaatatctttttcttagtatatcacgatatcataagccccatggtggcctttcactccagaaggtcttttcccatctagtctgagtacttacctccaaaaggagggattggatgtcaaatccagaaaatccaatctctagagccttgaagggatccagtaagccttacccaaggacactacccccagagaaaaggtatgtttgaagacaccctctctcactctgccctgcagagactccttgaccagacactgcaatccacccccaccaaggtattgtaggtctcattttaggtagcaaccatgtgtgcctatgagctccatgacctctggagaagagtagacattatacagacaagtaaagagaggcataaattactgaaagttacatagctaataaataacaaagctggaactggaactcaaacactccactccaaaaacctgagttcttaatcatgactttcttttgtttgcttttcctaattgattgtaagggcttcatcttctccaccactactctgaccccaatcagtagggagttttatcaagcccttctattatcatttcatttggaaatttcacccactgcgttggatcctgcatggtcacgatttcccagatactgcttcttccccctgacaattccatagttgctgattgtgtatacgtgcatacatgcaaatatgcaaacacatgtgccatgtcctgaaaatacaaaccttcgtcatctcaggatgagagggatggggagactaggggatgagatcaaaaaggtacatggcatcttttggggatgataaggatgtcctaagtttattgtatgatggttgcacaaactctgagaatataccaaaaaccatttaattgtatatgttaaatcgggggattgcttggcatgtgaataatacttcaataaagctgctgcaaaagtcaggagacaggatttgggatccttgaagagatgactgattgagtgtctgagacagagaaaaactaggtgagatcagaatatctccttgtgccagaaaacactgaagtgctccacaattgacagaaatgtgaaagaccacagctcggaagggtttctactggccttgcctgggacaattagaatgttgaagagaaccatgctagtaattgatagaaacatttagcattttttaaagatatcagtgaacaattaagtaaatggatggcagatggtagaagccagtttctccctgttggtatgggagactacagataagcaagggaaggaggccaggatgatttgtttgataagggtttagcactggaaacatcagtatgaactcatgtttagcttaatatagatatagatggatacacatagaaacatctacagataagtacatatgcacacatgagtatacacacactcctgctctgtcagctaagatgaactagaagcaataacacaccatcgacaatgagcacacctagtgtcagatcttggtttctaataccatcctccagtaaaaaagaattccccattgatccttggagaaatgggtgattctaggactggggcaggaaatatacaagatgagcctgaaggatgttgtggtgccagaaaataagaaagtgttcaaaataaccccaaaatgatgggcagatgtcaaagagatgcaggaaccaactgagagagttcccagtggccacagctggaacaagatgaacaatagaataaagtggcatagcatgatatccgaaagcataaaataaatatccatgtatacatactgatacagataaatgattgaatagttaaatgagaagagaccaaactcccaagcagaagaatttccaataattcatgtagatactctgccctacctgaggaaggtgtcaaagataaagccaacagtagttaaagtagtaaagacagatattaatcagtgatatactattgtaataacataatatgatattcttgtctgctttcagcaggtctaggatagaaattgttcataaaattttaagtctaagatcaggaggcccaccctattgcttttaaccctcttagttgtaagataggtggtatctccctcatacccctccaaataggtaaaaggaatacctgctctatcagggtataactagacatctatggtcttagccccctcttgtttatagtctttgggttcattgtgccttgtcgcttaagcgcttgtctagtggatgagaatgttattctctcctctaaatcaaccaaccttctatggagtaaagggtactgaagaggatatgtcagtcagttcgggctgccataacaaataccacacactgggcagtttaaacaatagacatttatttcctcaaagttctggaagctgtaagttcgagatcaaggtgtcagcaggactggttccttctgaggtctctctctttggctcgcagatggtgtctccttcctgtgttcttacacggcctttcctctgtgcgtgcacatccctggtatgtcttctccttataagaccatctttccaactctcttttcagtaaatggtgctggggaaactgtctaaccatatgtagaagaatgaaactggacccctatctatcaccatatacaagggaaataactcaagatgaaataaagacttaaatttaagacctcaaactgtaacaatcagagaagaaaacctaggaaatactcttgtgaacatccatctagacaaagaatttacggcttagtcctcaaaagcaattgcaagaaaagcaaaaattgataagtgggaccttattaaattacagagcttctgcacagcaaaagaaaccattaacagagtatacagacaccctacagaacaggagaaatatttacaaactatgcatccagcacaccctaatatccagaatctataaagaccttaaacaaatcaacaagaatgaaacaaataacctcatttaaaaatgggcaaagctgccaggcatggtggctcacacttataattccagcactttgggaggccgaggcaggcagaccacttgggctcaggagttggagaccagcctggacaacatggcaaaactccatctctactaaaaatataaaaattagccaggcgtggtgacacacatctgtagtcccagctactggggtggggagctgaagtaggaggattgtttgagcctgggagtcagaggttgcagtgagctgagatcgggccactgcattccagcctgactgagagtgagatcctgtctcaaaaaataaaaataaaaaataaacaatgggcaaaggacattaacagacacttctcaaaagaagacatacagtcagctaacatgaaaaaatgctcaatatcactaattatcaaataaatgcaaataaaaaccacaatgacagtggtccccaacttttttggatcagtgaccggtttcatggaagacaatttttccatggactgggccaggggtgggggcgggagggaatggggatgaaactgttccacctctgatcattgggcattagggttttatacataaggaacactcaacctagatcccttgtatgcacagttcacaatagagtttggctcctctgagaatctcatgccccccctgatgtgacaggaggcgggggcttgggtggtaatgctcactggcccacctctcacctcctgctgtatggcccggttcctaacaggccgtggaccagtaccagtccatggcctgggaggtggggacccctgcacaatgagataccatctcataccagtcagaatggctattattaaaaagtcaaaaaataacagatgttggcaaggctgcagacaaaagggaatgcttatacattgctggtgagaatgtaaattagttcagccatggtggaaagcagtttggagatttcgttgtttttgttttgttttgttttttcgctctgtcgcccaggctggagtggtgcagtggcgtgatctaggctcactgcaagctccgcctcctgggttcacgccattctcctgcctcagcctcccgagtagctgggactacaggcacccaccaccacgcccagcaaattttttgtattttttagtagagaggagatttcttaaagaactaaaaatagaactaccattcgacccagtaatgagattactgggtacatacccaaaggaaaataaatacttctaccaaaaatgcactcatgtgtttatcacagcactattcagaatagaaaaatatgacacatatacaccacggaatactatgcagccataaaaagaatgaaatcgtgtcctttgcagcatcatggatgcagctggaggccattatcctaagcaaactaactcagaaacagaaaaccaaatactgcatgccgccacttgtaagtgagagctaaatcttgggtacacacgaacataaagatggaaacagtggacactgaggactccaaaaggagagatggagggagggaggcaagggctgaaaaacttcctattggaagtaccatgttcactatctgggtgatgggatcaatagaagccaaaacctcaacatcatgcaatatactcttgtaacaaacctgcacatgtaccccctgaaactaaattttaaattttaattttaaataaaggacacctttcctgtcagatgagggccccacccttatgatctcaattaaccttaatcacatctttaaaggccctatatccaaatgcacttactgtggggtttatggcttccacatatgaattggaggggtacaactcagtctataacaaagggattcttcttcctcagtttcccgtagccggttctgtagacctatccccatatccctgagcctccccaaatctgtggcagcctccctggatgataatagtgtcaacagcccacacctcctcctgtgctcataagcactctgtctccccctgttaaggaaggcaatttgccaaaggtcacatagctagtaagctgcagaaccttatgcaaatccatgcaaggtattttgtcataacctcctgcctccctgttcatgttctcttttttctccaggacatccagttattctcattaaagtctttgtcatagttaggcacgaggcactgacagtagaggcactgatagaataatgcttccttttgctcaaagaataggcattagctaatctcctgatcattagtgctttcagcagcttcagaaaaaaagcaacagatgacagtgcagttggtttgtctctttgattcgtgactatccagaaattaatttacaaaaaaaaaaaaaagcagcaaaatagattctacttctcaagacttttccagtgttgttctttttgtactgctctatcagggtcataattgtttctttgagtaaagtagttttccatttgtatcacaaagagaaaaatcacttggacatttgggggactagccaccaagctttgcaaaggccaggtctgcagtatgttagacactaactctcccaggccaggcacggtggctcacgcctgtaatcctagcacgttgggaggccgagaacagtggatcttctgagctcaggagttcaacaccagcctgggcaacataatgagacctcatctcccaaaaaaaaaaaaaaaaaaaaaaaattagccagacatggtggcatgcacctgtagtcccagctactcaggagatagaggcaggacaatcatgtgagctagaaaggtccaggctgcactgagctctgatcgggtcactgaactccagccaggatgacagagggagaccctgtctcaaaaaaaaaaaaaaaaaaaaatgaaaccaactctcgcactatcaggaaatgttctctctcttttctttttttttttttttttttttttttttgagatagaatctcactctgttgcccgggctggagtgcaatggcaaaatctttgcctcccaggctcaagcaattcttttgcctcagcctccagagtagctgggatcacaggcacatgctatcatgcccagctaatttttgtatttttagtagagatggggtttcaccgtgttggccaggctggtcttcaactcctgacctcaagtgatctgccctcctcggcctcccaaagtgctgggattacaggcgtgagccaccgtgcctggccggtatacagttccttttaggagagaattttctctctgtagaatctctgaatacagggaaaccagacatgaatttgaattctcataagcctctgtggttcaaggattagagcaacttgactcttttctacatagcaaaaagataaaattcagcccgtcctaaaccaacaatctcggctcactgcaacctctgcctcctaggttcaagccattctcttgcctcagcctccccagtagctgggattacaggcatgcaccaccacgcccagctaatttttgtatttttagtagagacggggtttcagcatgtctaacaaaatgccatagactggtggcttataaacaacagaaatttatttctcaatgttctggagactggcaagtgcaacatctaggtgccagcagattggttgcctgttgagggcccactttgggtccatacatggctcctcccagctgtgtcctcacatgatagaaggggcagggcatctctctggagtctcctttatgtttttctttttttgttgtttttttgagacagggtctctctctgttgcccaggctggagtgcagtggcgtgatcttggctcactgcagcctcaacttcctgagctcaagcaatcttcctgcctaagcctcccagggagctgggactacagttatgcaccaccatgcccagctaattttggtattttggtagcaatggggtttcaccatgttacccaggctggtcttgaactcctgagctcaagtaatcggcccaccttggccttccaaagtgttgagattataggcatcagccgctacgtctgccctgagatcagttttataagggcactaatcccaattcgtgagggcttcactttcctgacctataacttcccaaaggccccatatccaaaaaccatcacagtagtgattacatttcaacataggaattttggggggacataagcattcagaccatagcaattcgtttgagggtttaatgaaataatatatgtaaagtacttagtatagtacagcatattatatgcattcaataaatatcagttgttatttttattacctttaagatacaataactttggcatgattagttattctgagacaatatacattaggatagggaaaaaaaaaaaccctaggacttctgcttgtatttttacttctccctataacttttgtgtgtgtacatacatacatatacatatgtgtgtatatatacatatatgtgtgaacgtgtatatataggaattatgtacctaaaaatgttttcactggtagaagatgtgatttttaaaaattggagacaattggctcagagatttaataaaagttcagaaacatgtatttgtatagcattttcttttttcttttttttttttttttgagacggagtcttgctctgtcacccaggctggagtgcagtggcgcgatctcggctcactgcaaactccgcctcccaggttcacaccattctcctgcctcagcctcccaagtagctgggactacaggcgcccgccaccatgcccagctaattttttgtatttttagtagagaccgggtttcactgtgttagccaagatggtctcgatctcctgacctcatgatccacccgccttggcctcccaaaatgctgggattacaggtgtgagccacagtgcctggccagtgtatagcattttcacctgatcttagccaaaaggccaagaactgttatagaattttcattctcaagattaagtctctttcatacaaaccacaacatattttcaaatcattgcttatttaaagcttgccaacctgtagcgtagcatgtgaatattcacattttgaactagggccaagaaagccaggatgatgcgtttctttccaaccccagcaattcattaaaattcctttgtcaaatcaacagatcaagagcagtgtattgcctaggatggtcggtttattttcaggaactgaatttataaataattcaggaaatgaatcagaccttattttatcagcaacattactatagatgtccagtagaaactctccatgtgtgtcatcttatatgaagtcacttgataattatctatctccaaattagaaaacctagttaaatgaagctggggcttgggagatgtggaaggaagaactcctgattttcaacccctgttaatcagcagcagtgcgggcgccctgtgcttcttgcacagttgtcctgtgccaccttcctgagtggctaccacccaggaagttgatgcagaggacctgccatgtgggagcctgactttcttttttttcgagatggagtttcactcttgttgcccaggctggggtgcaatgccgttatctcggctcactgcagcctctgcctcccaggttcaagcaattcttctgcctcagcctcccaagtagctaggattacaggcacgcgccaccatgcccagctaatattttgtatttttaatagagacggggtttcaccatgttggccaggctggtctcaaactcctgaccttcaagtgatccacccaccttggcctcccaaagtgctgggatcacagacttgagccactttgcccggccctgacttttatttttctaagaaaaaggtattctacagttgcatttcaagacaaaagggagactgtcaaaattttgcttgaaataataaccactttgaaagagaaacagaagagaaaggggagaaaaacctaagaatatcaaacctatcaaacaaattattttttgaaacaatagagaagtcccctccaagtattaggtgttttggggtgcagagccccagggagagggggcacagctcagaaatccctgtggcttgtttcaactcagtcacaatctgttgtaacccagcaaacgcccaggaatatgttggcctttagagccaaaaggcatatttagccctaaagacgacttgttttcctattaaatataaaagaaatagcatatatttttagcaagcacatcactgacgtgctactagcgaaaattatgcctaaatgggggcatttggtataatctgaatcttgcttgggaaaatgcttgttgctttttataattatttatcaatggtattggtttctgggaagtacatatgtgatctactgtaagggaaagtataatctagagccacgtgttaagttttgacatctggggctaagtgctcttctttttcaagtccgtaggccaggatggatttctcaattatgttgaagaatgtctgtggtttttatgtgtgttctcagaattcacacttcattactgctaaatgatcagaatcatgagaacagtggctttgtgcatcttacatgccattgtgtccccggggtctgccacaatgcctggcacaaattagatggtctaaaacactgcattttttaaatgtttattttaggtttagaggtacatgtgcaggtgcgttacataggtcatttgcatgtcacatgagttggctgtacagattatttcttttttttttttttttttttgagacagagtcttgctctgttgcccaggctgaagtgcagtggcacgatctctgctcactgcaacctctgcctcctgggttcaagtgattctcctgcctcagcctcctaagtagctgggattacaggcacctctcaccatgcctggctaattttttaaaatttttagtagagagggggtttcaccatgttggccaggctggttttgaactcctgacctcaagtgatccacccaccatggcctcccaaagtgctgagattacaggcgtgagctaccacgcctggctcagattatttcatcatccaagtaataagcacagtactcaataggtagtttttctatcctctctctccacccacaacaggcccaggtgcctgttgttcccttctttgtgtccatgtaaaacactgcatttgttcattctgttaaaataaaactaagatctgtggttttccatgaggtcagtcagaactaggaccaaaccctccaaaagttacgatttaattttgaagacttagcatttggcttttaaattagaattgtagagcaggtagtattaatccgtcactgttgtaccaattctggtagattagttaaaacatcatttctttagttgtatttttttaaacacgtcactcttcaatggattccatgagtcaaatgacaacacttaaagttaaaacattcctctgaatttcatttaaggcaaacgaaaacatggacagctggatgaagacctcagcctcactagggtagagcccaggtaggtattggccatattggtgctatggcacctttctacaggctctcacaaaatagggaatgaagaagtgacaaaataaaatgtgtgttcttagagtggccactcttgggtatacattggaatgtcctaggacggccaaactcttaaaattgctgataccaccctcagggattctgatttaattggtctaggctgcggcctggacattggtgtttttgtgttttttgtttgtttgtttgtttttcttagagatagggtttttctctgtcactcaggctggtggtaggatcatagctcactgcagcctcaaactcctagactcaagtgatcctcctgccctggcctataggcgcacaccaccatgccagctaatttttcttttaattttatggagatgggggtctcactatgttgtccaggttggttttaaactctgggcctcaggtgattctcccacctcggcctcccaaagtgctaggattacaagcatgagccacttcacctacctatacattggggtttttaaaagctccccagatgattccaatgtacagccaaggctgagaacgactgtgatatggtttggttttgtccccacccaaatctcatcttgaattgtaactccaacaattcccatgtgtcatgggagggacccattggaaggtaattgaatcatggggttgggtctttcctgtgctgttcttgtgatagtgaattagtctcacgagatctgatggttttaaaaaatgggagtttccctacaccagctctctctctctttgcctgcagccatccatgtaagatgtgacttgctcctccttgcctttcaccttccaccatgactgtgaggcctcctaagccatgtggaactgtgagtccaataagcctctttcttttgtaaattgcccagtcttgggtatgtcttatcggcagtgtgaaaacggactaatacacattgtattaaagtgttgttaggagaggcagattcttcaggccttttattttatatacagtacatataggcatttaaaagcaattgtaactaaattgcattcttctaagctatattctctttctgaagtacctaaaaattatttgaaattttacagctgaaaaatgctgtttgcccatcaatgcatatagacagtaagtgacttttgccttatgaacaaacttctggtcattttcatgttatggtgcccacagaaattgatatttgtacagcatacttaaggtcccttgaagggcagaaatgactaatccaatagttcctgcagctccaagcacacaaggtatcagtgtctcagcagaacaagaagaaaggctgcctgagaggctgtttccgacaactagggctcttttggccaagaaatgcataaaattgctgttctgggtaatcttctctgaattattgagcaagaacagcactctggaacttcatttatctgtagccaggataatgaaacacaagcaacattccaatgataacatttatcttgatttctatctccacacttaataaaaggaaccagatgtttctcttaaatcactatcaggctcttggtcatttcctggagttgataagagcccagcccatttcacagtagatactactgaggaaatacagaaaatgagaggagacagtagtgcattgactgcgtattagtttaaatattatgtaactctgtttatgaagttctcctccctactgcccaggggagaaagattacagcaaaaataattgagtattatttatttaagaacaggtgagatttctttttaaaatttaacccaaggtcagattatgagttcttatacaaagaaacaagaatgtagagtataattttaaaaattctatggtgtagcagttcttataggtaataatcttctgttttgttttataggaacacattatttggctgagaaattgagactttcttagcatcatttaatttatatttttagttttgcgaactattacagctgggccaagcacaaatgtatagtgtagtcaagttttgagtcccattcgagtttggaaatcccgactatagtaaaaaggagaagagggtgatagcagatagatgtgtatttttctcttgcttcctctcttgtctctaaaggagatttaaatggaattgagacagaagctatgaaatgcaggcttccaaaccagtgctggtattttgactatggtgttggcacactcccagagccctgggtgacattttaagtaaatgaagcagcctttttctctatatccttagaaaacttgtctcctgcctttctcctctctctgttcttaattcatcaggtcttgtcataatgttcaagaactctatggtcagaagagtgctatgcaattgtaaaatgagtgaagaatcttgctctagacagattgaattatatctgagatatacaattaagtgaaaaaaaagcaaagtaaacatatatatatatatatattttggttgagggaacagagtctcgctcggtcacccaggctggagtgcagtggtacacaatcttggctcactgcaacctccacctcccacccctaccccgcccctggttcaagtgattctcgtgcttcagtctcctgagtagctaggattacaggcatgtgccaccacgcccagctaatttttgtatttttagtagagacaagttttcaccatgttggccaggctggtctcaaactcctggcctcaagtgatctacccaccttggcttcccaaagtgctggaattacaggcacgggccactgtgccagaccaacatgagcatatatggtatgctactttttatgtaagaaagaagagaaagaaagaagacatacacatatctgcttatgtttacaagaacaaagaaaaatgcaaaaaggataagtcaaaaaaacgagaatagttacctataagtgaggggatgttgggatgaaagggatacagaagataatgacactattcctttttatatcagtttgatttttagaagcatgttaatgttctacatcttcaaaaaataatattaatttatgagaatgggaaagaagaaaaaaactgaaagcaaaccttaaactatctgtatttcaaatgaatatcgtaatcacactgaaagggaaaatgaggaacttatcccaataaattataaacgtagtccttggagagaatttccagggatcacgcaaagatggcagaagataatcctggaatatgctgttattcaaaaaagaaggaaatgctaaaaaaataaaataaaataaggggcacatgttgcatgagcaggctttaaggggatgccagtggccaaatcttagataatttgaacaccaaaataactaagatggtaataaattataaaccattaagaaaaaagggggaaatcaatgagtccatactgaagatagttgacaatagatagacagatacggatggatggatgggtgggtggatggatggttgattgcagtgcgaaagcatttgcttacagtagaatgtcaagggccaagtggtaaacatggaggaaatactggagttggaaattcatattacaacatccttcataaatactgattccatcaagaagcagtgatgaaggataaaccaagttggtgagccattatgataagcagcggatcctagtctttccccacagattgcttattgtaatgtaagagggaaaatactgtacaatggagaagctggacactagcatgactagatgatcaaaattagcaacaccaatgagtgatatcacttaccaccagatgtgaatcctgagaaagacccatcatctgcacagtatccaagtgacttgactctagtggtggggaggcattagacaaaccccaaatgaagaacattcttatacatatgtatattcttatattcttaaacgccacaaaagacaaagcctgaggaactatcccagatttcatttgttaaattatagcaactgacggaagttattgagacaactaaaattctttattacatttttgtgattaaatacttcaaacatggaaaatcacacaaagagtaacaaaatggcacctatattcccacaacccagtcctttcaaagtctagtattttgtcttagtttaaattattttaagggtattagatataatgggaacattaaagctatttctgaaatcctctcattgcctcttctttcccagagatgatcacttttctaaaatattgtgcttagtttcttgcaagttgttacactgttaactcttcaaactcagtatgtgtattttttaactcagtttgattttgaaatgtatcttttttgatacatgcagctctggctcactcttttgattatttgtattcaattaaaggactaaatcattattttattctctgttgatggcatttacattgctttcaaatttttttcagtattataggcaatactgcagtgaacattctgttatctgtcttcttatacacacttgccagaaaattacaaatattgtccaaatcatgaaactggtcaaaagatatgagcagttttagcttcataaaatattgagaaattatcctccaaagtagttgtgtgagcttatatttccattatcaatgcataagaatttctgtttcggccgggcgtggtggctcacacctgtaatcccagcactttgggaggctgaggtgggaggatcacgaggtcaggagatcgagaccatcctggctaacacagtgaaaccctgtctctactaaaaatacaaaaaaaaaaactggccgggcctagtggcggtcgcctatagtcccagctacttgggaggctgatgcaggagaatggtgtgaacccgggaggtagagcttgcagtgagtcgagatcacaccactgtactgcagcctggacaacagagcgagactccgtctggaaaaaaaaaaaaaaaggatttctgtttctacaaagataatgacaacaaattatttttcccatctgatggtcatgaaatggttgatctttgtgttttaaatttgctcttctcagattactagggagactgagtggttttacaaatgattatgcaatattttaatttcttctcctgtagattctttactcatatcctttaggtttttttctgagtggtatatcctgttttcattggtttgtagaagtttttaatacattctttatatcctcttatgtgcatttgagtatcttttctcactctttgagctctattttcattttatttctgttgtcgttggttgaatgggggttttactttaatgatgtcaggtttactggttgtttcttatcagatgtgccttttctatatattttaagatgtaagagtcttaaaacatattttcctatattttcttttaaaatattaaatattttatttttcacatttatgtgcttaatctatcaggaattatttctgtgtatggtgtgacacagtactctgattttaatttttcaatacatggatatccagttggcatagtctcaaaagtcaaatataccgataaacttgggtcgagcagtctacttcaatgaggtcatctctctctagatagaaagagtcctggaaatcctaatgttatcccttgggaaaagtctgttcctatctggtaccatcttttattagggctttctggggaggaggcacttctaaaaaactcaatttctgatttatagtttataaaaccacctgcaggagacaagactgaatagctgtgattagtcaatattatttaatcagaagagaggagaatggaatcccctatttgggtatttagccaatgatcatacagagagaaggaactatcagggaagatattgacaaatgtccagggtctttgattttgttcctatattagagttgtaccaaattacaaggagttttgtatccaggaataaactaatttgttgacagctttgcctcaatcattatacataacctaagtatgttctatccaacctgaaaagcaaatgattattgaaatttatattagttatattttatcactacgtaattaatttcttttttttgccgggtttaatctgtgtacctagattaggaaaaggaaaagaaaaaagaattgtcaaacatttaatcaatcaggatataaacatgggatagttttctgaaaacaggaaattattaaagccagaaaaataatatttaaattaggcatactactacctaaatttgactttttcagaattagagacttatttaaaatgactcaagaaatcagggcaaagctacaaaatagagaatgacctctcagaggttgactcttgtgagaagagttaacagtggggttctgttttcaagacagagaacaaaattgttttctctttttaaagagcagattgtatattcaagggtcaaaataatattcatctgaactattcactctctgtcttcattattcataagcttttttcatttaacatctttaatatactttatatgcatttttattaaatatacatatgtagttagttttaacttcagctttttaaaataaatattgataaattaaatatcattgtattatctaaagcaatatacatcatataaatttaccgtcttaatttgagctttgcaaagagcaaatatgctattatagagtggtctatcacttctataatctctgttcttatttatgcattttagttaccaaagatttcatgtgacaacattatttactaccttaattgaatattagtcataggtcttgaagacaatcacggatctcaaaaattatatttaaagtgtgatataatcattgttgattttaaaaatcgaaggtacaatatttaaaaatcacatgcagggctgggcatgttggctcacgcctgtaatcccagcactttgggaggctgaggcaggtggatcacccaaagtcaggaatttgagaccagcctggctaacatggcaaaaccctctctctactaaaaatacaaaaattagctaggggtggtggtgcatacctgtaatctcagctactcgggaggctggggtagaagaatcgcttaaacccaagagggcaaggttgcagtgagccaagatcgcactatggcactccagcctgggagacagagccagactccatctcaaaaaaaaaaaaaaaaattcacatggaagggctgggtgtggtggctcatgcctgtaatcccagcactttgggaggccgaggaaggtggatcgcttgagctcagaagttctagactgggccaaggcagcacagtgagaccctgtctctcaaaaaaaaaaaaaaaaaaaatcacatgcggatagcaagagtgaactgttttacactattatttcaggtttacaggaacaaatctttttagaaaacagcagttgctatttaatttagttaaatacatatatttatatttttatgcctttacatattttgtgtaaagagtgataatttatctgacccatgaaatcaacagaggaaatttagaaagtataaaataatgagatcagagagaagacaaatagatgtttttgaatatactgtgttttgaatatattgtgtgtactaacatactgtgttcaagtattcatattaaatgggaatataacacttgaagttcttttttcttttcagagttggggtctcactgtcacccaggctgaagtgagcaatcatgactcactgcagcctcaaactcctggtctccagtgatcctccaacttcagtctcctgagtaactgggactacaggcatgcaccaccatgcccagctagtttattcttttttttttttttttttgtagacacgggagctctctatgttgcccagactggtttcaaactcctggcctcaagcaatcctcccacctctgcttcccatcacaggcttgagccactgagcctggccacccatgatgttctccatacaatttgtatacctctgcatttaccaaccaaatgttacagttcatttaaattgtactgctgggcgtggtggctcatgcctgtaatcccagcactttagaaggccgaagagggcagatcatgaggtcaggagttcaagaccagcctggccaacacagtgaaacccccgtctctactgaaaacacaaaaattagccaggcctggtggcgtgcgcctgtagtctcagctactaaggaggctgaggcaggagaatcgcttcaacctgggaggcagaggttgcagtgagccgagattgcgccactgcactccagcctgggtgacagagcgagactccatctcaaaaaatatatataaaataaattgtacttaatagtactgacgttttctttcttttttttttttttttttttttggcgttttggtttatctagttatctagctgtttagtcattgttatttatggactctcttggccacttctgtaagacaaggacttatactgaaagactaacacccttaaaacattagaagtttggccgggcgcggtggctcacgcctgtaatcccagcactttgggaggcagaggcaggaggatcatgaggtcaggagatcgagaccatcctggctaacgcggtgaaaccccgcctctactaaaaatacaaaaaattagccgggcgtggtggcgggcgcctgtggtcccggctactcgggaggctgaggcaggagaatggcgtgaacccgggaggcggagcttgcagtgagccgaggtcgcgccactgcactccagcctgggcgacagagcgagactccgtctcaaaaaaaaaaaaaaaacaaaaaaaaaaaacattagaagtttattttgtcacccatcccaattttgttttgctttttgtttttgccctctgtcctattttaaattggtgcttcttaaagttctgtaggccaaattaataagaggaacttcatctaattccgaactcagagttcaaggggaggtaaaagaccaatttaaatggataagcctatgtacctctgcccctacctggaccacctgagttgtgaagtatgctggtcactttctctgatcattttctgcttgtgagcaggagtcatttttggagagatggcaggaccctgtagtagtggtcaggaattacggatctgcccggatagcaaatgccagtgctgagtttgtatcttaggtggtgagacagtatttctctgctccatgacaggggtctgggtaatacctgcccataacccatctgccatctttggctcagtttatttcctctgatctgtcaatctctccattgacaggtgaaaggctgacttcatcagcatgacatggatcacatttttgaagagctggtaaaatagcctcattgtttaaacgaatgtgtttttgttcaattcttgttgtcagagaatttgttcctgagtgtcctgcctgagtcttcagaaacacaatttactgtattctatgggataatttatgggggtttttggtggggttttttttttttttttcaaaagtgtcacttgccaagctttgtttttgtttgattagtgtacagtagtctcccttagccagggtttcactttccatggtttcagttacccacagtcaagtgccttccactaataggtgagtacagtacaataagatattttgagacacagactacattcacataacttttatttcagtatattcttataattgttcattttattatgagttattgttgttaatatcttactatgcttaatttatgttgattttttactgttccttgtgtaatacagtcttgtatatactttctgagttactttgtccattgactcctgttatatggcctcagatatttatttaaggtgagggttgggctacgtggcaatgttctttttgcttgtgtgtttgttttgttggttgggttttttgtttttttaatctttaaacattttttagagatagggtctcaccgtgttgcccaggctggagcacagtggccattcacaggcgcaatcacagtacactgcagccttgaatgcttgagctcaaacgacctcccacttcagtctactgagtaactgagactacaggcacgaagcatgcctggacttttctttctttttttttaatttttattattttttgctagattttgccacccttttgccatcagcttcccagtttgtagtctgtcaatgtgcagaccaggtagttaacaccatttggtattgttcaggaatcagtgtaaaatatgtcgccagttatgtctttgagcatagcttgtaattcagccaacttgacacatttctccacctttggctaagcctggccaggctcagtccctgggagtttcagcagagcatacccagggcctcaggcactgcctgtctgagagctttgaacagggagggcccaaatccgcagggccttcccctcaaggatcttcccaccccctaacccctccaagctttgttagaccccagcaggcccacagcaaatggcacaccacaggttctcagccccttctgtgatgtcattcttcattttacctgagtagagaggctgttatccccactgtgtctggctgggggtaaatccaacccattgcccttgtagtgttcagtgttgctggctagtttccagtttgttgtaatgcccagtatactattgtagcatgtgtgtggtgtggggtgtgtgtgtgtatgtttgtgtatctgtgtaaatcaatgtatcaatgtatttgattcagactgtccaaccacctacttgttgatgtcagaggcaagaaagcacagttatccaaaatagtgatttccaggtaaagggatggggagaataggagggaggtgagaccagcttgctcaggtgggtcaagggtgagctgttgtgagagtcttctcccaatgtcccaggtcttccagtaattgcataaagaggttacccgaggttaaaatatatgtctccagtacttaaatgtctctctgggcctctgtgtagttgttgtttttttttttttttttttttttggccagagaggaagagctgttatttttatttttcctttataacatctagtactaaaggccttctttgggtaatgcctaaatagtttattgctattttggcctaattgattcttttcctcagctacattctattatttttctttcaggtatttaacaagtgacatgttttgttttttcttttatgatgagttaatcttcaaagtttcttataaagagacagagaaaaaaataaggaggaaccactaggcacctattagaacgagtaccataaaaaatactgggtgctgggaaggataggaagcagccggaagcctcacgtgttgccaggggaatgcaaaacggtgccatcactttgaaaacggtttgacggtttctcagagttaagcacacacttacatatgacccagcaaccccacacctgggttttgaccctagagaaatgaaaagttcttttcttttaagatggagtttcactcttgttgcccaggcttgagttcagtggcacaatctcggctcaccaaaacctccgcctcccagattcaagtgattctcctgcctcggcctctcaagtagctgggattacaggtgtgtgccaccatgcccagctacttttgcatttttagtagagacggggtttcactatgttggtcaggctggtctcgaactcctgacctcaagtgatccactagcctcggcctcccaaagtgctgggattacgggcataagccattgcatctgggctgaaaagttcttttcacacaaaactttgcacaagctttacttgtaatagccctaaactggaaacaacccaaatgtctttcaaagagtgaatggctaacatatggtggtccagccgtagcatcatggtattctactctgcaataaaaaggagccaaccgttgatacacaaaacagcttggatcatctcaaaggtactgtgctaagtgaaggaagcctgactcaaaatgttaaatgccatgtgattccatttataagacattcttgaaaagacaaagacaaaaactataatgatagagtggttctgaacagaatttttctttggagtaacgatctcactctgtcacccaggctggagtgtagtcgtgtgatcacagcacactgtaaccttgaactcctcaagctatcctgccaccttagcctacaaagtaactgggacccataggtgcatgccaccacactgggttattttattttttttaaatatttttgtggagacatgctttgttgatcaggctgctctcaaactcctggcttcaagcgacccttctgccttggcctcccaaagtgctgggattataagtgtgaccaccatgcctggcccagaatttttttaatccattctgcgaattcattgtgtttcttgagacttagttactttcttctgtcatttgtttttatttatttttgagacagagtctcactctgtcatcactcaggctggagtgcagtagtgcaatcttggctcactgcaacctccacctccctggttcaagcaattctcatgccttggccacccaagtagctgggattacagatgcgcaccactatgcccagctcatttttgtgtttttagtaaagacgagttttcaccttgttggccaggctggtctcaaactccgggcctcaagtgatctgcccaccttggcctcccaaagtgctgagattacaggtgtgagccaccaccactcccggtgtggttttttttttttgtaacactctcactctgttgctcaggctggagtgcagtggtgcgattacagcacactgtaatctcgaactcctcaagcaattctcccaccttagcctaccaagtaactgggaccataggtgcacaccaccacactgggttattttatctttattttttatttttgttgagacgtgctttgttgtccaggctggtctccaactcctggcttcaagtgactcttctgccttggcctcccaaagtgctgggattacaaatgtgaccaccacacccagcccagaatttttttaattcattatgtttcttgagatttaaattcttctatcattatttatttatttatttatttttgagacagagtctcactctgtcatcacccaggctgaaatgcaatggcgcaatcttggctctctgcaacctctgcctccccagttcaagcaattcttgagcctcagccacccaagtagctgagattacaggtgcgtatagccatgcccagctgatttttgtatttttagtagagacggggtttcaccatgttggccaggctggtcttgaactcctggcctcaagagatccatccgccttggccttccaaagtgttagggttacagacgtgagccactgagccctgctttttttttttttttttttttttttttgagtaagactctcactctgtcactcaggttggagtgcagtggtgtgattacagcacactgtaacctcaaactcaagcgattcttccaccttagcctaccaagtaactgggaacataagtgcacgccaccacattgggttattttatctttattttttatttttgtagagacatgctttgttgcccaggctggtttcaaacccctggcttcaagtgactcttccaccttggcctcccaaagtgctgggattttttaaatccagcctagaattttttttaattcagtctgctaattcattatgtttcttgagatttaattaaattctcctatcatttgttttaagtctgacctagtataagccccccatttccttgatttgagcaacaggaccacaagaattacttcctggttttgaagcatacgatcgctctgttggttgatcatagtgatcctctttgtatcctccaggcagaggtgggggtgctgtcaaagactccccagggtcagctcccagaggtgggcagttgctactatagtctgatttctgccataacgtctgcctatgcacattatcaaagcccccactaacactgaagccattgcctttggctctaggtttttgcttcttgttttcactcctatggatttggttaggcctgcgttgagttttaacctggatttatttcctaaattcttgtttaatgccttttctacactagactgtgagtcagtttttcatagtcttcctaggctggaggttttcctttaagtatggctttgatttcagagagtctttctgcagtgtgacctcgttttcctgttaatttagttgggattcatcccatactcatcaccaacttgacattaccagccaagtagttgcagaggtcacagaacagaaagtctcaccggacaagttaaactcttccaggcacttaatgtattaagtcaatttaaaacacacacggagatgcaagggaaaagaaatacggttagttagcagacttagtgtagggtgtgagcaggatgaagggccaggctctctgaatcctggtacatgacagtgttcatgtggtgtgtctgtcatttgtctctgtctcatcagctgtccctatagatgatgttataaggactagtgttgaggtttgagccagggtgcccaaccataggaggtgcctggcaccaaggcggcaaggatgcctggccacttgacagcttgtcaattagcctgctgagcagataagggttttatttgcttttcttagacagagaacaggtagggccagaaagggtgtcactgatgggtggttgaattcaaacctcatgaatatgtattgcctcaagtgcctcctgtatatttagagtaatatatgttgggtatctctcagtccattctctcacgctttgcttgctaacaacttttctttatctaacgtatcttgagaattttgtggatgtcttccaagctacatacttactactcatctatacttctatcttaagtttcttcctttccatttttttccttccatagcagaattgaatattaacaaacaccaccaaaacatgcacgtaatgctatgcattttatactctactaccccaacctgttgagcaacgggactagggagggagacaaagccaacattcatttatgtgttatctcaggttctcttctattacttttattactaacaccactattagcaaacatggctttccatctgcaggccaaatgagcctgccaataccaggttctagaataagatctacttgcttgatcactggtagaactggacaactgctgtagctgataaactgtttgcttcctcatctttgtggggagctggtgccctaagactcaaggcacagaggagcagagaatgcatgcttccccagataggtagaccccagagggagatggaaaggaaaggggctaggccacaaggcctagaaaaggaaacaaaaaaatagttgcaagcatttgatcacatcggaatatgaacatatgtgataattttctgaagacaagaaattattaaagccagaaaaacaacatttaaattaagcatagtagtaagtaaatttagcttcttaaaaatgagagacttgtgcttcaagtgactcaagaaatcagtatactcatgcctgtaattgcagcactttgctgcaggccgaggcgagtggatcacctgagatcaggagttcaagaccagcctagccaacatggtgaaacccgtctctgctaaaaatacaaaaattagctgggtgtggtggtgggctcctgtaatccaagctactcaggaggctgaggtaggagaatcacttgaacccgggaggcagaggttgcagtgagctgagattgcgccactgcactccagcctagcaacagaataaggctccttctcaaaaaaaaaaaaaagaaaataaatcagtataaagctacaaacagaggacagcatcttagaggttgactcttgtgagttaagagttcactgtgcggttgtatagatttatacacacacacacacacacacacacacacacacacaagacagaggaattgatttagcataggaattggctcacgtaattatggaggcccaaggagtcccacaatttgttgtctgcaagctggagactcgggaaagccagtgatgtaaatcagtttgagtttgaaggcctgagaatcaggaacagtgaagtgacggtgtcagtctcggagtccaaatgccggagaacccagagtgctgatgtctgaggccaggagaagatggatgtcctagctcaaatggaagagatcaaattcgcccctcctctgcccttttgctctgtgtgggcccttaacaaattggatgatgcccactcacactgggaagagctaccctctttactcagtctaccaattcaaatggtaatcttttccagaaacactcttacaaatacacccggaaataatgctttaccagcatctgggtgtcctttaagtccagtcaagtcgatacctaaaattaaccatcatggcggccaaccgactaagtctgcatgaggaggtagtagagccctggggctcaccggcaagtaagaggcacattgcttgcctcctccaccgccatcgaaatgtgttgattatatgtaactttgagctgttaaatgtaattccactgcaattacatcatgaaactgagacagtatgatgggttactgacaaaagtaaaatgggtgtgaaaatgcctccatatggagactccatatgtgcatatgttttttgtgtaggtttgcatatataagcacttttaatatggaaaaatacacattaaaccacttcacattggtcatcttggggggatcagattggggaaggggaagttttaaatttttctttctatacttctatattatatttcttttatatttttataacgttaaaaatatcgtaaaaacctccttctccacttgagtcatgttcgaatgaaatcccacttaccaagtctgaaccgtcttggcgcaccattattaactgaatggtgctttgcatttctgaatggcctactgttggaaaaaaaatcgggaaccctaacaaccggctggatttgaggaatggatagagcaggtaggaggtaccttacctttattaaaatgccacaaacacttattgtgtaaagttaaataagtcactattaagagctgaattgtcttcctcaaaatttgtaagtggaagtcctaacacctggtacttcagaatgcgactatatttggagacagggtctttaaagaggcaattgagttaaaatgaggtcagtagggtgggccttcacccaatctgacaggtgtctttataaaaagagagagttagaggacacagacacacacagaagaccatgtgaagatgcagggagaagacgtcatctatctgcaagccaaggagagaggcttcagaaggagccaaccctgccaacaccttatcttaaacttctagcctccagaactacaagaaaatagattttttgttgtttaagcctccagactgtgggactttgttacagcagctctagaaaaccaaaagagccacaaatactcatatatagtatgtcttcattctaatggtacattaaaaaaaagattactgcctcatattgatgtttaaccatgtgtttgatgttcctgctttttaacttttaaagattcttttataattccttgcattttaccctcagaataatccaatgcattcagagaaatcaggtattcttattttacaagtgaagaaactgaggcacagaaggattaagtgacttgaccaaagtcttctagcaagtggtctcctgaaccgacagcctttctatgtaccacattcaacctatcaaatggagtatttcacaataactgtctctgctggtgcttatttccacataggtcacattcattcagcaaacatattgagcaactagtttgtgtctgtctttcttaggagttgaggagacaatgacggagaggacacagtcctgcttttgaggagcacatggtctaggtgtgttgacagacacatgaacaacattttatataatgtgagaaacactataatcacagcatgagtacggcattgtagggacaccactgagaatgtctttacagatgtggtagaaactgagtgggtcttgaagaattcaaaggagtttgtcagacagggatggggattcccaatggaagaagcttcatgtgcagaggcccagagttgtgcaaggtgggaacaaggacgctgaggatggaaaagagattggagtgtggcagtgcagggagggggagatttcatacttgtctactaaaaacgttagatacctttagctttatgacaaactcactgttttgtggttcttcatttttcactagtttcaccaagacagacttttttgggggccgttcctatagatcttacttctcacattttaatgagtatgatgtatcacctggggattttgttagagtgcagattctgattctgagaggggcctgctagtctgcatttctagaagattccatgtcagattctcgctgctggagcctggaccacactttgaatagcaaagcttagtctgtaaagtaagaaatcagaagattgggttgaccacatttgtattttaggaagttaaaccagacaaacatgtgtaaaactggttgtaagcgacttgctgctgcaagtcacaaaacaaaagttctgcggatatgtatcctgtgggttatgactcatttcaggaattcctcaaatggcaagaatacctcaaagattcatgaaatatgcattatttgaatgtactatgtatgtttcttcctaatttaatactttagtcctagtatagaagtggaattttagtagaattcttataagtaagtagtatgtttcaattacaggatatctacagcaaaaaataaaatgacttaaaaataatacaaataaaaccagcagtagttgacttggtgccatcttttctcaggaacgtgagtaatgactgggtcccatacatggagaacagattgctccacgcaaggcctattagaagttaacaccaaagcagatgttcttgaagctactgttaccattatagatgcaaatccagacaagctgttcccattttataggaaaaaaaatgtaataataaattaccatacttaccttaatggcttaataagaattcattagtgagcattcataaaagaggataagaagtttaaaaatgtactgcttaaaataattaatacttttatcacatcagaagcctaagacatagtaagcaatagcagatggtaattttaatatcttacaaatatcatgaaggctgctggaacccaaggtagaaaactgcaaaatacaatgactttggggtcagttgtaattataaagaagctcaaaggtcagagaccagatggaatccctctcaagtttaatccagagatgtttctcacaaagaatttaataggtgattgctttccctcaaagcctatttgaatgctagccctgaaagaatttacaaattttaaagggggaacttggccgggcacggtagctcacacctgtaatcccagcactttgggaggcctaggagagtgggtcgcctgaggtcaggagttcgggaccagcctggtcaacatagtgaaaccccgtctctactaaaaatacaaaaaaaaaaaaaattagcctggtgtagtggcacatgcttgtaatcccagctactcaggatgctgaggcaggagaattcgcttgaacctgagaggcggcggttgcagtgagccaagatcacaccattgcactccagtctgggcaacacaagcgaaactccgtctcaaaaaattataaaataaaataaaatacagggggatcttatattctttggccttatattctataaggagctttctggtgccttgaatcaacacaattcctgatggattcaaagccaaactttatgtagtttcccattgcctcattaaactgctcagtggtagaagctttttcctgtccactggaagaacactaaggcaggctatgactttccttgttcatttttaggtaataaacaagtcttaggcatgttataagacaaacatagcctcaattttaaaatatagtgcaggtgtcaaaaatagttcaaaactggaaaccatctataaggctatcttagccattaaaatccaagctggtgagaagaaatagggagaagaagaaatagagatgtgtgtatatttttaacatttggaaacatctaaaagctttaaactgggatgtcaaaatgtgccttacctttttttttttttgtaaaaacccaattagctgatcaagtatatgaaaagctgccattcctctacctccaatccctcctcatacaaagcagtggtctttactggggtccaaggatgatgcccagtatgtttacaaaattatcctttgtgatgcagggagaatattggaattatttttcatatttatttgtctgaaaatgagatacattaagctttaataatatttattttatttattcctgtttttgagacagttctcgctctgtcacccaggctggagtgcagcggctcactgcaacctccgcctcctgggttcaagcaattctcgtgcttcagccacctaagtagctgggattataggtgtgtaccaccacacccagctaatttttgtatttttagtagagatagggtttcaaacttctggcctcaagtgatctgcccaccttggcctcccaaagtgctaggattataggcatgagccaccccactcagcaaggtttattaatatttaatattctaactgactttagtacctgcactttctcatcgaatagaaggatgggtggatggatggataaaaagataggtagatagatagatagatgtatgatgtatgtatgggtagataagtaaatagataacagctagatggatgagttaatgggtggatagacagatgatagatggatgatagatggttgatagatagggaggaaagtagataatagatacatagatagatgtacttttttcttttcttttcttttcttccttttttcttttttttttttaatagctaggactgtgggataaacaaaagttggaaaccactggtctaaaatactaggacatttttgttttgcatttccagaatctggcaaggtactacttaatttattcaagttgttttcaaggggtaccatttaagagggctgatttttagatggaaagaacagtaatgccagtagtacacagatattatctaacctagaaaatgattgtcttgaaaaggtagtcctaattttcttgtatcagaatttactttgaataatgctacaggaaaagagctgtatgatggatgccagggcaggcgcgtgctgtagacgtggaagcagaagagcacccaggatatggggtgatgaagaatgttgtcacagagtagggaagagcagaactcttttaccaggtagaagcccaataccacacacacacacacacacacacacacacacacacacgaaaaagaggagcactaatgagaggagaactgggccttgagacctaggctttcatgcccccttcttttgcctcccagaggccagtaaagcctctctgtgggcttcctgggttccagggagaacagttcacatcagtggtatgaaatcacggctttcaagactttgcttcagcagagacctatcataagagatgcattttacattggaaatgcaaacatgtcaggatgtgtgtttcttgaaactgcagcttgacttgctaccttgaatgcactgccatgtcatctgttcctgcatctgaaatgctggctagtgtccctggcattcatggcacaagccagtgcagttgcaacccacagtctggaattcacagagaatgggagatacgctaggaaaggttagtatcagctgaaatgttaagggtcttaagtttcagacaaggaggtttaggcgttgttatttgtaaccaagagggtctcctgaggtttttagaaggggggcaatgtggccagacacagtggctcatgcctataatcccagcattttggaaagccaaggcggaaggattgcttgagcccgggagttctagaccagtcagagcaacatcatgaaaccctgtctctattaaaaaaaaatttaaaaattatggtggcgcgaactttaaatgtaaaatttaaaaacttcaaatttagcattaaaaaaaaaatggtgccacgaacctgtaatcccagctacttggaaggctgaggcgggatgactgcttgagccatgcaagcaatcatcaaggtcaaggctgcagtgagccatgattgcaccactgtattccagcctgggcgacagagtgagatcctgttccccccaaaaaagaaggtgggcagtgtgtctcaatgtgggctttggggaggtggtcggcctgtagcagtaggcacagtgtggtagatggtgcagggctcactggcactggggacagtagtgatagcccacagactagtttaggctcttgcagcctaaactgggggagtaaaatagttattatgcttctcaccctctcccccatgatttttttgcccttaaaaatgctaccagctcagacctaaggaagtgtcgcatagcgattaggagtgtggctctcaaagtcacctccttgctcctcacctacccactctgtgcacgtggccaggtgacttaaatttccctgccgacctctgcgaaaggctatttctgggacacaggaagagctctcaaagtacagtgaatgttagtggcattgtgcagaagcccaatgttagtggcatcgcgcagaagcccagaggaccacacttcctcgggagttggcgctcacggagtccagctgtgccagccatgtccccagggaaacaattcccctctgcaaaggcagaacattcctctgaagcagcttccaaatctgctgtcacttgcggcctggtcacctagttcttcaatcacaattgtgggaagagggggcaaaggaaatgccagcagggctcttgccttagcactcactgtgactgtgtatgtttaaaatacataaaaggcatactcaaaaatgacctgttgttcattctttcttacgctttcatcataaatatgcgttactgcacgtttaaggcaccatttaatttttggtacgctattcataatactgaggtgtaagagaacttgcaagaacattaggcagggacaaataaaagtagcaggctctagccatcgcttgtattttcttctgcttagccatttttgattgctttctccagttatttatttattacccaatatgaagcacagagaggaaaaaagatgttttgtttttgttttttaagagacaaggtctcgccatcacccaggctggagtgcaatggagctatcatagctcactgcagtctcaaactcctgggctcaagcaatctttccacctcaccctcccaagtagctgggactgcaggtgcccaccaccacctcagctaatttttaaaaattttttatagagacggggtcttgctgtgttgcccaggctggtcttaaactcctgcctaaaggggtccttctgccttgtcctttcaaagtgctgggattacaggtgagagccaccccacgttggtgctttcaccagttattacagcatacgtttatttctttcttttttcttttttttgagacaagggtctcgctctgttgcccaggctggagtgtagtggcatgatctcagctcactgcaacctccacctcccgggttcaagtgattctcttgcctcagccttttgagtagctgggactacaggtgtgcaccaccacacctgtattctttgtatttttaatagagacaggatttcaccatgttggccaggctggtcttgaactcgtgccctcaggtgatccgcctgcctcagcctcccaaagtgctggaatttcaggtgtgagccaccatgcttggcctatagtacactttgctctatcctagaactttctggcctgaggctaatttactctcaaacttaatgaatgggaagagtgacacttccctcatttctgccttattccatgactctgaggaggtgctaagatgcttccttctacctggaaaaagtgagtttttaagtgtgttttgcaagctttaggcctaatttgcatgttcacagcaagtgaagtggaaaatatagacaattatcttgatttttctagaaacacactcatttaaaatatcaaaaaattcagaatattttcccttgaattatttcagtaattatcccaattttgttctgtattgatgttggtatgatattaggtgccacttggggcatacaatacaaaagcaactacaaactgaagaagcaaaaaataacatcatgatacttatcatactttgcggaaaatgaagaacaggttcattacaatgcaccatcttcagtgaccctggctctgctggggtttcactgttgttgaagtgttcagaacacactaatgtacccagggaaggaagagctctttggcttctccagatctttttcttgactcctgctcacctgctctcctgactctcccacctggattcaccttgagctgacacccctgataagtctttcagcagcatttacaaggttacatttcctccagccattcctaagtgaatcaaaggcattttcttaagcctggaattcaaggtcctttggcaactggttctatgttcatctttgaattctgttactaatcctctgaataaattcccttctgcaatgatgcagagtacttcatcactttaccgccccctgcccccaacagtagtattcatgcccaacacgtcttccctgctcatccaagttctaaattttccttctcatctaggttctttcttttttgctttctttttatgtctttttttttttttcctgagacagggtcttgctgtgtcacccaggctggagtgcagtggtacaataacggctcactgcagccttgacctcctgggctcaagtgattgtcctacttcagcttcttgaccagctgggactacaggcacacaccaccacactcggctaatttttaaattttttgcagagatggggtttccccatgttgcccaggctggtctcgaactcctgagctcaagcaatcctccttcctggcctcccaaagtgatgggattacaggtgtgactaccacacctgactaatccaggttctttaattgccaaaatgtcctttagtttcttcccagttctgtttcctgagtttctttggtagatatatttcttttttttttttttgagatggagtctcgccttgtcgccctcgctggaatgcagtggcacaatcttggctcactgcaacctccgcctcttgggttcaagtaattctctgcctcagcctcccgagtagctgggatcacaagcatgcgccaccatgcccagctaatttttgtacttttagtagagacagggtttcaccatcttggccaggctggtcttgaactcctgaccttgtgatctgcccgccttggcctcccaaagtgctagaattataggcgtgagccactgcacccagccagatagatttctttctacctattctacctcttgataatgtactctattggctcttactacttttagcattttggtctttcctttacaggtagatttaaaactcttcacaaggagatagtttctttttgttatgtttcctttacagcatgttgcacagaactgggtatccattaggcgattcatggtcattgaaaattagcaggtaggggtgttccctaacccctgagatctagataagatgacctccaggtcttagttgcatgggtcgtcacagtccaagtctccttccagattctgcaggttcctcgggtcagccttcatggccatggccttggactcctgctttcagacaagctgctctgcagaatgctcactcagatataaagtccagcaaacaaaaactcacaaaaagcatttctgagtctagtaggacctactgaaaatctaaggaggaaatattctggactgtttccattcggcaatggaaactatttcaaatcagacagtggccttctgggtcctgtggctgcccacccacagggagtctgcattggctctttagccaggcagggttccctcccttctcttttctcctccatcctctttctttcaaaagcaatcctccccgctgccctaaaaaagcacaaatcaccaccatcatctgactcactttctctgcaaagcaacttacctatgtttgtgccaggcatctacaaacatcacggtttttagcatttctgctgggatcccagtatcatatcaaagttcttttctcagaaagaaagttccctctctcactagaaatctgacatagctgttagaacaactttgttttttaaccctgttatactgaaatatgtttacttcaggggttattaattttgaggttccttcctgttcttcatctcccttttgttagattgctatgttattcttgaacaacttcctttttctccctcctttcctaccatgatttcttccatgtactctttcaaaagtttcttgacctccagaactttggactttattaaggttttttccccaaagtaaccttttccttctcaagtggatcagattgacaaaagtgaggtataaaaaatggccgtcatacctgtctgggctacttagctgaaatagtttactttagaaggctctacacaagtacttctgtttgcctctctgtagacttatcgatactcagcagacagtaaccactctttgccggtctccagcatgacttagcagtgacagcttctctctcccaactttctaagtagcgcctcttcgtcaggaagtgtcgtctattttctggtgctcatactaccccgggtcttattttcactaattcttgaattaattttttccttacatccactagaatcaaaataagcaacctctgggaattactgccaaactctctctctcttttttttccctcgagatggagtcttgccctgtcactcaggctggagttcagtggcatgatctcagttcactgcaacctccgcctcccgggttcaagcaattctcttgtctcagcctcccaagtagctgggattacagatgcgcgcaccacgcccggccaatttttatatttttagtacagacaggctttcaccatgttggccaggctgatcttgaactactgacctcaggtgatccgcctgcctcagcctcccaaagtgctgggattacaggtgtgagccaccgtgcatggctgactctttaaaccagttgtattttttattacctttccagagatatccttgtgtacctttttctgggaagactatatggttcataattctgcatgttctcttacttctgtatcctcactggtattttgagtatgccacaatttcacatccttggcaagattttttttttcttttttttctttttttttgagatggagtctcgctcttgtcacccaggctggagtgcagtggcacaatctcagctcactgcaacctctgtcttctgggttcaagtgattctactctctcagcctcctgagtagctgggaatacgggtgcccgccaccacacctggctaatttttgtatttttagtagagacagggtttcaccatgttggccaggctggtctcgaacccttgacctgaggtgatccgcccgccttgtcatcccaaagtgctgggattacaggcgtgagccaccacacccaaccacaagtttttcttatttaaatttttttggtgcaagtagctggtggcccagcacaagacatcccagtggtaattaatactacacttcaacaactccccatctctgccccacagaacacaaagcaacaaaaaccaggtgggtgctgccaataattttcatttctgagaaataattcatagttttcaaaaaatgagcttaacagctactagttttttaaaaaatgtaacatgatttcttttaaggttttaattaacaacggctgtgtgtcaaaaaggtgcccatttgtgaggaatctgacttcaggagaggaaacacgtgtgcatatccatgagcaatggaagacctacgctgatgggggctgttttaatttgggaatgtttgctggttgaggacaaaaaagaataaagttattacacagttattatatatctatacaagtagatgcttagacagcagttttactgattgacagagcaaagtcactttggatactcccttggactccttccttttctcatgcaggttggagagacgccttagtctcatttcccgggtatatcgggggaagaacaaagtgcctgacctgaccgctgcttttcatggccagctgggagagtttcgacaagtcaacctctcagagtctcagcattcctctttataaaaatgggcacaacaatgaaaaaccgaaaatcaaaaaaggccaaacaatgggcacaagatggctatgcagctgtgcagccttcccgcggggcgcatgcgcatgcgtgcactgcacaggggcgctgtgggctaccagggcgcaggccaccccaaccacccccgcccccggccgccgactctgccctgcgctgctccccactgcgattggcctggctggtggctgtggctgctgtgtcctcgcccagccaatgcccctgaggatcactcaggttccccacagggctctcctgttcagtcactggggcggaacccagtgggagctttctcgggttgtgactgaccgcagcttcctctcactatctaggcctgccggatagccaccttgctgggaattcttaaaccttctggagctctgaggtttgtgtttcttatttttgaatatagttatacatttatttggttttaaacacattttctctcattcttgggggctctgtgagtgggaaggagaggcggtggtgtttggttggttgacatcatgaaaccaaagtatcacggtgtaattttactttgcgtttctttggtctctagtgggattggaattgcttgtttatgatattccttttattcctaaggagttacattttttttggggggggggggcgataagtaaggtcttgctctgttgcccagtctggggtgcagttgtgccattgcagctcactacagcctagaactcctgggcttgagcgatcctccctcctcagcctcctgcagagttaggactacaggcatgtgccaccatacccagctaattttggggaggttttgggggtgggggtagtgacaggatctcactatgttgcccattcttggctcaaactcctggactcaagcaattctcccacctaggcctcccaaagtgctgggattataggcgtgagccaccacccccggccacgaggggtcacatttaaaaatgatcccaatgataacttagatccttgaaatgaaaaggcaaaagaaggctaaggaaaagagttcaaatggtgatatctgagtgtgctacacaccatgagcgccaatattcacagattactggggaaggtgctgtttgcttcttcactgctctgagagatcaaagttcttcctaaaaaaaaactactcgagatttacctttcttgctattatctacttattctccctttcagtagcccagagtgtaaggttcatccctttttggacaatttaccaatagttttcttagtactttgtcttttggaatgtctgctgttgcacctcttatcaagcgtgcaccccaggtacggaggacagccacccgtgcttggaatgctatttgcattgacacaacccaacattccactgttgttgactcttagtaagcttgagggaactaaaactcatttttaaaaatgtagttattttaggccgggcgtggtggctcacgcctgtaatcccagcactttgggaggctgaggcaggcggatcacgacgtcaggagatcgagaccatcctggctaacatggtgaaaccccatctctattaaaaatacaaaaaattagccgggcgtggtggtgggcgcctgtagtcacagctactcgggaggctgaggcaggagaatggtgtgaacccaggaggcggagcttgcagtgagcagagatggagccactgcactccagcctgggtgacagagcgagactccatctcagaaaaaaaaaaaaaatgtagttattttattatttttctcccggttgtgaatttggatagttgctttttttttttttttaatgtaagaacctggctttacattgtatccctattatatttcgtgttgttagattcatcctacccatctaggccgtcaaaggcttttggatcctgactcccatcggatattttagctctccttccctgctttataactttcacttataaatgagaagagtctgcctctgggcttcacccagccactagtaaaatactggagagagaaggccaagagcagagccaggcagcacatttccctaagagccaggagatttcagagaggaaagtgacccctgtggcaaaaaggacaaagtggatggcctgtgtgtgtgtgttactggcagtgcctttaatacaaggcaccatactttttaaaaatatgaaagtgcaggaaacttagcatatcaaaaatcaggcttgtgctcaaagcggagagtcacagactacaggcacctaaaacgggatgctacccttgggctcttcctgcctgcattttgcctccctgccaacgtgagatgcgggtgagaagtgagggctgagtcactgtcactctgcaccagttccaggactgctcaagtcttttacccacttctagaatagaaaagaggtcagtgtggaaagagacgattctgaagagggcttcggtgagcagttatctctggagaaagctgtgcctgactaacacccagcccacctaccaacccccgcaactttcccccaaccccaccccatcccagacgcagaggcagatgccagtcacaggcattgcaacagaagcacttggtccacgtttgaccacgcttacttctataattatggcaactgagcgtcttggacaaataaccaataatggtcttatcctcaatttacttaggaagttttttttttttggacttctataatttttaagcaaacatctgaagatatagagccattcttcctattcatcattaataaatcttctaaaatgtcattatatatactcagattatatattttggcatgtggtaattgacgtgttctttgaaattttagaaactaaacagtgtttagcttagttccctagattgttatactctagaactgttaagacttataataacataaaaatgcctcatcctcagtctttatctgctcttttaaaacagactttaataaaatgcatcagtgactcaactatccacatccatgtgtcatacttaaagggtagataactaagaagaggctgttaccaaacaacttgtatttttatacttaagaaaattatagagaaaacataatcttacagaaaaatatataatataaagtaatttagtgaattagtctcaaatgcaagaaaattcactgttatttttctttctttagaagcctggaaaaacaaattatttgctgaacttagcacttcagttttctcttattcaggggagaaaactctctcatataaaatgtaaaatatcttaatatttatttttataacttaaattgacttttcttctccatcaaatcaaatgcaatggagcaggagttctgtgtttgtcaccaatcctttattgaaactggtaacttacacactttataatagaacaacaaaaataatgttcaatatatacagccttcgcatggactatctgactatacacaggcagagtgataacacaatctaatcttcatcataatctgtgcacaaaaagacaccaaacagacaacatgtgcacatcacagtgaaatgacatcacaggtccagtgaaaattcagcataatacaaaatggactgctctattgcaaatgacatctttctaaatgcccagctcttactcagtagtaatttacccagagtctgaagcagagattggttgtgtggctataagtctcttgagtgagacaacctctgcagataagtttgctatcccctgcttcaaatacaagttctctgggtcagaaactttgtagccactgtctttcatttcaacaactccagttttgaaactattctgagttttgccactcagttctttttgatgccagtgctccgatttgagagaccaatcttgaatgttagtcacttgcactgagaaaggagtaagagaagaatgtaccatacttggggcactatgcttttcgagttcgaaatgtcttttagatgtcatgtcaataggtgaggaaagtttttgcgtggcctcaaattcattatcaaaggcttctactttgatctgcatggctttggctttgatccggagcttgtgtggcaaggcagaggaattcacttctggaactttaaccacagttgcatgcacatgcttgagttcaactggagaatggatggggcccttggggacctgttgctcgtcttctccatcagatgactttcctaccacaccatcatcagtttccgacgttctcggggagttgctggaggatcggttgacttgcagtagtgggggagagtgtgagtacccagagaaagaattccccatatagttttgatagatggacgctgtgtaagagcctcggtcatctcttggctcccttgtgtagctctctaattccatcggctcttgcttgataatctggaacttgttttcaggacttctgcagcttccctgcacagagctctcctgcgtgtgttctactgaggacacttctgaaacatcggacagcgagctttgtggagagtgtttaatgacagaaatacaactacttgacaccatcgagggttcgtgctcgtccacaaatgaactcacattggatttggaagtctggtaatcttgaaagtacacagctgtagaattactgagtttctgaatctcttgagcatatgctgtggagctaattaaaccaaactttaattttagtgaaagcagctcagcttttaaagtggcgttttcttctcccagtgcaattagtttgttctctaaaaccaggtcattcagtcgacgcttctcacgagatcttttggcagcttcattatttttccgccttttttcccaatacatagcatctttcttttcatcaggaatgaattcccgtttcctccgacatgcagaagatttgttcttccccacacttccttcactgagaagcagctcctcacctgttgtggagtcttctgacacttccgttaaagcagaattaaggaccatcatcttgtccacattgctactggcatcaagagacgcctgctcctttttgacggtctgcatttttctcagctgcatcagaaacaaccttaccctatctatgtgtgtaggagaacaaattaatttccccgtattctcaagctctttaaaaactctggtttaaaatccatcaatattcttccttttgttctaccgtctgggataaatccgtcaggctccttattgaatgaagttgggcctccttcgttatctgcaatacatgaataaaaaaaaaaccagttattcactggataaatgtttattacaaattatgtacaaggaaatatgctaagcatttagggcatacaagcacagatgaggcatggccacagttctttctttcaacaagttagcattttcaaaaaggaaataagttcccaaatacctaaactataaagctgtaaaggacaaatccctaatgaggcctatcagtaagagaatatgtgatccaggaaagtgagggaaaaataaaataacctctgcccagagagaagtagaggaaggctgtatttaatgaggcgaaatggagaaatagttgggtgtgggcaattacaggaaggaaatgacagatagcctctggttggtaagtttctaaacagtacatgcataccgtggtgcttctaaataatgttacctaatatttacatcactgccaagcagatatgctcacctcttaaaagggactttaccaagtaaactttaacgtgagtaaaaaaaaagttctgcactcctatatggaataaaatacaaatggagacaaacttcttctacaaaaactaaagtaaaagccacattaacaacggagctgttggttttaatctacaccttaacgtggacataaacctgcccatcacatccttgactgcctggtaggcttatatcccagcaaattccaccaggtgactcactgcaactaaatgaaaaggattcttctccatcaagccatctctttacaagcatctgagtttaagagattagaatttttttttctgattcctttgaatttgttctatcaaacattcaagattgaagtatccaaaatgctttttgtgatcttgaaaattctgtcaaaatagatttcaggtttcagttacatagtagctttgaactaaaaaacagttactaggcggggcacggtggctcacacttgtaatcccagcactttggtaggccgaagcgggcagatcacaaggtcaggagatcgagaccatcctggccaacatggtgaaaccccatctctactaaaaaatacaaaaattagctgggtgtggtggtgtgtgcctgtaatcccagctactcgggaggctgaggcaggagaattgcttgaacctgggaggcagagattgcagtgagctgagatcacgccactgcactccagcctggtgacagagcaagactctgtcaaaaaaaaaaaaaaaaaaaaaaaaaccccacacaaaacaaaaaaacacttactattcaaagggggtttttaaaagtatagtgcattcttgaaatgaaattcttttaaaccaagagaatatagttacagaaaaaaatttctttcatttatatgaattagtttcaagtaaaatataacaactcaaaaatagaatcattcattagtttcctcttccattgatgaaatacttacactacaaatttggcctgacagttgccttagctcgagataataaaatccatgttatgttccagtagcaatcattgcatgggggcttttgaatttaactgtgtttctagacactgattctctgcctaatgttccagtcagtaatatttttcgttaaatagacatggtacaacagttccatcagcacgatctgcacacagtggcactttattctaccctactaaaaagatgtaatgagccaggtgtggtggctcatgcctgtaatcccagcactttgggaggccgaggtgggcggatcacctgaggtcaggagttcgagaccagcctggctaacatggtgaaaccccgtctctactaaaaatacaaaaattagtcgggtgtggtgacaggcgcctgtaatcccagctactcgggaggctgaggcaggagaatcgcttgaacccaggaacccaggaggcggaggttgcagtgagccaagatcgcgccattgcactccagcctgggggacaagagcgagacttcgtctcaaaaaaaaaaaaaaaaaaagatgtaatgttcttacatgatgccactatctccttcttacgcctagtttcataatgactaataaaatgaagtttacttttatcaattggaaaagcctgccagcttcttttgtcttttccagggaatgaaaggaattatgtaataatttcaggatcataaagaataatgtttcatgccaggtttttgcccattaaactgagccaacatagttaagggaacagctagtcgtaactcagagaaatttgtgattattaatatcaagtttctgtttgttttttggtaatgaaactttaataggaaatgaaggcaaggagtgtgtcacagtcagcagtgatgttgcagagaaggaatcttcctatttatcatttaaacaatattatttccttttttttttttgataagagtctcgctctgctgcccaggctagagtgcagtggtgcaatcttggtgcactgcagcctctgcttcccaggctcaagcgactctcctgcctcagcctcctgagtagctggggttacagttacgcgccaccacgcccagctaatttttttgtatttttagtagagacgggattttaccatgttggtcaggctggtcttgaactcctgatctcaggtgatttgcctgcctcggactcccaaagtgctgggattacaggcatgagccaccacgcccggccaacaatactatttcctctaatttgcatttaggttttgtcctctaatatgaaaacccagtttcctttacatattgaatggattctttcctctgttgaagtctgcactctgccattcagcaaagtcctcctgctaaagtaaaatgagtggagaagtaaagaggaagatatcccagttaaagaagacaattgcactgacctttcccaaggcacctttcaaatctccactatactcttggccactacttttttccacttttagtttttaaacatcatatgatcccttgcagactattattctggttattttctccacctgagaatctttctcttccatgtgttatcttatttgttccttcttaaaaaaaaaaatcagattcctttattttgcctcacttactagatttacagtaatgcttttgaaatgccccgccattctgtctgccttagttactcttcctaaacttctaggaccttttcaaggttggggcccaattgggaaggagccttcacaataggtcctatttctatttaactgaaatagccccatttgtcttaaaatttccttaactcatgtcttctaggtgtctaagtactatatgactactttatcatctctacaactttgttggtacattaacctacagaaaacttcatttgcttttttgtttttgagacagagtttcactcttgttgcccaggctggagtgcaatggtacgatcttggctcaccgcaacctctgcctacagggtccaagcaattctcctgcctcagcctcccaagtagctgggattacaggcatgtgccactaagcccagctacttttgtatttttagtagagatggggtttctccatgttagtagagatggggtttagtagagatggggaaactccatggggtttctccatggggagttcaggctggtcttgaactcccgacctcaggtgatctgcctaccttggcctcccaaagtgctgggattacaggcgtgagccacctcgccaggccacctcatttgtttttaatcatcttcttcctatttgaatttcatggcatgtcactataaatctgtgattctgctctcatctgtatgtattacattcatggtctctacaactcaatggcaaatcaccacactatcttaggatattttctgtaatattatctatcaaataatcttgcagtgttgaaaagagtttatcagcattatgggatgatacggagacaggcacaatcatatacactgtgtgtgtttccacgtgtttgtcttttgtgcccaactacactgcgaattacttcagggcggaaattaaaatatacttgtcttctagcaaaaacctgaagatattaggtgctcaacatttcattgacagtcacccatataccttatataagagagttttgtaaacagaaaacttttttgatgctttctttttaatgttatgtgaattgtaaagaagatattttacttattaacagagagattctcttattcattaatttgtttattcaacacatatggagcacctactgtgtactgggcacaaggggagactaggggcacataaagagggagagaaaaaccaaactcccgagaccaggcgctcagtcgtgggtgggtgggagacaaacaggtgagcagaggggaaccaggtgtgagtgcagagttgcacaaacatgggcctggggtgcaggctttcttcttgtcatggagataataacaaaaacaatcataattggtgccatttattgaacacttaccacagaatgggcactgggagcctgacctgctttctttcattcacttttggtgacaattttcagataagaaaactaaggctcagagaagtcaagtgacttgcccagtgtcacatagctaaatggcagagcgtacattcaggcccagttcctttactctctcctacactttcacaggtggttctgcatctttgcaatgcagtctcatttacacacagttctcttttgtgtcactttcatttctgagtaatacatacccttttactaagttactttgggcgcagtaaggcactatgctaacttaactacttcttctttttttttttttttctttttgagaaggagttttgctcttgttgcccaggctggagtgcaatggcgcgatcttggctcaccacaacttccacctcctgggttcaagcgattctcctgcctcagcctcccaagtagctgggattacaggcatgcgccaccatgcccaactaattttgtatttttagtagagacggggtttctccatgttggtcaggctggtcttgaactcccgatctcaggtgatccgcctgccacagcctcccaaagtgctgggattacaggcgtgagccgtcacgcctggctccttaacttctcttagatgctgtcttaacttctttagccagcaaagatactatctagaacttttctccatcctccttagatgtttcagatctggcactatttatgaattgagaaaacattttattaattttcatatctttactaaaattttaacctcctggctattctaattatgttaaatagagaaaaagaaatatgatagctgtggacattgtcacctatgatcttcttcttttttttttttttttaacaaatccaagagtgtaatctgttttcaacatgaggcgggggacagtgtctctctgaccctctcattttgcagattaatcagctagaagacaggctgaccttcccaagaccacacagcagttgggcacagatgggctctgagctctccttatgcccctcaacaatgaacttaaagcaaatgcaaaagtagtttacgatgccttcaaaaagcctcaggatttatgctaacctaacaaatttatttcaagcctcaatattttcccttatgattaatttaacaattacttcatctatgcatcatcttttcaaatcaacatctaatgttgtggtatattagtcattgcttaagtttcttttttggtgaataattgacactacatgccaattctatgatgttagtgtattcagcacgattaacttcattacacacattagatgatatgactctccttgaaaacacaaataaaaaagagaaatttaagagcaggtattattacctaccagttgacatatttttccatacatactccgaaggtgccatcactaattaatgcttttgtatagtccatcacactacttctctaagcaagaattatatagcaagaattatatttcataagcccagatttttaaagtttaagtcagattaccctattgtttttaattaagtacaagatttgatttagaaaattctataaaagaatataacctcataacaataattctagaccaaatttatccttgaggagttatctcattagttatgtttatgatagacctttatcttccctggtctctcccagaactaatgtttaacaatccaagctccacaaaagaaaagaataaacatgctttgtttcaatcatctgaaatcttactaatagtctaaacattaaaatctactctgagaacattttgttattaattatctataaagggtaagttttattgcaaattgcaatatatattttgtttttaaaattctgtcaatagaagatgaaatactatttgatatgcccaatgatttggaaacattatagaattatcttattttccctctactctctgaatgtattgttttctccctgttatataatacagataacagtaaaggaaaaaaaaatgtcttcaaggtaaacctaagttatgttaaactgtaagccacctctccagtaagacagcagatgcttattttttagataaatgtcattttcatgaaaaaatcaaatcaattaatcaattcacatctctttatacttttaaagtatgaatactagcaatatgttaaccctacattttcttcctgtgggtaaaattcacagtatctgcgtcaatgaaatgctttacttcttttcatggatgagaaaacaatctagtatttaaaagcagagatgaaataagaaaagaattcactatacatgtacaacccagaggaaatggggagtgaaaaaactcagtcagaaaacaccgaagttgcaagagaattttctaatcccgttgaaaaagagaaggatttttaagctgagaaaactatgttaaacctctctaagggccattctgtccccaagaagcagcttaccccaaagttagagagaaatgtgcacttgatcaagacaggcaagacgcacacacacacatacacacacactctcgcacactgccagaatctattctatcatagcaacaaattgacctactttttctatttgggtgcctctgtaaataaatgtgtcaaagcctgatccagtttatgataaatgaaaatatttcaagttcgacaaaggactagctgaaaattaaatttaaatttaataaatacgatgacaacattgcattttattacatcactgatgtaatttaagtaattgaaatatgaaatagtataacttaacattcttctttaagaggtcgtcagtgtttgaaacttaatacacaattaaattattctgaagcctgcacagagtaagcacatacacgctagcacgaccaattaactgcacagcttgagaaataagaacagctctcactaaagatgggtagtaacatgggggaaaaacagaacagtaataattttttaaaaatctatagaaacttaaatgtggggactattaatatcttgaaacttctgaaaagataactgatcagtgtagcaactaatctgaaatcttaaaaggacaccaacaatcacaaagtaacccagttgtagaaaattccccaatgaataagtaatacatgcaacatggtgtaatgatggcaaaaatggtgggctaaggggacagtcaggctgagaaaattcttgaaagtttctaatgataatgtagaatcatcccaacttgcttcacttggctttttaatttctttttccacttttccagtcagtggatgattataaatgtcattttctaccttatgaatagagtggattttcaaatgcttatttgtagtgtttatttgaaggccagttaattacagtttaagacccctaaaaagctaattaataaaagacatcatgttctgataactaaaaggcttataaacatcattctgagtcctatgaaactgagtcctcaaagcacagattaataacaaatggcatctagcaaatctctagtaaactttcttatcataaaaacaagtttatgctctattattaaagccatatgagaaacagttttgggtgttttttttttttttaactacagtaaagttacttacaaagaaatgtgaaagataactggggtagtagtaataaaaattcattttgaaactgaaaaattcatattgtaatgtctgtgatcaaaggtcaacgtctttcaacattctcatacaagtccaacctggatagaaatcaactcaaatataatttagaaaaataacaggatatcaaacaatgtattaaaccccgtgaaatacaggcataccttacaaaaacaagaaatgaatattaaaggcaatttcaattacattgtttctgttatattttgaattgaatcccaagtgtgctctcattcctcaatacaaattaaaaataaacaactttaacagcatcaatggcatctggattacaatggaaatcatgaagtatatgagtttaacctgggtaaaaataaagcccaggcaatatgactgcaccttttccattccatgctgcaatcgcatttacatctcgaaattgactctaatgaccaaggcaaggtcaactagaaaaatccactcagctggtgagtcaggcacattgctcaacgtccgaaaggcctctcacaaagggttttaattttcaggctgttgcatcacagtgatgttataactgcactgcacaaaaataagtctttaacccagaaaaggaaattgtttcaaaaactacagtgagtgtgagaatacactttgttgaggtgcaaatttccccatctggttttcaggctctgcgacctgggctgcaaattcatttctctgagtttccatttcctcatctatgaaatgtggatgataacagagcccctcaacactgtgcctggcacatgcagagtatgtgtttagtaaatactaactctttatctcttttctgaagaatgatcagtatcaaaaggcaacgatgcctatcagttccaggctgtttttgctgctcgtgactcttactgaagccctgacctatgtcgcaagtgtaagggtaaaccaaatgaaaatttggtcaaaagggtcaaatatcaacagtttcacaggactggccttagttttcaggctacatataccccctacaagagagcttatctgtggggtctcaccatccactgctgatctcagaccacaaagttttagatagagaaatcatccaagctacagaaaatgagtcacagaatgtgtaagggaattggaaaaagctgagctattaatatggcaattgtcacgtcattcctgctactataatcgactcatctctctattccttcaagcagctccccaaaacattaacccaatgacttgggaagtttgaggttctgcaatcctgtcaggaattcccctcaaactgaaattaacattgaacacgatggcaaattaaaaaatatatatattattagaacaaaaaaagtatctcaagaaagatcttacagacttaattccaacacgaatccttactgttactgcgaagagatttacaaagagaaaaatgaaggtaaatacacacacacacacacacacacacacacacacacacacagattctggttcctgatcaataacacaggaaacatttattgaactcctcacaaccaactaagtcaacaggttttattccctcagtttaccctggagagtgatggaaatcaggacagtgttggaagataacaagctggggcctgggacccagggttcttgtgagcccagggcctgcgctcttaggatctgtacctcaccgaaacctgttctctaactactgcctgtaacaggagggaaactgattagggatagcggtgtagggtatgatgccaaagaaagcaagttttcggtcagttttcaacaaagagcagattgcgttgatatgcttcaggagaacatctgtgatgtctccatgaattactgcatgggtacaatcttggaagtctttatgcgaggatgaaagtactgtagttttacagtaggacagcagcgtctatgtgggcgtttagattttattttgaactctggagatcagtgttctctctcctctagcctttgaccacataaattaaaggttaaaaaaaatcggctcaactcaactggccaaagtcaagctgaggccttccttttaatcactatcaatactggagcgcctccacccccaatttctgtggccggtggacgtttggaggtttttcttaaggtctttttcacttcaagaatggagacgcgcttggttccgaaatacaatgaagactcttggaacaaaggtgtctgcaggtttctgaacctcaccgcagaacaggcgcggagtcaggcccctggatttgccctgttggaaggagggccgcggagacgcaggcgctccgggtcgcccgcgctgcccctgtctgccccgtgcgggagccggggtccctggctccctggctccctggctcccgcggcccgggcgaacccagagcgcacccgtacgccggccccggccggtccctagcgcccgggctccacgggccgcgcccccacgcggcgcctcccagagaccctcctccctccgggtgggcggcgcagcggggcctcggcgccgcgaggaccccccgcgccagaacaaaggaatgtggggagggggcagggaggagctcaggccactgagcagccccagtataactgccgttcggaggcgcttctcggtcccgacccgaggtccccgcccgccactaccagacccgcccccagccccggattctcgcagaccccaccggcccgcaggagggagcggcgcactgggggccgcacggactcgccattggagatcgcgatcggaaggtggcgccacgcggcccctacaggcctgggactcccacccgagctcgcaaagtaggtcggggtctgaagctgggggcctagagcaactagcttcttggaaagcgactgcaattatttggggtaatatactctgttccagagacgtccaccccccacctcccacaaaaaaaaaccctgcacttaatttaaatgttacgttatatatacatcccatcatatacatatattcacacataatcactatgtaacagtccaggaagaaatttaatatttgggtaaattacatattcacacatcttcacataagtaaaaccagggtatccagacaaaaaaacaatctactaacctatatctgtttcccataggtcatatctggtctgggggtaaataaatacttctgacctcacttactgttgttatttacaaaagccaagaacagaagatgacacttggccattccctgctgttctcagagaacagcagtttcctaaagtgtcctttaaaaacataaatgggagccagcatccagcaaatcaccgggcgctgcgaaatgccttcctaaaaatacaatcttatcaaaggtctccgaaggcgtggagttaaaactacagcaaatggccttgaacttgtatttgcacacagccctggagaaaacaccagaaatagcactgcgaggccacaattgttaaaatgtgatagggctaaatttagaagaacgtgcgtttcatttagggcaaaagacacacattcggcagcatgagcaaactccatgcttacccggttgtctactttcctgtttaaaatatccttaaggaaaaaaaaaaaactgttatagtgacattcttaaaggctgagactgtcctactttctttgtagcaagattataaaatcacgtaattagctccctctctctatgctcactgccagcaaattcggcagttacataatgcaacatttccaggaaactattatgtgatttgtcttgtcgtgtctgaaaaagcaatgacaataaggtgagaaaaagggctgatcgaatggaatgcattaaaattaggaaggtggggaggtaaacgtcacaatggttcgtcccagatttaaaaataacagctgagaacattgaaagggcgaaccccagtagtacccaagatcagaattcaatgcgagcaattcttgcttttaggttttgtagtatcgttttaaaacctgtttatttgggacgtaatatagacgtaaataacgatctaatatccaacgctgcgcctcaattaccaaatcattgcacacatacgcgcatattcccacatcagcccgcaattcttgccaacatttcaccgtgggcagattatgcaatgtatgaaaggacaaatcccacaaccttcccgagggcttgtaaaacacgctgacgacaaacagggtggaaaacgtctgtgcagacacagcccctgacacaaacaaacgccgcgcaggcattctccgaatgccgtcaccgttcacgctaccaaccctttttctcaccaagcaaattaagactattccccattcctcaaccccccattcctctcccccctacgccgccagccccagagaaggaacgagaaagaaagacactagagaggaaagagcatcttcccgctcggagagggctcagcctgcctggcgctcttctttaccaaaacatcaattttcctgaaatcaggagacattatgcaacagcagcggggggagagcgcaaaccagccaggactacgtgccggcgcgaaggcgctgcaatcaaagcagccaccttaaggtggcgagtcccatcctgacaaggcagcaaaagtttatgtaatgaatgccccgcgcgcactcgccgccgctggcgagcccagcttacagcccgaccccgcacacagcgcggcccgcaccccgcgcccgcccgcccgcccgcagcgcgccctgggagcggtcgccgggcccccggccggcggtgggcggagcgcttaccgtgttcctgctctcgggccggcgaggagaaagaaaggggcggccgggagtcgggccgccggcgctcggggctcgggccgggccgggcctccggggccgcggcgggaggcgggcggcggcgagggcgcggcgcgggaggcgggcgggcgcgccgggtccgcgggcgccgtggccgcgcggagagatgtgtgttagtaggtcagttccgagcgccgcgctacgtcgccgcccgccagccccgcgtgactggcggccgcggccccaatcgccgcgcccgcacccgcccccggcccgccgccaatggccgcggccggcaggggcgggccggggcgggcactccgcggccccgccccgcctccccgccctcagctccccctccgcggcggcgccactaccagctcgcgtccctccccggccagggccaccgccgtccgagcgcccgcgagggctggcgccccattcccggcgcaacgagtgttgcgcaacggcccacgcggccgacacgaccggagcgagcctgcggaggagcccgggagccccccgtcccaccgccccgtccgctcttggctcccttcaccctcccggtcgccgcggtggctctgcgctccccgcgaccctcacttgctcgcagaggcgctttttgtcttcctgagagccgcagcctgctgggctacctgttgccgactgagcactgcgggttgcggctacccgggcgtggcccggacctcggcctccccttccccgcacactcccgagaggagccctctaccttggggtgggcaggagggaaggcggggggtggcggctggcaagctgccaacactcggggcgcgctgcggcggggaaggggttggcgcggccgggcagctgcgcagggctgcgcggcggaggcagcgattaaaatgtcccggcgcctctcccgagagccgcgacggcccggagccgggagggaaagctccacgcacaaacaccgccccctgcacaattagggcgaagatgacggctgcaaagttgttgcgtaacacgactgggaaacgaggctcgctgaggtccatctacccacccccgccacgcgggtgcggcgttcctcggaggatgtgaaggtccgcgctcgggtgcccccgctgggacgcccactgtcgtttggtgctggggcttgagacgaccgcgcgggatctcttcctgtgattttgagctgatagctgcttagtgttatttctgcgtctaactggatacggtagtcttctctcccaaattcccgggctacggaagagacgtaaaaaaatggaaaaaagagcacctagccgcgacttcttaagtcgtcgcgctagactgtcaaggcacgtggcacactccctgcgtttaccgatacacggatagtggtcagtgctggccttggcgaagggagccatgttcccgacagtgactcacaggcttgcccaaatacggagtgtggcaggtgggcaggacctccaccagccagctccctcctggtctccttgaactacgtgggggctgggccgagtgcctccacgactttccacttctttttgctcctttcgtttttaaaaagcaaaaaccaaagtaaagagaagagcagagtgaacacccaggtaccatccctagtgtctgccatgagcagcagatctatctactcgccaagattgtcttttctacctttccccttcttgcacagttaatatcataataacgcaagtcatatttaaaaaatttttatcacctatcagttgagtttttggaaagccttccagggcagcgttgtggttttgaacgcactcttgttcgtgatttatctggtagtacagctctgctgacaaggctctgaaaactcagacgtacaatatgggcttagcgtgttccccgacaccatcttcccggtgctgactaatgcaagaaccacatcccctccactacacattttccaaacttgactaccttcatgagaacaaatcctgattttagtttataatttccacttttctcatacatatataataattcaagatgtggtcttactatgttgtccaggttggcctggaactcctgggctcaaaggatcctccggccacagcctccctggtagtggaattacaggcgcatgccactgtgcctggccacttttctcaaatttactgatagtttcctttttgcccaaaccttacaatgcttatttgtagctttgagaacctctcttagatgaaatcaaaatcatatccatattagttgcctttttggggtcagaaatgcagctattgtctagaaatccagggctgtcctgcataatctaccctccccttcacgtgttctgaccttgttctgcattttgaataatttcatggaatttcaaagccgttgtagtaaatgtctttctttaaagacaactcgaccttcaagacaggtaaagaacgtgcctggagccaccccaggcagtgatgctggaggagttctctcaacctggaaacttattctttatgctgaattttgaaatcgaatgctcctatatttacttggagtattttagattgtgtatgtattatatctgtgcatcattcattgttaccatctaacttggaaatcagaggaagtgtgaaaggtatctgagataccagcttagaaaacaactctttagctcctcctggtgattaggacaccactaaacaacaggatgaaggatctgtccccagggccgaagtgatgatgtatctaatattatatcctagaacattcacagagtaggtaagtatttgcagattaactcgagtaaatggagcataaaaacctaagatatttgaaacaaattaaccagggtggggaggcttctaggaagacatcagcatgtgcctgatggtggagctgggctgtaaggttctcaggaggaggaggaaggggttcttgctctcagcaacctctcagtgctaggggtggattgagggcaggggcaagggaggaggtgcctggacagggatgagaactaccagcagaagacaatcaaccacattctaattcattttattatactgccaacatggtttctgactaagcaaatataagagctatagcttgagaacagaatgactaaaacagtgacttctccttactaaaatgggaattaataggaatttgtaatttagtaacaacttaatttaatatagtaataatttttctacagctgcagaatgtcttgagctggaacatccccaagaggccatatatatatcccagggattttacagtggacctcactaggccggagtaactgtaaagtcagatggataatgagaattcaggacgttagccacacgtggactgtggcaaaaagaaagtgacccactgaagaagactgtttttcagctctctcatcaattgctgtttccaggagcccacagctccaattactcaaaagaacgttgacttttttttttttggtaaaatatcctgattttcaggttaggcaagcaattcattaaaaaataaaagactgcacagcccacagctccaattattcaaaagaaagttgactttcttttttttggtaaaatatcctgattttcagtttaggcaagcaattcattaaaaaataaaagactgcaggacttacctacccagaggctggacagtctgagtcctctgagttctacagagatgtcctgggaacagggggtggagacgggggactcagtggctaaaaagcaggctgcctacctggcaaccaaattgggcagctctaccctatctgttttgtgcattggacttatggatttctttgtagaaaaaacttcgataactaaaagccctttggtgacctcctgtctggtctggtggccggcagcctgcatcagggctcctgtgtgccaggaccattttctttccactgtagtatgtttatggaccaccttgtgtctttttattaaactccaggaacagaagttcagtttctgggaatccatagcataccgtttttgttgttgttgttgttgttgttgttgtttttgtttttgagacagggtcttgctctcttgcccacactggagggcagtggagtgatcacggctcactgcagccttgacccccccaggctcaagcaaacctccaacctcagccttccaagtagctgggattacaggtgcacactaccatgcctggctaattttttaattttttttttgttagagtcagtgtctctctatgttgcccaggctggtctcaaactcctgggctcaagcaatcctcccaccttggcctcccaaagtgctggaattacaggtgtgagtcacagcaccagacctgttttgttttcaagtggaggctttaagatgtgagctagcatggtagccttagtgaggttctcctccccacgcccatcagtgtgtgctttttgctgggattttggctttgatgcaatgagtcattgactgttgaggcagaaacttcctggaatgatatttctttccaccactcatgcacttttatttctgctattcatgccatttttaatctttcacctctgtcttcctcttccgctttgccttttcttgtagtttttctacctttgttgaccttttttctttttaaatttagttatcttgatttactctattattcttagttttttcctttggcctttctccagtcattcagatcattacttcctgggattccttcattcccccaaacatccacttttctctttgctcttgccacctacctatcccagccacaacctagacgttatagtttttaagatttcaactgtcttccagcctctgcctctcggtcccctaactttgccatgtggctccattagcaggagttctattagcatgcttggccttctttttcaaaaactagcttttgtgggaaattgggtaatagaagatggtcacataacattccctgtagaagcgatggctttaaagtatgggaagccaaaatgtttcctattaagcagctcttgctcaagctaagaaagaaattagatctctacaccaacgacatgatttccccagacaaaatcagctgatggtctgaatacatttgaaagcatttccaaaggacccaggaaaagaccagaaagaggtgattttgcaaagaagagaaaatgttgcaagtacactattacaaaaactgaaacatgtctttaaattcagccaccacagatggcacacatttcagtaagcatttttattcattcagattaaatggtatatgtgagtaagagtgccaaaataagggacattaacaaaaaaaggtgggtaggaaaaaggagaatacactaaaaatggtcaagactgtgggagcagctaatcgtgttcattgcaaaatcttggcgatggagcaagcattgtggcagcactcagccagcaactggaacacagctagcagggctatgagtatatgaaatagaaaattgtgaaatatgttctaacaaaaatcatttcatgaagaataagacaagacaggtccacattgcaatccagttcaaatcaacgaagtaaagcttatctaaacatttctgtgaagtcatgcacaggatagtttactggaaagagctacacagctgcaactcagaagctgaaattctggtgcattctgtaccccatactcaccaaggggatcatttcacctctctgaatgtccattccttcatctgaaacccgagggagccaaccagatggttggccacgttccttctctcattagcatgggttgactaacatgccaccagcatatattgcagaaaagaaaaactgcaaatgtggcatttgcagcaaagcagctatggcaagcactggctcattcataaccttcccttggcctaattgtaacatggacaagagaaaattaccttgttgagttgcccaccaacttttgtcactccagagacaaaagttgtcttctggagtcgtttgtttcagcaagagattaaagtgaatgctctccgtttggtaaatgcacttaagaagtccggaaattgggtgcttgaccgcatttctggtcttctgagaaactttcagaagtgctcaagattcaggtgccattgtgttttcagctgctgctgtgtgatgctgctctcaggcggtgcatgtaggtctgtggaggattttgtgagtccgcatactggcaggatgataaaagagccagctctcgggcagtcaccaggaattgcaggcagtagagcccagtgctgaagacccagatacagaggcccgtgtccacatcccagcttgcccacagccactcaggaactctgtggctgtgggcaacttacttttctcgtctgctgtgtgcctcactttcaccttttgacaaccatttataattatagtatcaatctcaacttgttctgaggataaaattagtacctattaactgattaggaaagtgcctgatatattagcaagtgttagctattattattaacccaaaaaagaatcaacatacatcagaaaaatagtatcatcaaccaaatacttgtgcctgtgcatgcgtatgtgtgtgcgtgtccatattaattacatatacataataaatcttgttacgctgccaggatcctattcaattcagatgaacaagtgagcatgtacatctacaagaaagaataacagaggtggatggggattagaattcattcattcttccatttatggagcacctgctgggtgccaggcatcccttgaacagttgagtgatgtcccatgcctgctgtagacttggcgctcattcactcactccctcacttaaggtacatgtttactgactacttagcaggggccagaaactaagccaggcccttagaggttaatgggaagatgaggatggtgggttaaaagcataactcgaatactgtcgcggtgtggtaactgtcactggaaagaccagactgtgtaccaagaggggcttgaaggagaggagacccacattccattgaagcagaggcagaagtacttcctgaaagagggtataatttaatcaaagtttttcttttttattaaaaaaaatgtttggtacagggtcttgctctgttgcccaggctggagtgcagtggcatgatcatagctcactgcagccttgacctcctgagctcaagcaatcctcctgcctcagcctcccaagcagctagcactacaggtgcatgccaacacaccaggctaattaaaaaacattttgtagaggcaggatctcactatgttgctcaggctagtctcaaactcctggcctcaagtgatcctcctacctcagcctcccaagtgctgggattatgaccaaagtcttaaagatgtatgggtattctacaggcaggaatcatgcctcaaaagagtaccacataaagccaggcctagcaaagccagtgtggttggtgaccaagggaaccttggggagtgacaagtcctggcagagagcttgatggaaacccaggttttgcaaagtcggcatgggagagcagtgtggaaatgtagaccaggcccaggcctaggggacctggagtagcaaaaccaaccagtacgttattcaggcagtacgttattcaagcatttaaaacacattgttttaaatgctttttttcccccaaatgtcacacattaagaattagtgtagggaaatggttcaaagcctggactctagagctgggtggccatgggtaagtcacgtgaaaccttgatgcctcagtttcttcatctgagaaacagcacaatagtactttacatatgctatatatgcttcagttcctctacacagtaagaataataacaaatactgctcaaacaccacagcatgcacacaccgtcttgggcgcatcacatatattaagatgtttcatccttctaccattccgtggagaggggaaaggtgtcacgggaacagagcctgagcttagggatgcactggcacatgctctcctgtgctattacaaagggtgtgtattcatcccacgagagaaagccagctggagactagaagcaagtggaatttgacttgaacagtttaaccacagtggaagccgacgtgactttggccttcagggagtgtctgtacttgggctatgctgctccagagttccttttgcttctgttcctgctcctggctgtctgggatggttcccagtgcaggacttgtgctgctcaatgacccaggccacacaagactttccccctaatgcataagtaaaacaccactttcctttgtaaaaatgacctctctgcaagtcccagtgtgtctccttcctggatcccctttgcctcacctgtcccaagcctctcttgcttgctactggacaggctttgtcttggacgcctttccctcttctaccaccagcagctaacttgggtcttcctgggttcccaatgctttcctgctgctgcaagtaagatggacagaacttacagatgggcacctcccatcacttaggaactcacacaagcacagagggccaggaacctgtctttcccaggggctaccggggcaggtgacacaaccccatgatgtagggtagttggcacactgtcaggttagttctgagccatgagtgacaggagatgggatggaaccagtagataaatacctcctctctacaatgtttagtggcatgatgtcccaaatcccagccacagtctgtgctgtcttggggcactgtagtcaacctggtagtgtaccttgtccttataaatgtacttcccctatttctctgtctcctcttcttttcctcctactcttgcagttctagaattgtacctcccaagaaaggcttagcacaggagatttgattcaggctccggtttctgggaaactcaggcccagccaatttctttcggaacctgtcaaagattcaaagtgcagcaatagtcccaaaaataggtttcctgaaaacatgtccctcacgaaaagtagcagagaaagatgactctcagtcttgcagagaaattgtccattttcttatcttttgcagtattatgaaaactgttgctgacacataagaacctatatattccagtgaagttgtttaggtttttttttgccagatcttaattctgctgtgcaaaggcagagctgaaaagaaatgggaggttgatttgtaaagcattagtgtgagaaggtcttagggaggtcttttctagtactcttttggagtatgatatatattgctaaagtagctggagagtagtcagaagtatagctattttgatgtgataaaaggaaaacattttgaactgcagactaggaaagaaaactttcttgttactgaaaaatatttatctttactactgaatatctgaaaagcattctttttcagtgtaaatttaatcatttaatggtgaaacaataaagtccttcctatttaagtaggaaaataaacaggaaactcattattatttgacatcattttgaaggtcttagccattgcaatgagacaggaaaaaaaagaattatcagtattacaaggaagttataattccatatgttcatttacttatgtagcaaaactaaagcttatgcaaaaatagaagaattcagtaatgtagctggacaagatgttaatatttaaaaacaaaattttcctgcatatgggaatcatttgtaatagaatggctaaaagcacacattctacatttattgctgtgactatcggcaaattgctgagactcattatgtttcagtttcctcctctgcacacttgggattgtagtcatgctgccctctgaaggttatggtgaggatattatgaatgagcattgctgcagtttgactcacacaagatctacttacaagcttattcatccagtctttatttactctgggatttgcaagtatcaaatactttcagacttccttgatggcaggggtggctaactgacatcattctggccaaacgggcataataagaagttgcaggtgcccctattttccttttctcctgccttaaaaatggacatgatgctagaactatagcacccatttgaccatgagggaagcgtcaatatcagcacctgtttacctactcctgggcttcttgaacatgagaaacacaaacctcgatttgtttaagtcattgttagatgagtattttgtgaacaatattttcatttgtgactgaataacatgtgaagcataacataaataacatatctggtgcctaggcagtgtttaataaatgttagctcttagtattttagttgaaaaatattatatttaaatatatttaaaatatacttgggaaaagtgtcttattcacaataagaaaaactatcaaataattaatactacatctaacaaaaaggtacaagctagtctacataaagaaaactattaaacattgaataatgactaacagaagccaaacaagtaaaaaaattgaatatatttctgattaagagtattataaagatgatgattacccccaaattaaccaatgagtataatctctcttaatcaaaattctaatggatattttgagaaacttaaaaagttgattctcaggccagacacagtgactcatgcgtataatagaagcactttgggaggctgaggcatgaggatcactggagaccaggagattgagaccagtctgcacaacacaggctctcatgagtgcttctaaacaatggaacataatatgcttccagaacctcagcttcatgaagtctaagacatgtttcttcagctttcaagcctccccaagtagatatcagattgcatgggagtagaaaaaaatggatgctaagtgtctactaaccaagggaaaatacatcatgttggaatcattggctagaccttcatctcattccaagcataaaaatattcccgtaatattaaagatttaagtgttaaattacacataaaagtacaaaaccaaaatatgggagaacaggtctacatgaaacccagaagttacaaaagaaaagataaatatatttaattaaccgtgaagcagcttttgtttgataaaagacaccttaaaattaaaagacaaaaaatttgagaaaatagttcacatttttattctagaaaaaggtttaacattcttaatatgttaagcactcttataaatttacaagaaaatcaacatccaataggaaaatagtaaaaggatacgaataattttcgaaaaaaatcaagtgcacctagacttcaccactatacaattcatccatgtacaaccaaaaatcgcttgtactcttaaagctatcgcaattaaaaaaaaaattaagaataggtggcagtttagatttgggccataggcctgtagtttgccaaacacttctctaaagggtttcctagggaatgtggaggtcagcatgaacatgcccaaggaccatggcaaggctgcctgtaggtgacataacagtatccgtatgagccgtcttctatgattccaggcacccctgtgctttccctggttttcttttgcattcccccaaagtacctaataactgaattgtgtgttttctctttctttctctctctctccactgcccccactaggcatagcaagtatttgctatgtcaagtagtggaagcatcaccctccttggatattcagtcctctaaatgatcagaacccagagttgtgagaattgtgataaaaacgcttgctgcaactgacttatacaataatacaatcatcaggcccctggagctgctggtcagaaaactccaacatctctatgaccttgcctgcctgcagcaattgctaactcaacaggaagtgtgcctcacctctctttcaccatcaaattttatcttaatttgcatccagaataccagttgcaagagagactagtaaatgtggaattcaaattctatggtacataaaaggccactcaaaggaggttgaaatggaacttgagtgccatttcatcatggtcctcatgaagcctgaccgagtccacctgcctctagaggctggatgatggctccgtttggcactgaatcagttttagagacatctgcctgcgcctgaaactgaggagtgtaggaagaaaggtctgccttggtgaagtgaggactatgattttgccacatggtcttcatgactaccattctattctgtgacagtggtcaaccagggtcccttactgagactttcagtgaacagtttattccatgtgcctacagcttataatctaattaacatttcatctatgcatgccaggtactatcagaactcttccctttaatactagctggatttttacttccttcagttacatcttgtacatcccatagttcactcaacttgctgagaatctgggagcaattttttacagcattcagggtactttgttgcaagcaacacagaccgattttggctaatatgagcagaacagtaatttactaaacaaaaaaacccaaaaaactccaggcaactcacagaatctgtggcaagtcaggtttgaaggctaaaaagccggaagctatgccccaaatcaaactgcagaattgatctcccgcaggcactgctgtctctgctgtaggacagagaaactgcatctgcatggcacactcctccaatgctgctaccagaaagaaagctcctgcaaacaggatacagccaccttcacaggcactgccccagggaaagagcctgcatgatctccatttcttcacattaccattttctgattaagatttgaaggtggggccgggcgcggtggctcacgcctgtaatcccagcactttgggaggccgaaggcgggcggatcgcgaggtcaggtgatagagaccatcccggctaacacggtgaaacctcgtctctactaaaaatacaaaaaattagccgggcgtggtggcgggcacctttagtttcagctactccggaggctgaggcaggagaatggcgtgaatccgggtggcggagcttgcagtgagtcgagatggcgccactgcactccagcctgggcgacagagcaagactctgcctcaacaacaacaacaacaacaacaacaacaacaacaacaacaacaaagagttgaaggtggggagctaaggaggagttaagtatgtctgattggcaggacctacgtcatatgccaggaccctggctaccaagagtctgggaaaattaatagaagatcttcaacttctctgattggagacaggctctataacccaaaataggaagaggttcctctgccaagtagccataaagtgacaaatgttcactacatccttcatatatagtcagttacaatttcctactgacactatcccctaaatcagcagtccccaaccttttttggcagcagggaccggtttcgtggaagacaatttttccacgtgcaagggttttgggggatggtttcaggataaaactgttccgtgtcgaatcatcaggagttacattctcataaggagtgcgcaacctagatccctcgcatgcgcagttcccagtagagttcacactcctatgagaatctaatgcttccgctgctctgacaggaggctgagctcaggcagtaatgcttgctcgcccaccgctcatctcctgctgtgcgggccagttcctaacaggccagggatcagtaccggtctgtggcctggggattaaagaacactgtcctaaatctcttttttaaaacagctttattgagttataattcacatccatacaatttacccatgtaaagtgcacgattcaatggtatttgatgtattacatgttatattttttggatcaggaatacatatataacaaaatttgcctgttgaccatttttaagaaaataaatttaatcatttatacttaagatgtaaatatattgtgggatacatgtagatagtaaaatggtcactataaagaagcagattaacatattcgtcatctcacacagttacacttttgttagtttttgtggcaagaatagctaaagtctactcatttagcaggaatcacaaatacagtacaattttattatctgtaatcttcacgtacatttgatctctagacttgttcatcctacatgtctgttactttgtgtcctctgacctacatctccccatttcctttctacctccctagccccacccctggtaagcagtgtcttattccctatctctgtatatatgactctttaaaaaattccacatgtaaatgagatcatgtatttttgtgtgtgtgtctagcttatttcacttagcacaaacttccaggtttctgcatgttgtgacaaatggcaggatctccttttttaaaggcaaaataatatgtctttatctatatgtatgtagcacagtttcttaactatttgtatctctacagacacacaggttgtttccatatcttggctattgtgggtagtgctgcagtaaacacgggcgtgcacatacctttatgaaatggtgactttatttcctttgggtatatgcccagaaagggggttgctgggccacatggtagtcctatttttaatttttttggaaactttcatattggtttttataatggctgcaccaaactacatttccaccagcactatgcaagccttccctttttcttcacatacttcctaacattcgttatcttttgacttttaaataatagccatcataatgggtgtgaggtcgtatctcattgtgattttgactcgtgtttcctgatgattaactgcgtttaacaccttcttacaaatttgttggccgtttttcatatcttctttggagaaatgtctattcaggttctttgttcattttttattgagttatttgtttttctgctattgaattgtaggggttcttataagttgtggatgataaccccttatcagatacagggtatacaattttttttcccaattcataggctatttcattttgttgataatttcctttgctttgcagaagatttttattttgatgtagctccatttacttatctttacatttgtagcttgagcttttggtgtaattaggggaaaaaaatcattgtcaaggctaatgttcaggcacttttcccctctagtgtcttctaggagttctatagtttcaggtcttaaatttaggtatcttatccattttgagttgctttttgtgcatgatgtaagataacagtccaatttcattcttttatatgtagaaattcagttttcctagccccatttattagagagactatcctttctccattgtgtcctcttggtgccttggtcaaaacttaattgaccatacatgtttggatttacttctgtgcaccctattctgtttcactggtctatggcctgttattccaatatggtatgggtttattccaatacagtatgagtttgattattatagctttgcaatataatttaagatcagaaagtgtgataccttcaactatttgtcagaattgttttgattattcaggatgctttgtcgttccatatgaatttctgaactttaaaaaaaatttctgtgacaaatgttattgggattttgatagggattgcattgaatctgtatattgctttggttaacagacaatttaaaaacattaattattgtattcatgggcatgggatatctttgtatttattcttcctcaacttctttcatcaatgttttacagtttttagtgtctagatcttttacctccttggttaaatttctaagtgctttattttcttttgatgctactgtaaatgggactgttttcttgatttttctttcagctaggttattattctgtgagtaaaaacactactgatttttgtatgttgattttgaatcctgcaactttactgaattcacttattagttctaactgttttttttccctgtggaatctttgggattttatacatataggattgtacaatctgcaaaatagagatactttttctttcctttctaattgccttttatttcttttgtgtgtgcgtgtttgattgctcttgctaacttccagtactatgctgactagaagtggagagttgtcatccttgccttgtactggaccttggtggaaaagctttcagtttttctctgttgattatgttgttagctgtggggtttgcatacaaaatctttattatgtgtgagaaactttccttctaaatctaagctgttgagagttttttatcaacaaaggatgttggacttcgttaaatgctttttccttgtcaattcagaggatcagatggtttttactatttcattctgttaatgtagtatattatattgattgatttgcatatgttaaatcagtgttatatgccagaaataaatctcacttggtcatgatgtacagtctttttggtgtgttgttgaattcggtttgataatatttaattgagaattttttgcattaattctcatcagagaaattgacctatagttttcttttcttgtgatgtctttgtctggattaggtatcaagatgatgcttgcctcataaagtatgtttgggagtatttcctgtagccctattttttggaagagtttaggaagtattggtattagttcctctttgaatgtttggtagaattcagctgcgaaggcatctggtcttgggctcttaatttgggggagggttttgattatttcttcaatctctttgttattattctgttcaagctttctatttctttctgatttaactgtggtaggctttacttttctaggagttaatccaactcttaagtcatccaatttgtttggcatataattgttcataatagtcctgtgtgattcttttaatttttgaggcatccgtgtaatatcttcaatatcattttttattttatttgagtcttttctctcttttttgctagctagactagtaagtgtttttaaattttgtttactttttaaaaaaccaactcagttttaccaatttttttctatggtttttctgttctccatttcatttatttctattctgatctttattgtttccttccttctgctaactttgggcttagtttgttcttctttttctagttcttgaagaatatttttagactatttatttgggatcttttttcctttttaatgtaggtacttattgctgtacactttcctctcagaactgctgctgctgcatcccataggttttagtatgtttcatttccattgtcattggtctcaaggtatttacagtttcccttttaatttctccttttactcattgattgcttaggagcatgttgtttaatttccacatatgtgtgagtttttcaagatatcttctgttattgattcctggtttcacaccattttggtctgaaacaatcttcgatatgattttagttttttaaaatttgttaagggttgttttgtggcctaacatacagtgtatcctggagaatattccatgtgtacttgagaaaaatgtgtattctgctgctgttgcatggaatgttctgtatatgtctgttagggctgtatggtctaaagtgaaattcaagtccagtatttccctattaattttctgtgtagttgatctattcatggttgaaaatgaggtatcaaaatggtctactattattgtattgctgtgtatttctttcttcatgtccattaatatttgctttatgtgtttaggtactctgatgttgggtgcatatatattgataattgttatgtcctcttgatgaattgatccccttatcattaaataatgactttttttgtctcttgtgacagattttgatttgaagtatatttaattagatataagtttcagccacccctgctctcttttggttaccatttgcatggaatatcttcttctatcctcttactttcagtctatgtttgtccttaaacctaaactgggtctgtcgtaggaagcatatagttggatcttatttttttaattcacaaagccactctatgtcttttggttggagtatttaatcaacttacatttaaggttattatttacaagtaaaaccttactactgccattttgttatttgatttctggttgtcctgtggatcctttgctttttttgtctatctttgtgatttgaggattttctgtaatgctaagctttgattctttctctttattgtttgtataccagttataggttttggctttgtggttaccatgaggcttgcataaaacttcttatagttagaattgactattttaaacagacaacaacttaaattctgtcacatataaaaactctagacttttaccctaccccacacaatttatgtttttgatttcacaacttacatatttttatattttgtattccttaaccacttatggtagctttcgttatttttgactgttttgacttttaaccttcatactagagatatgaatgattcacatagcaccattatagtgttggagtattctgaatttgagtatgtgtttgcctgtactcatacatatgaaagaataaaagtactagtgagttttatactactactcctcactagttttatacttttctaggtattcattatagcaattattgtccttttttttctgcttgaagaactcctttaagcatttgtcataaggcagggatagtggtgatgagttccctcagcttttcattgtctgtgaaagactttatttctccttcatttcttaaggacagctttgctagatttagtatttatggctagcttggttttttcttttggtactttaaatatattacccctttctttcttggcttacaaggtttttgctgagaaatccactaatagtctaatgagaatgctgttatacatggcacgatgcttttctcttgctaccttttaaattctctatgtccttggggtgtcacttcaccagccagaaacctctgtggtcagcagtgtcctctgcctgagtattgcttgtgtctgctgggctcgttctgcccactcagcccagcaggctgtgctcagcttatgctaccagcctgtaacctatacctgccaagggcgagccaggcgcagagtggtgaggggtgtgtgggtgagcaagtgcaggatctggtcattgtgcacagccaggcatgctggctgctttggcagcacaggcagctccaggtgccagcacaggtgctggctccctgcaaggctgcagctggaccagatgtaccacatgtggcttctgctgtgggtgcccacatctggacgagagggacatggtggtgcccagaagcttggagatgccaggaaccacacagacccaaagagggtgccacagccctggctctgggagcccctaggtctgagctccccgaagggccacagctcttctctccttcttgtcatccggaatgtggcaagcagaggggcatgtttcagccctgtttgtgttacagcactttcagtcctgccattcagtgggtccaagttcttgtcccacatccaggaaaaatgaggtatgtggacaactggcaggtaagcaaggtgaagactagcttcactgaatgacagaacagctctcaagagacctaaagtgggtagctcctttctgcaggcaggtcatgcacatgaatatctagctctcagtagagaggagacccacagtgggtagctactttccataggcaggtcatcctgatgtctgttcaagtttgagtgtgtctggggtttttatgggctcagaagggaagaaatgcctgctgactggtccatgggcagccacgggcaggcctggaaaaagcgccgtaagttctcattccagtccacagactctacctggaactgatagcctggcccccatgcttcaggccatctgggatttgaaggaggggcttcaccagggaacagcccctttctgcccagaagcctgtatgcctcctgccaccaatcatgttgtccatggtgcccatgctgtttgtgctgaagggcacctgcaggcccatgcctgagctgccgtcagcacctccttggcctcccacttgtgctggtcagggcccaaagtttggaggaggccaaggcggcagggggctaacatgtcagcaccaccccaagcacatgcacacctgaacaggtcacaacagccctgggctcgaccacgactttgctccaccccagagtgggcactgggagcaggcacttccaagcctgcagggacagaggggcttcctaggctgggttggtagctgtggttgggtggctgcaggactcttgccccaacaactcagaagggggcagggctcccacctgttaccagcccccaccagctccatgagcatgcagcccgagccgcacctcccccactgcagctggtctcttagcggccctggctcaagacacgctgcagctgccatcatttacttttgacagcttgattataatgtaccccagagaggacctctttggttctgtttggataactttaagcttcatgaatctagacattaatatctttctcaagacatgggtaattttcagcaattatttcattaaataagctttctgtccctgttttgtctcttttcttgaaaattccatgttgcaagcatttgtttgcttagtagtgttacataagtccaacaggctttcttcattctttttcactttcatttttttcctctgattgattcatttcaaacagcctatcttcaagttcacagaatctttcttctgcttgatctagtctgctgttgaagctcttgattgtatttttcatttcattgatcaaattctttaattctaagatttatgtgtggttttaaaaaaaatgatatctatctctttattgaatttctcattcagatcataaactgttttcctgatttcattgaattatctatctgtattcttttgtatcttcctggatttcctttaaatcattattttgaattcttttttaggcagttggtaaattttcattttcttggagtcagttactgaagaattgttgtgttcctttgatggtatcatatttccttcgttttttgtgtttcttgtatcctgcattgacgtttgtgcatctggtggagcagtcacctctctcaaactttacacagtggcttttgttgggaaagattttcacccacagatgggcttgagggagacaattgggcagggcgtgatgggtctggtcccaggtgggtgtagttatgtaattctccatgtagcttctttacctgtgatgaacatcagcaatgactgtgggtgcctcagtggtctaggctgcaagattttgtggcaacagtggtggcagcatatgttattaggattcttggtggcaagagctttagagattctcctgtacttttcttctccaccacttagctgaagtgtcttagctgaaggaatctctcttcgtttcaagcctgacatggcccacaggtaatggtgctgggatccagggcccaggtgctctgagtgtctgtagagccagagtcctgggctgggctcagggtcttgcaaaactactataggacctgggacttgaggttcagttcactctctgaggcacaagtggctttagttctctaataaagctggggtctgttgctctgaggcatatcctagcagctgaggcccatggagctaggttgtagctatgactgtggtcctggtggtcagggcatagtactgacttggctctgggaagaaggggtactctgagggtttggccctggggagcaaggcacaactgcagttcaggtcccagaaccaataggaaacagtgacaacttgggccctgagggatgagataccacacagtagtgactctggattctgagaatgtgaggcatgacagtaacccaggctctgtgaggccagttgttgcagcagcaatgacccaggaatggcccagctgtggcttaggccctgaggaccggggagtagacagtgatgactctattccccatggagtgggcatgcctcagcagcttggactctgggggactactccagttttagggaggcagggcctttagctgtggagcctaaaaggtggggtagaacagctcagccaagggtaagtttccctggaatatgaggtgccacatcagctcagctccagagtatggctacacacattgccaggggctctagttctctgaggggtggggtgcagcattggcttgggcactgggggcgcaagactgctctgtagggctgaagcttagggtccatagaaagcagggcactacctcagctatggtacttggagatgcaactgccagaggtttgagatcccagagcagtgaggaagagtgttagctcagaccctgagggcagggtgctccagtgactgaaatcggggggatggagtgtctccacagtagcttagctcaggggtaggttgtagtaacagcttgacttagagatggtaatgctatcatgtgggcatggtacagtggcagcaaagactcagggatggagaggtgcaatggctactcatccctggagcagaacacagtctggcagtggccctaattccaagacggtgtagaacagcagcagctcagaccacaaggagagagatacaacatcagctctttctctggggtagtgcagtgtgtagacactggggagctcccttaactaggatcagaatctgtgaggactgtgggagtctccaataatgaagaatgcagatgtccacagtggtgatgggggtttcaggagtcctcttgcttacctttccctgcagagagaaagtctctcctggttatgagctgatccttactgggcgaccagttggtggaggcaaactgtttccttcccttctctacgtagccatactggatttctgtgcttcacaggatttctgttgctccttttctcttctctagtgttctcctttagttattttggttgaaatgtagttgtatattcattgttttgtttttgtgtgtgttgcaaggcaacgagttctacgaacttctagttgaccatcttgctgaaatcacccctaattttacccattttaaaagtgcaattcaatagcattaattacatttgcaatatggtacaaccatcatcactatttccaaaaccattttcatccttccaaatggaaactctgtaaccataaacaataactccttcttccttcacccctcagcctctagtaatctctaatatactttctgtctccatacatttgaccattttaggtatttcatattagtggaatcatacaatatacgtgctcttgtgtctagcttattttactaagtatgatgttttctctccctccctcccttccttcctccctccctccctttctctctctctctctctctctctttctttctttctctctttcaatggagttttgctcttgttgcccaggctggaatgcaatggcatggtcttggctcacagcaacctctacctcctgagttcaagtgattctcctgcctcagcctcccaagtagcttggattacaggtccgcaccaccatgcctggctaatttttgtagttttagtagaggcggggtttcaccatgttggccaagctggtcttaaactcccgacctcaggttatctgcttgcctcggcctcccaaaatgctgggattacagatgtgagccactgcgcccggccctgatgttttcaagtcttaaccatgtatagcatatataagaacttcattcattttaaagctgaatagtattccatttgtatgtatatatcacattttgtttacccattcatctgttgatggatacatgggtagtctctgactttgagctattatgaactatgctgtgatgaacactggcattccagtatctgtttgagtcctgctttcaattcctttgggtattgagattgctagtagtggaattgctggttcatatagtaatcctatgtttagcttcttgaggaactggcaaattgtttttcacaggagctgcaccattttatatttatgccaatgacacacaagagttccaatttctccatatccttgctaacatatgttattttccatttttaaaattatagccatcctagtatctgtgaagtgatatctcattgtgcctctttaattttcatttccctagtggttagtgatgttgagtatcttatcgcatccttattgactatgagtatatcttctttggagaaatatttattcaagtcctttaactactttttagttgtgttgtctttctattgttgagttctaagaattctttttctattcttgatattgaacccttatgagttatatgacttgcaaatattctttttaccatcctgtaagttgcctttttactctgttgacagtgttctttgatgcacaaaagtttttaattttgaagaagcccaatttgtctatttttcccttttgttaattgtgcttttggtgtaatatctagaaatttattgccaaatccaaggtgttgaagatcatgtctattctttcctgtaagagttttatggtttagctctcataattaggccattgatcccttatgagttaatttttgtatacttttgtatgtaatatgaactagggattcaactttattcttttgaaccacctattaaagagaatattctttccacattacatagactttgcacccttgtcaaatgtcttttttttcaaactctcaattttattctagtgctcttatgtctatcctcatgctagcaccacactattttgcttactttcttgttcattttgggttgctataacagaatacctgaggctgggtaacttactttaaaaaaaggtgtatttggctcatgattctggtggctgaaaaggccaacattaaacagttacatttgatgaggacttcatactgcttccatccatgacagaaagcagaagcggagtacgtgcaaaaagaacatggcaagagaggaatcaagaaagggaaaccaaggaagccaggctctttttaacagcatgctctagcaggaactaatccaatcctgtgacagcaagaactcacctctgatggaagacattaatctatttatgagggatctgctccctatgactcaaatacctcccactaggccccacctcccaacactgccacactggggatcaaatttcaacatgagttttggtgggaacagacccctttcaaaccaattactaaggcttggtagtaagttttaaaactgggaagtgtgagtcttctaacttcattatatttctcagtgtgcctttggctattcagggtcccttgaaattccatatgaagtaaagattggcttgtccctttctagaaaaaaaggtcatcagaatcttgatggggattgcattcaatttgtagatctttttgggtagtattgacagcttgatactattaagtcttctttttaatgggatgtctttccattaattttggtcctaatttctttcagcaacgttttataattttcagtatacaagtctttcaccttcttagttaatttattcctaggtatgttattaccttagatgctattgtaaatgaaattgctttcttaatttccttttctagttattcattgctggtatatagaaacacaactgatttttggtattgacattgcaccttgaaactttgtggaattaatttattagctttcttgtgtattctttggaattttctataagtaagacaatgccatttgcaaataaatatattttacctgctccttttcgttatttttttttattgtctaattgctctggctaaaacttaactatacaatgttgcacagcagggtgaaagtgaacttccttgtctcattcctgatcttagaatgaagaattttagttttttgccatagagtataatgttagctgcgggtttttcgtaaatgctctttagcatatgagaaatttccctcctctacctagttttctgagagttatttttatcataaaaaagatattggattgtcaaatgccttttctgcattacattttggtaattatgtgggtttcccccttctttctattaatgtgatgtattacatttactgcttttcttatgttgagccacccttgtattcctgatataaatcccacttggttgtggagtataatttttttaatgtgccattcaatttagtttgctaggattttgttgaggatttttgcatttctattcataagggacgttggtctgaagtttcttttttcttgtgatgtttttatctgactttgatatcagggtaatgctgaccttatagaattagttacaaagtttcctctcctcttctattttttaaaaacagttcaaggtttggtattagttctttgaatgtttggtagaatttatcagtaaagccgtctggtcctggatttttctttgttgagacatttttgattattgaattaatctcttcacttgttatataggtctgttgagattttctgtttatttttaagtcagtttaggtaatttgtgtatttctaaaagtttgtccatttcacctagattatctaattttctgcatacaattgttcatactattctcctaaaatcctttttatttctgtatagtcaatagtaatgtcttcacttttatttatggctttagtcatttgtatcttttctcttttgttctttattagtctagctaaattttgttaattttgttgatcatttcaaagaacaaacttttgggttaattcactttctttattgtttttgtattctctattttatttatctgctatctaacctttattcttttcttccttatcttacctttgaatttaatttgctctttttctcccatttcctcaagatataaagttaggctactgatgtgagatcttccttctttttaatgttggcatttacagctacaaatttccctctgaactctgtctttcatgcatcccataagttttggtatactagtttggttttcattttcattagtctccaatcatctaatatcttttgtgatttctttttgacccattggttatataagaatgcattgcttaatttccatatatttgtgaattttccaattttcacaggcattgatttctggcttcattctattatagttggagaagatgctttgtataatttcaattttaaaattcattgatatttgctttgtggcctacctaacacatgatttatcttggagaatattccatgtgcacttaagaagaatgtgtatccttctattgttgggtggagggttttgtgtatgtatgttaggtctagttagtttatagtgttgttcaagccctctgtgcccttatagatcttatggttaaatgttctgttcattattgaaagtggagtattgaagtcttcaattattattgtagaactgtatatttctcccttcaattttgtaaatcctaaagatctcttgactctggcttcctggctaccaaatttttttctgttctactttaatggtacctaaccagcttcagctttgttctgattaaatctgttccccaaacagtaaccaaggtaactttttctgaaaaccaaatttcatcccaacacttctcactctaaaaccattttcctagctctccattagcctcaagaaaacgttcttttttcttagcatgatttcaaagcccaccatgacctggctttggttcctacctttaattttaccttctttccactcttccttcttactcctgattccaaatatattgagtattgcatgtttccaattgcacccaatcctttcaccccctggcctttgttttactttgtatgctgctagaactgcctctagttctgctcctctatctcttcatatacagaatttctattgatctataagtgtcagttaaatcatcagttcctctgagaaacatactctgacttccttatacaaaatcacatatccttttaaagaattatacccttccatgtgttttgattcttatcataactcttaacataccacattttggcttgttaatcaccactagggcctctagcattgtgcctggcagataatagcttcactgggaaaggcaagccacaattggccctcaatatctcttcatgatcttgctgagtatgccaagaatacaagatcctgatcactctttatctggacccattcctcaggattgtatttgcagagagcacacctgagagataatgaagtaatgtctctcagacaaaaagcaggactctttctacttagcatattagtgatgactcatctaagatgtgtgggttcttgtcttgtaacacaaccactgtacacatgggcattcatcatggactgtttaaattggccctgcgggattcagggaaaacaggatatccacgcacatgacctgctgttgccatgagtaaggaagtcctttgtctctgacccaggaatctcatgtcttctgctagcatctgagaaacagtaatagtctaaattgttagcttgcaagtagagtaaaatcctagacccctcacaattcttgaaagttcaagaagtattttttagctatgtaaaccaaaaataaaatttgaagcccctcaaccatctgaatggaagcctcctcttgactaagggcattccaaagttaacctggaaaactagtttaggctgtgatgggaagggttgtttgggcatacctcattacaccctcctcccttttggaattcaggaaaagctgaccagcattaacatcaacacagatcttaagtctgataaaaacaccaaaacaatatttaaaatctattctctcagaagcctgctaccaggaagcttcatctgcataataaaactttagtctccacaacacctgtcatcatagcccagacctttctttctattgattccagaccttttgataataacttaactctttcaaccaattgccaatcagaaaaattttaaatctatctataacctggaagcccccattttcagttgtcctacatttccagatcaaatcaatgcacctcttacaggtattgaatgatgtattatgtctcctaaaaggtacaaaagcaagctaggccaggtgcggtggctcacgcctgtaatccctgcactttgggaggctgaggtgggcagatcacctgaggtcaggagttcgagaccagcctggctaacatggtgaaaccccgtttttactaaaaatacaaaataaaaactaaaaattagccaggtgtggtggcgtacacctgtaatcccagctactcaggaggctgaggcaggagaatcacttgaactcgggaggcggaggttgcagtgagccgagatcacaccactgcactccagcctgggcaacaagagtgaaactctgtctcaaaaaaaaaaaaaaaaaaaaagcaagctgtacctcaaccaccttgggcacatgttgtcaggacctcctgaggctgtgtcatagatatattcttaacattggcaaaataaactttctaaattaattgaggcctgtctcagagacttttgggttcacggctgtaagaacaaaagctggaattgtcacctgcactaattttctagggctgtgataacacagtatcacagactgggtggcttgtacaacagaaatttactttctcacaattctgagggctacacatctgaggtcaatgtgtcagcaggtttggttctttctgagagctgtgaaggaaagatctgtttcaggcttctctctttggcttgttgatggtcatcttcttcctgtggcttcacatggtttttcctctgtacatgtttgtatctgaatatcctcttcttataggaagctagacatattagattagggcccacactaatgacctcattataacttaattacctctgaaaagactctatccccaagtctggtcacattctgaggtactggcgtttaggactccaacatagaaatttttggagggacacaattcagcccataatagcatcataaataaaagcagaatacaaacatttggtaggttttacctcataagcctttgtcttattaaatgtaatgaattattaacaaaaatatttaaaaactaactttatttcggagagacataaacttgattttttcccaacatatttcaaaaattcttcttaaatccttgctatttagcatttttctcctgtgggtatactaataaaactatttgaccattcgagactgtattttaaagcagagacatttccaacattacactaaggcaatcatttattatacagattagtctaaaattttctctgaaattaaaacatgggaatagggtgcatttgtattggtaggtgttatctaattatgaaaactgatagaattaaaacattaaaaatagccacaaaatgagggcaagtcttactgacttgagatttatctttttagcttatagtatctcatttctggttttgtgtgtcatgtggaattaaacattagtttttgacatggaaaagaaatttcaagagattaaggcttgagaaatacaattaaagaacatcacaactaaggtcaggcacagtggctcatgcctgtagtcccagcactttgggaggctgaggcgggggatcacttgaggtcaggagtttgagaccagtctggccaacagggtgaaacatcatctctactaaaaatacaaaaattagctgggcatgggtggcgcatgcctgtagtcccagctactcaggtggctgaggcaggagaatcgcttgaacccgggaagtggaggttgcagcgagccaagatggcaccactacactccagtctgggagacagagtgagactctgtctcaaaaaaaaaaaaaaaaagaatatcacaagtaaaattacccatgatttgtgttccctaagcacaagcaaacaaggcaattggaatagaaaaattatttctattccatggaaatcaactttctgggaggctttttatcccaacaatatttgcctttttgtatttacaaaacaccgaatttttgactctgaaaaaaaaaatgctacagtaaaaccacaaagtcttgattacctatgaaattcatacatttccttagaaattgggccataattcaattaccccaaagtgattgtcaatttttactttttaaaaaactgtcagctgggcacagtggctcatgcctgtaatcccagcactttgggaggctgaggcaggtggattgcctgaggtcaggagtttgagcccagcctggccaacatggtgaaaccccgtctccactaaaaataaaaaaattagcagcttgtggtggcacgtgcctgtaatcccagctactggggaggctgaggtaggagaatggcttaaacccaggagacagaggttgcagtgagccgagattgtgccactgcactccagcctgggagacagagtaagactccatctcaaaacaaaacgaaacaaaacaaaacctctcataagaaactttagaagttttctcaataactggaactcatttttctaatgaattccatcatttaaaaatatttattaaatgtctactatgtgttaaatgttacagtaattgctagggacatcatggtgaacacagtctgcatgctctttgcctccagttattttgtacagtattttggctttatctaatgttttcttatgaaatgaggggtttgtgataggactatgagttatacgaatatgagggtgatgttccctttgatcatttgggtaaggtagtatctgttgagtttctccactgtttaggtctttttgtaagtaataaacatcttgagggagatatttgagactatgtgaatatattgcttttcctcaaacttttgctcaccaattttagcacccatccatggatctttctatggcaagttttgctgtggtgtttgactgatgttgagtttctatttccctctttccttctgcatttattacttgtagttattctgtaaggaaatgctgtcccatctccccattttatttgtttatttatttatttatttacatcacttgtggcttaatgatgtttattttattctatttaatactatcattctgtattttgtggcctaaattgttccagctttgatgtccttttgataagctctaacttaaaaattctttttaaatctttttttggatttattccaaacccttcatctacccagggctgttttattttacaagcattctttggccttattaaaacattgatagttgacaaaaaggtttattgatgtgtaattgaataattggtacatgataaacttcgcatatttgaagggtacaatccggcacattttgacatacttatagacctgtgacaccatcaccacattcaagttaacccatttatgcctaatatcccattattggaacgctatgcacgtgggagttatttatatcctactgctcaaggtcatagccaaggtctgattgcaaaaattttaaaaattgcaacctccagcataagtgggttaatgaacatgtatatcacccctaaaactctcctcatgcctcccccttaccctcacccaatattctgaggcaactgctgatttgttttctgtcattggagattaattcacactgtctaaaatttcatgtaagggaaaccacacaactttcctacttgtttctttcattagtataattattttgagatccattcatggtgttgtatatatcaatcgtttattcctttttattgttgaatattattccactgtatggatatacatgtatccattgatggacatagggttcattccctgctttgggctattacaaattgttccagcactttcaacatgtgtttgcgtgtcttaggagtcgaatgattggatcagtcacattgtaggttaatggttaatttttttagaaacttgccaaacagctttccagggtggttataccattttctattcctatcagaagaataggaaagttccagttctttcctatcctttccaacacttggtatggtcagtctttcgaattttatctactttaatagctatattatggtatcttattgaagtctttatttgataaatattttaaacacctttcccatgctcttagtagccattcttatctcatctttcctgaagtgttgacacaatttttttattggattgcttgttttctcaatattacatttttagagtttttcattctggatgactttatcagattgacggtttgcaatattttttctcagtgtatggctagcttttcattttcttggcaatgcttttaaagggaagaaagtctgaattttgataaagtctaattcattaactttttctgaattaattttactttttgcattatatctaaaaaatctttgcctatcacatgatgacaaggttttctcctctactttcttataggtattttatagtttaggttttacatttaggtctgtgatccattttgaattaacattttatatggtgtgaggaatgcattaaattcctttttggttcacttttttgggtttttgtattgttttgttttgtttgcatatggatatccaagtgtcccagcactgtttgttgaaaaaactatattttaatctactgaattacctttgcacttttattaaaagatatgtgtgtggttctatttctggactctttattctcttttattgatttatgtgtctatcttgacactaatgtctcactatcttgatcactgtacctttacaataatgcttaaaataagatagtgctactatccaaatttatcattctttttaaaagttctcttggtgttccaatcttttgaattttaacattttttaaggatcagtttgtcagtttttgtcaaaaaaaaactttctggaatttttattgtgatctcattgaatttatagatcaattaggagagatttgccattttaataatattgattcttccaagctgtaaacacttgttatctctgcatttaacactgttatcgctgttatttatttatttcttctgcactttctctcagcaatatcttatagttttcagtgtagaggtcacatctttgtcagattcattcccaagtgttttttatgctattataaacagtgtttaaagttcaatttctcattgttcattgttaccatatagaaatataatgtattatattatattagttctggtagctgtgtagcacatttcattggattttcttcatagatagctttctgtttgcaaatagagacagttttacttcttcctttccaatttgaatgtcttttatgtctttcatcaccttattacactgctcagaacctctagtacaatgttgaaaacaggtggagtgaaatctttgtgttgttaatttgggggaaaatatttaatcttttactgctaagtatgttagctataggtttattgtaggtactctttttaagtttgagcaacttttattccaagttttttgcaagattttaagatgaaaaatgtaaatatgattttgtgaaatgtttttttctctgtcttgagatgatcatacagtttttttcttttcatttgttcatgtggtagattgcattgattttcaaatgcaagccaaccttgtattcatgggataaaccccactttgccatgttatattgttctttttatatatcagtgacttagatttatttagaatttttacatatatttttatgtggaattttaatctgtaattaaaaaaatacatttgttagtttttttgaatcaataatgctgtccttgtagagagaatttggaactgttctctctaattttctggaagagtttttatagaattagtattattattttcttaaatatttggtagaactcaccagtgaagttattttatcctggagttttctttgctgggaggattttaactaaaaattcaatttcattatgagattcagggctatttaggttatttatcttcttcagtgagctttggtagtttatgtctttaaaggagtttgtccatttttgtctaaattgtcagatttattggcataatattattcatagtattctcctgttttgcttttaacatttgtagcatttgtagtaatgtcacctctctccttcttgatattgggccttcatttcttctatcttttttttctgataagcttttctagaagttatccattttttttatcatctcaaagaaccagcttttggttttattgattctattttttctgttttctatttcactgactttaatgttaaaaattcttatatatttacctacctagttaccatttctggtgatacttaatattttagttaactttttcttaatttaatgttgttctatcaaagtcattagaaagtatttgcttatttgggagtccaaggcaggaggactgcttgaggcctggaattttgaagtgatctcattgctggaggtatcacctgaagttcttggtgtcaagaaaattaaggagcatggacaccaaggatgaggttggggcaaagtttaataagtgaaagaagaaagctctctgctgtggagagggatgccattttgcagttgaatacaataatttttagaaacaggctggtgggacaggatgccttatttgcataaggtgcgaaaaactggtcaggactaagtgtttcgtttgcataaggtgtgaattcctgacagttccaccctgtccctctagtgcccatgtgggctgttagtctgagttactccatgttatttaacttccctactgcccatgtgtcaggggatggaattttccattgtggacctgcctggttctgtgtatcttatctgtgcagctataggcatgttttaggcaagactccctatgcaagctcccttaattgagtatgcccaaaaaaggaaagggatgtgctcagtgaagcccatcatgtatatgtgaatcttgctggctacacaaaaggcagtttttatgttggatcttgcttccttatctgtgcttgtagcttgatctttcaggctgctcttttagaaaagaactcttccaaggacatgtcctaagtctctgcttaacttgttccttcctctctcctctctcagtttgagatcagcctgggcaacatagtgagaccctgtctcaacaacaataacaaaattaaataaaaaattagctgagcatggtggtgtgcaccatagtcctagctactcaggaagctgaggcaggaggattgcttgagcccaggagttcaaggctgcagtgaactataatcatacctctgcactctagcctgggtgacagagagagactctgtcttaaaacaaaaaacaaacaaataaataaaaaagaaaatatttgtttatgtatttactttctccactagactataaaatccttgatgcgggtactgatttttattaatatttgcatttcaaatgctatagctcgaatacagtgctcaatgaatgtatgtataatgaatgaaggaatggatggatggatgaatgggggtaatgagacataccgtagagtcttttccttaggcaaaggcacactgacaaagagccctttttatataccctcttcatccagaatctggggaagatattgatgaggatggtggagaaggtagagagattggggttttatacgttcctttgttcataaaacatgttagaaaaataatgtctgagttgagctcccttctccccagcaacctctctccccagccacccccaccatccactgctccttctgccttgagtagagtcagaggagaaggctgtgcaggtagtttgagaagcaatcctcggaggaagagtgagggaccaggggagtgagacagggaaaaaagaagaaagaaaagtgtacagattgctgccatgggcaaggagggcttggttctttttttttttttttttttttgagatggagtctcactctgtcacccaggctgtagtgcagtggtgcaatcttggctcactgcaacctccatctcccaggttcaaatgattctcctgcctcagcctcccaagtagctgggactataggtgtgcaccatcatgcctggctaatttttctattgttttagtagagatggggtttcacaatgttggccaggctggtcttgaactcctgacctcaagtgatctgcccacctcagcctcccaaagtgctgggattacgggtgtgagccaccacgcccagcttggggtttgttcttaatagacaacttgtgaaaccagaattgtccacctgaaagacaggagatggaatgtttatccaccaaatcacattctttatttttcaagggttttccctgggggagttctgcaaagttcctgagttatgcacatttagagcctagcaagcatacacctgagtctttagttattaaatagagaagtcaaaaatgaacatctggctcataatgcatggcatatggggtaagtgcattgggcaccctctgaaaggcattacaactcaaaagtactattttacttatgtcttgaaaactgcaaaaatgcctaatatatcctaagcatataggcaatatagaaaggtttagaatagaaattaaatgctacattgccatctagttccttctgtgtaacttcataagcaatgagtaagacgcttttgtcattttcattgggaacatctgaattccatgctgtctatgccatgtttggagtttctcatctatcttgggtggaaacttgttcctggtcattgattttggaaagatttactcagtcagggacgattatggtgaagaacttgttaagctaccttgtttgtagagccaaccaaccccatcttatttatcttgtcaattccacagtttcacattttccaatttatacacagaagaaaatacatcccttaggaaaatgcccttaggaaaacttaacctagtttgacttcttaaaatttttttaactaaaaaataaattcaggtaaaaatttgaaaagttacaaataaaaagcaaaaataacaagttgtgtgtgtatgtggggtaaggattgagttgataactaaaaaccaaaagggacctatgttagttttctgagggtgccatgacaaattgccacaaacttcgtggcttaaaacaacagaaatgtattcactcctagatctggaggtcagaagtctgaaagccaggtgttgcccacactccctccggaggctcttgggaagaccttgccttgcctcttccagcttctgatggcttcaggtgtttcttggctttcttggcttatggccgcgtctctccaatctctgcctccagcttcacattgtcttctcctctgtgtctgagtcctctctgctcctgtctcaaatcagctctgcttttctgttattattaggacacttgcattggatttagggcccacacagataacctaggatgatttcctcatcgcaatgtccttaataactcttaaggatgaacctcaggtaaggagaggaaaaggaacctagaggaaaggcatcttatttaggaaacaaagtgacacacatctataaaatatattggcaagactatagtcttgccaatataggtaggtaatcacggtcattgttctatatgcttaataacgtggatttggaatctagtcaacattaacaaaatggggggaggttattcaatgggtacttaaaacctactaaggtatttgtcttgctgagaaggaccaggtgtgaaataactttagactttgttagttgatagttgagtatatatgttactacaaactacaaaataagaagtaaatccaaatatactagcaatcaatacatttctttatttctttccaatctattatcttttattttttttggtcttaatgcacctgctatgactgtcaatacaatgttaaatagaagtggtgagagtggacatccttgccttattcctgatcttaggaggatctgtgttatcctattaagtataatgttagcgatagtttttttgtaagcgttctttattgagaaagttccctctatttcttgtttgctgagagtttctatcataaatggtgttagattttgtcaaatgctttttctgcatctattaatatgatcatgtgctttttgttagaccgttgatatgatgtattacattgactgattttcagattttgaaccatctttgcatacgtggaataaattccacttgattgtaatgcataatcctttttatgctttgttgaactcaatttgttaatgctttattaagaagttttatatctacattcatgagagatattggtctgtagttttcttttcttataatatctttctctggtttaggtattaagataatgctggcctcattgtataagttagaaagtgccctctgtgcttctattttctggaagagattgtattattttttctttaaatgtttgatagaatttaccattgattccatcaaggcccaatgttttttttgggggtggggggagggaaggaaatagttattattattcaatttgcttaatggacataaaatattcagtttatctatttttttgtataagttttggtagtttatgtctttcaaggaattgatccatttcatctcagttattaaatctgtggccacagaattgtttgaaatattctttattatccttttaatatctatagaattagtataatgacatcttatttataatattggtaatttatgtcttctacatttttatcttggttaacctgtgtaatggtttatcgatcttattgatattttcaaagaaccagcttttggttttgttgatatcctacatagtttcttattttcaatttcattgatttcttttctgatttttattatttcttttattcagtttgctctaggcttaaattgttcttctttccgtagtttcataaggtggaagcttaggttattgattttagatatttcttctttgccaacatgcacatttcatgctataaacttccttctaacttctacttttgctgcattccacaactgttgataggttgtaattttatttatttcattatttattattttattaaataagatatttatttattaaatattttatcttgagacttctttgacaaatgtaatatatagaagaatgttgtttaatttccaaatatccagggattatccagctatctttatgttatggtttactagtttagttccattgcagtctaagaatggcccggcacatgacctgtcttggtgaatgttccatgtgagtttgaaaagaatgtgcattctgctgctgttgggcgaagacttttataaagataaattagagctagttgattggtagtgacactcaggttgtctatatcctttctgattttctgtcagctccatctatcaactaccaacagagtgttgaagtctgcagcgataatagtggatatgtccatttcttcttttaattctatcaagttttgcctcatgcattttgatgctctattgttagatacatatacatttaaaattgttctgttgttttggagaatcgactcctttataattatgtaatgtccctctttatccctgataattctgtctgctttgttgaaaaatagaactgttccagctttcttttgattagtgttaatatggtatatcattccccatcctttacttttaacatatttgcatctttatattttatgtgggtttcttgtagacaacatatagttttctttttattaaccctcaccaaaaatttctgtctttttattggtgtacttagaccatgcatgtttaaagtcattattggtatagttggttaatacctaccatatttattttatatttgctgtatttttttctttgtttctcacctccctcacatgtttctgccctctcaggttttaactgagcattttatattattccattttctctcctatcttggcatatcaaatatacctctgaaaaaaatttttttagtggttgtcctagagttaacacaatatattttaaactaacttaactctaccttcaaataacactatactacttcatgggtagtgcaggtgccttataatggagtattcctatttgcttcctcccttcccttgtgacattgctgtcattcatttcatttatacatatgccataatagccccatacaatgttattattgttactttaaacagttatcttttgtatcaattaagaataataaatataaaatgttttattttgccttcattcattccctctctgatgcagctccactctttatgcagacccaagattttgacctatgttatttccttctgcctgaagagcttataaaatttttggcagggccaatttgctggtgataaattttctgtttgtgtttgtcttagggagtctttatctctgtttcaactttgaagggtaatttttctgcatataaaagtctaggttggtgtgaactttttttcttttgacactttgagtaatttactactccaattctggcttgcatggattctgatgagaagattcttctcttccaaaaactaatctctatctttgctctcttagcgttaagctgtatttttcctctgtcttctttaatgattttctttttgttttggttttcttagttgcaataggctattcctagatatattggtatttattggtattactcctatttgtctttggttttctaagttgcaataggatgttactaaatgttattctattggtatttatcatgtttggtgttctctgagctctgcatctatagtttggtgtctgtcattacttttggaaagttcttaaccattattacttcaaatatttcttcttctctgtaccttttcttctcttttgatatttcaaatacgtatacactgcccattttgatattgtcccaaagttcttggagattcagttctgttttttaaaaaaaatatttcttctcttcacatttcagtttgtgaagttttaactgacctgtgttaaacctcaatgattctgtctttgttgtattgtgtatactggtgagcccttcaaagggattcttcatttctgccacagtgttttttacttctagaaatttatttagattctttattccagtttcatctccctgcttgtattatccatgtttttttttgcatcttgtctacctttactctatttttcccattagagctcttaacatattaatcatagtcttttaaattctttgcctgacaatttcaccatttgtgtcatagctgagtcagattccagcgtttgctttgtctccttgtagtgtgtgcatttttttttccttttagcatgcctttaaattttttgtggaatgcttgacgtgctatattggttaataggaactgaggtaaataggccatttatgttaggatttatgtgagaatttatgttaatctgttcaggagttgggctgtttaatgtttgctgtgctataggtgccagaggattaaaattcttctaatgtccttgttttctaatctttcctcttcactttaacctttcataagtacttttctttagagagagtctgagtcttgtggttcttttagctggaacccactgttattatactacagccctgtaggcatggtagtaaagggtgtggtgtgtgtgtgtgtgtatgtgtggggtgtgtgtgatgtacagtagatctgtgtgtgtgtgtaagcattctaaagtcacatgtttagatctcagtcttttagttagcctgtgtctttgtgttggctggtgtgattgatcctgattaccaaagggaaattgaaccactaatccacaatagaggtaaggaagagtgtgtttggaatacaggagatatgttaggacatctcttaatattaccatgccctgcaattaaagtcaatggactttacaatgacaacaacccaactccagccagagtactaacaacacagacccttctgaatgaaggttagagtcactctaccaggtgaaaaaccatgaccagctgagatgcttcctgagaacacaagaaatacagaatggtagtggatgaaagtagttataaaaagcagctaagactgtatgacctgttatgtaaaaagagaactgcaattgttatgagcatgagtttgttttgttatggatatgtatgtttgtataatgtctttgttttcttccctctcttatccccttatcatataacatgtaaagtattggctctgtatcatagtatttaagcattgttaattttatttcataatacttaagttgtaagacatcaaggaaaagagtaaacatcacccaagaacgttgcatcctttttgaggaaagggttaatgcacttttggccatacgcaggatagttctatcacattaggcagaagtatgacattgttattgtatttattctgagaataaacatggtttaaagaggtatatacgggtgtcaagttgacaaagagtggacttgtgatggttaatgttatgcgtcaacttgggcaggccatgatactcggatatttagtcaaatactctcctagatatttctctgaaggcattttttaggcgagattcatacttaaattagcagactttgagtacagtagaataccttccacaagtcagttgaagactttaaaagaaaaaagaatgattcccccaatgaagagggaattctgcaaagcagactgcattgagagtcaagctaccttcaacaacaactgttaccttagtctccagcctgccaattctgcagattctggacttgccagcaccccaaattgcatgatccaagttcttaaactaaatatctctctctgtctttatacacatattatatattatattatatcatattatatgtatatacaacttaaatgtgtgtgtgtaaatgcatatgtgtgtgtatatatagcatatgtgtgtatgtatacatgtgtatatgatgtatgtgtgcatgtgtgtatatatacacaaacatacatcttttcagttttgtttctctggaatactctaatagagcatttcttttagaggggtgctaatataaatgatatcacatttttgatgtcaaaatctaattgttcattgttggtatataagaaagcaattgacttttgtatattaaccatgtatactgcagccttgctataatcacttattagttacaacagggttttgtgttgattctctgggattttttttaattattactattatactttgagttctagggtacatgtacataacgtgcaggtttattacatacgtatacatgtgccatgttggtgtgctgcacccattaactcgtcatctacattaggtatttctcttaatgctatccctccccccaacccccaccccacaacaggccctggtatgtgatgttccccgccttgcgcccaagtgttctcattgttcaattcccacctatgagtgagaacatgcggtgtttggttttctgtccttgcgatagtttgctgagaatgatggtttccagcttcatccatgtccctataaaagacatgaactcatccttttttatggctgcatagtattccatggtgtttatgtgccacatttttttaatccagtctatcactgatggacatttgggttggttccaagtctttgctattgtgaatagtgctgcaataaacatatgtgtgcatgtgtctttatagcagcatgatttataatcctttgggtatatacccagtaatgggatggctgggtcaaatggtatttccagttctagatccttgaggaatcaccacactgtcttccacaatgcttgaactagtttacagtcccaccaacagtgtaaaagagttcctatttctccacatcctctccagcacctgttgtttcctgactttctaatgatcgccattctaactggcgtgagatggtatctcattgtggttttgatttgcatttctctgatggccagtgatgatgagcattttttcatgcgtcttttggctgcataaatgtcttcttttgagaaatgtctgttcacatccttcgcccactttttgatggggttgtttgtttttttcttgtaaatttgtttgagttctttgtcaattctggatgttagccctttgtccgatgagtagattgcaaaaattttctcccattctgtaggttgcctgttcactctgatggtagtttctcttgctgtgtagaagctctttactttaattagatcccatttatctattttggcttttgttgccattgctcttggtgttttagtcatgaagtccttgcccatgcctatgtcctgaatggtattgcctaggttttcttctagggtttttatggttttgggtctaacatttaagtctttaatccatcttgaattaatttttgtataaggtgtaaggaaggaatgcagtctcagctttctacatataccaagccagttttcccagcaccatttattaaatagggaatcctttccccatttcttgtttttgtcagatttgccaaagatcagatggttgtagatgtgtgatgttgtttctgaggcctctgttctgttccattggtctttatctctgttttggtaccagtaccatgctgttttggttactgtagccttgtgtagtttgaagtcagccagtgatgtctccagctttgttctttttgcttaggattgtcttggcaatgtgggctcttttttggttccatatgaactttaaagtagttttttccaagtctgtgaagaaagtcattggtagcttgatggggatggcactgaatctataaattaccttgggcagtatggccattttcacgatattgagtcttcctatctgtgagcatggaatgttctatttgtttgtgtcctcttttatttcattgagcagtggttcgtggttcttcttgaagaggtccttcatgtcccttgtaagttggattcctaggtattttattctctttgaagcaattgtgaatgggagttcactcatgatttggctctctgtttgtctgttattggtgtataggaatgcttgtgatttttgcacattgattttgtatcctgagactttgctgaagttgcttatcagcttaaggaggttttgggctgagacgatggggctttctaaatatacaatcatgtcatctgcaaacaaggacaatttgacttcctcttttcctaattgaataccctttatttctttctcctgcctgattgccctggccagaacttccaacactatgttgaataggagtggggagagagagcatccctgtcttgtgccagttttcaaagggaatgcttccagtttttgcgcattcagtatgctattggctttgggtttgtcataaatagctcttattattttgagatacatcccatcaatacctaatttattgagagtttttagcatgaagggctgttgaatttagtcaaaggccttttctgcatctattgagataatcatgtggtttttgtctttggttctgtttatatgctggattacatttattgatttgcgtatgttgaaccagccttgcatcccagggatgaagcccacttgatcatggtggataagctttttgatgtgctgctggattcggtttgccagtattttattgaggattttcacattgatgttcatcagggatattggtgtaaaattctctttttttgtggtgtctctgccaggctttggtatcaggatgatgctggcctcataaaatgagttagggaggattccctctttttctgttgattggaatagtttcagaaggaatagtaccagctcctttttgtacctctggcagaatttggctgtgaatccttctggtcctggactttttttggttggtaggctattaattattgcctcaatttcagagcctgttattggtctattcagggattcaacttcttcctggtttagtcttgggagggtgtatgtgtccaggaatttatccatttcttctagattttctagtttatttgcatagaggtgtttatagtattctctgatggtagtttgtatttctgtgggataggtggtgatatcccctttatcattttttattgtgtctatttgattcttctctattagtcttgctagtggtgtatcaattttgttgatcttttaaaaaaaaccagctcctggattcattgattttttgaagggttttttatgtctctatcttcttcagttctgctctgatcttagttatttcttgccttctgctagcttttgaatttgtttgcccttgcttctctagttttttaattgtgatgttagggtgtcaattttagatctttcctgctttctcttgtggacatttagtgctataaatttccctctacacactgctttaaatgtgtcccagaaattctggtatgttgtgtctttgttctcattggtttcaaagaacatctttatatctgtcttcatttcgttatttacccagtagtcattaaggagcaggttgttcagtttccatgtagttgtgtggttttgagtgagtttctcaatcctgagttctagtttgattgcactgtggtctgagagaaagtttgttgtgatttctgttcttttacatttgctgaggagtgctttacttccaactaagtggtcaattttggagtaagtgtgatgtggtgctgagaagaatgtatatactgttgatttggggtggagggttatgtagatgtctgttaggtctgcttggtacagagctgagttgaagtcctggatatccttgttagccttctgtctcgttgatctgtctaatactgacagtggggtgttaaagtctcccattattattgtgtggaagtctaagtctctttgtcggtctctaaggacttgccttatgaatctgggtgctcctgtgttgggtgcatatatatttaggatagttagctcttctcgttgaattgatccctttaccattatgtaatggccttcttttgatgtttgttggtttaaagtctgttttatcagagactaggattgcaacccctgctttttttttttgttttccatttgtttggtgtatcttcctccatccctttattttgagcctatgtgtgtctctgcacatgagatgggtctcctgaatacagcacactgatgggtcttgactctttatccaatttgccagtctgtgtcttttttttttttttttactttttttaaaattttattattattatactttaagttttagggtacctgtgcacaacgagcaggtttgttacatatgtatacatgtgccatgttggtgtgctgcacccattaactcgtcatttagcattaggtatatctcctaatgctatccctccccccaagtctgtgtcttttaattggagcatttaacccatttacatttaaggttaatattgttatgagtgaatttgatcctgtcattacaatgttagcttgttattttgcgcattagttgatgcagtttcttcctagcatcaatggtctttacaatttggcatgtttttgcagtggctggtaccagttgttcctttccatgtttagtgcttccttcaggagctcttgtaagacaggcctggtggtgacaaaatctctcagcatttgcttgtctgtaacagattttatttctccttcacttatgaagcttagtttggctggatatgaaattctgggttgaaaattcttttctttaagaatgttgaatattggcccccactctcttctgacttggagggtttctgccgagagatcagctgttagtctgatgggcttccctttgtgggtaacccaacctttctctctggctgcccttaacattttttccttcatttcaaccttggtgaatctgacgattatgtgtcttggggttgctcttctcaaggagtatctttgtggtgttctctgtatttcttgaatttgaatgttggcctgcctagctaggttggggaagttctcctggataatatcctgcagagtgttttccaacttggttccattctccccatcactttcaggtacaccaatcagatgtagatttggtcttttcacatagtcccatatttcttggaggctttgttaatttctttttactcttttttctctaaacttctcttctcgcttcatttcattcatttgatctgctatcactgctaccctttcttccacttgattgaatcagctactgaagcttgtgcatgtgtcacgtagttctcatgccatggttttcagctccatcaggtcatttaaggtcttctctatgctgtttattctagttagccattagtctaatcttttttcaaggtttctagcttccttgtgatgggttcaaacatcctcctttagctcagagaagtttattactgaccttctgaagcctacttttgtcagctcatcaaagtcattctccgtccagctttgttccattgctgatgaggagctatgatcctttggaggagaagaggtgctctggtttttagaattttcagcttttctgctctggtttctccccagctttgtggttttatctacctttggtctttgatgatggtgacgtacagatgggattttggtgtgaatgtcctttatgttgatgttgatgctattcctttctatttgctagttttctttctaacagtcaggaccctcagctgcaggtctgttggagttcgctggaggtccactccagaccctgtttgcctgtgtatcaccagcagaggctgcagaacagtaaatattgccacctgatccttcccatggaagctgcatctcagagagtcacccagctatatgaggtgtcagtcagcccctactggcaggcgtctcccagttaggctacacgggggtcaggctacttgaggaggcagtctgtctgttctcagagctcaaactctgtgctgggagaacactgatctcttcagagatgtcagacacagccatttaagtctgcagaagtttctgctgccttttgttcagctatgccctgcccccagaggtgaagtctacaaaggcaggcagtcctcgttgagctgtggtgggctccacccactttgagcttcctagtgcctttgtttacctactcaagcctcagcaatggcagacgcccctcccccagcctaggctgccacctggcagttcaatctcagactgccgcactagcagtgagcaaggctccgtgggcgtgggacccgccgagccaggcatgggatgtaatctcctgttgtgccatttgctaagacagttggaaaagcacactattagggcgggagtgtcccagttttccaggtactgtctgtcacagcttcccttggctaggaaagggaattccccctgactccttgtgcttcctgggtaaggcaacgccctgccctgtgttggctcaccctccgtgggctgcacctactgtccaaccagtcccagtgagatgaaccaggtacctcagttagaaatgtagaaatcacctgtcttctgcatcgattacgctgggagctgcagaccagagctgttcctatttggccatcttggaacaatctccaattctctgagattttctaaatagacaatcatgtcatctgtgaacaaagacagtctatttcttcccttccaatctgtacttttatttccttttcttatcttattgcattagtgagtacttccagaacaatgttgaataggagtggtgagagggatagctttgccttgtttctgaccttagagggaaagcatccagtttctcacccttatgtatcatgttagttgtagggtttttgttttttttttttaatcaagttgacaaaggtcccctttgtccctagtttgctaggagttttcatcatgaatgggtgttggattttgtcaattgctctttttgtacctattaatatgatcttatggtttttcttctttaatgtgttgatatgagggattatgttacttgatttttgaatattgacctgtcttgcacacctgtaatgaattccagttgttcatagtatgtaattctttttatatattatttgatttgattttctaatattttattgaaggctttttcatctaggctaacgagagatattggtgtataatttaggtttttctaccctggcactagttcccatgaaggctgctgctccttggcttctgttccagtatgtggtgattctctatatgcacctttctgtctcttcctattttggggcaatggtttggcctgtaaactcaattctatgatctaataagagttgtttattttccatttatgtctttctcttgtgagggcaggagtgatggcttcttagtgccttatgtgctgggctagactggaaatggttttttattctacctaaattgtggattttcatcctgggaatcctaacactctgaaggggttaggtgaggtggaagaaagatgagataaacgacttgagctttgctagccaaaaggtctctttcctgagtactttaatctgtccttgtcattcaaaagcagccatgggcaatagggaaacaaaccagtgtggctgtttcccaatacaacttcatttacaaaatgggcagtgggccagattagtcagcccctcatgtagacaaagtcctgcctatatattaaatggcagaacaaaaaagtaagaaagaacctggatggccttgtggagccactgtaccatccctgcaagtttgtgtggacttcttgccctgtgagacctactagccctaagctaaagctgctgttagtcaggggttctgtgactgatagttgaatgcattctcaattggcatgacaaacccatatctcattttcttgagcattcattgttatcatttctcaaggctttcttttctacccactcattactttgttccaaccatttcatgtactcataactccacttataatctatccatagattgatcacaaaattatccattccagtacagaccttgaccctgacttctagacctataatatacttatgtatagatatgtgcagcatatgttttatgtatgtattcaaaacttccaactacatggatagatgtaaacataaatatatatgtatgggtattcatatagaaacattttaaattcctctaaatacatcttgggctaacatgacagtcaattttagctgaaggtacagaattctaacaaaagtacctaatattataacctacaagatgtggccaaaatgtcactcagaggaaaaattctaaccttaagtgaaattattggaacacaaagaaagactacaaaataaaaatagcaagaagatgctaaaaaaagattaatacaaaaaatcagaaattaataaaatattgcaaaatgaatatatttgaaaccaacagaccagatatgccagggcatggtgggttaagaaacagtgagagaattcacaaatgaacaatgttggaaatgagaaaggccatatactcaagatacgaggaagttttaaaaattattaaggactacttataaccataaatacgataatatagattaaatgaattttccagtaaaatatatgtgaatgacatttacttgataatagcttgcaaatgcaaaaatactaactggagcaaaatcaaaggtagtgaatgatagttaactgattgtaagctctttgaaagaagctgccttgttcactgtggggtccctgacaccagacctatgcctggtgctcagtggttattggctaagtgaatgaatgaatgaatgactgctccataaggaaagaggctaggagacttgcacaagtaaattctactaacctttaaagcacagttaatttccatgtttgagcatggaagataatgtaaggctttctacctcattctacaagactaggactttcctgatactaaaaaaccagataccacacaaagaaacccatacctcaattcagtgcatagatgtaaacatcctatgtaaaatgatgcaaaaccaaatctagctgtgtataaaagaatcacgactgaccgggcacagtggctcatgcctgtaatcccagcactttgggaggctgaggcaggtggatcacctgaggtcaggtgtttgagaccagcctgaccaacatggcaaaaccccgtctctacaaaaaatacaaaaattagctgggtgtggtggcacgcacctgtaatcccagctattctggaggctgagacaggagacttgcttgaacctgggaggcggaggttgccgtgagccaagattgcgccactgcactccagcctgggtgacagagcaagaatccgtctaaaaaaaaaaaaaacaatgtccaattgtctatttatggaaatgcaaagtgtttcaacctttggtagtctatgaacgcaattcactacattcacaaattaaagaagaaaaacaaaaaatctctgtgatggtagctgaaaaggcattcaatacaattcaacatttcttactgaatatcacattttgtaaattaggataaaagaaactttttactgtgataaaggaaatctattgcacgtaaagcagctaatggtgaacactaaacattcctatcaaaatcaggaacaaacaagaattccactactgctgccgaagtttgcctttttctggaggttctagacgctaacagaataataaaaatatattagaggtgtaaatattagaaagggaagagcaaaactctaattcctgttaaatgatctgacttttctgtttgttttctgttgctgcataacacattaccagaaacttagtgccttaagacaattcccatttgttttctcacagttctgttgtccagagtctggccgggctgcactgggttccctgattgtggcctcgagagcctgaaatcaaggtgctggctgggctgaattcctgtctggagagtcagggaaaacccacttctaagctcttgggtgttgtggtcacagttcagttcctggggttgcccagctgagctccctgtttccttgacacatgtcactctccatctcagcgacagggagtccctcacatagaaccccctcgtgcttcacatctctgaattcctcttctctctgcagctgcagaaaatgctctgcttttaaagggctcatgtgatgaggttaggtcagcccagataatctctctgtcttaaggtcaactgattggcgaccttaattatctctgcaaaatcccttctgcagtgtaacctagagggaggccagggacaggtcataagccccatcttagaattccactcaccacaacttctaagaaaatcccaaagaagcaactgatagcatgataaccagatacaagatcaaaatggaaaaatcaatcgctttccaataattcactataaaaagtactggggaaaaaatttcaagcacgtaaagaaacagaaactaaaaacagccagagataaaactaataaaaatgtgcaagacctagacaaagaaaattataaatgcttatgaatgaacacaacaaagagaccccaaaagtggggagattgagcacattcctaggtctcctttttattttctttattctttttctttttttttaattacactctgagttctgggacacatgtgctgaatgtaaaggattttatttctgctttgcttatgaagcttggtttggctggatatgaaattctgggttgaaaattcttttctttaagaatgttgaatattggcccccactctcttctggcttgtagggtttctgcagagagatttgctgttagtctgatgggcttccctttgtgggtaacacaacctttctctctggctgcccttaacattttttccttcatttcaaccttggtgaatctgatgattatgtgtcttggggttgctcttctcgaggagtatctttgtggtgttctctgtatttcctgaatctgaatgttggcctatcttgctaggttggggaagttctcctggataatatcctgaagagtgttttccagcttggttccattctccccgtcacttttaggtacaccaatcagacacaggtttggccttttcacatagtcccatatttcttggaggctttgttcattccttttcactcttttttctctaatcttgtcttctcgctttatttcattaagttgatctttaatctctgatatcctttcttctgcttgattgatttggctattggtacttgtgtatgcttcatgaagttctcgtgctatgtttatcaggtcatttatgttcttctctaagccggttattctagttagcagttcctctaaccttttttcaaggttcttagcttccttgcattgggttagaacatgctcctttagctcggaggagtttgttattacccaccttctgaagcctacttctgtcaattcgtcaaagtcactttccgtccagttttgttcccttgctggcgaggagttgtgatcctttggaggagaaaagatgttctgttttttggaattttcagcctttttgcactgttttttcctgatcttcatggatttacctacctttggtctttgatgttggtgaccttcggatggggtttctgtttggacatcctttttgttgatgttgatgctattcctttctgtttgttagttttccttctaacaatcaggagcctctgctgcaggtctgctggagtttgctggaggtccactccagaccctgtttgcctgggtatcagcagcagaggctgcagaacacaaagattgctgcatgttccttcctctggaagctttgtcccagaggggcatctgccagatgccagccggagctctcctgtatgaggtgtccgtcaacccctgctgggacgtgtctcccagttaggaggcacaggggtcaggggcccacttgaggaggcagtctgtcccttagcagagcttgagcactgtgctgggggatccaccactctcttcagagccagcaggcaagaacgtttaagtctgctgaagctgtgcccacagccaccctttcccccaggtgctctgtcccagggagatgggagttttatctgtaagcccctgattggggctgctgcctttctttcagagatgccctgcccagagaggaggaatctagagaggcagtcttgctacagaggctttgccgagctgcggtgggctccaaccagtccgaacttcttggtgactttgtttacactgtgaggagaaaaccgcctactcaagcctcagtaatggcagatgcccctcccgccaccaagctcgagcatcccagatcaacttcagactgctgtcctggtagcgagaatttcaagccagtggatcttagcttgctgggctctgtgggggtgggatccactgagcaagaccccttggctccctggcttcagccccctttccaggggagtgaacagttctgtcttgctggcgttccaggcaccactgaggtatgaaaagaaaagaaaaaatcctgcagctagcttaatgtctgcccaaatggccacccagttttgtgcttgaaacccagggccctagtggcgtaggcacccaagggaatctcctggtctgcgggttgcaaagaccatgggaaaagcgtagtatctgggccagagtacactgtccctcatggcacagtccctcacggcttcccttggttaggggagggagttccctgaccccttgcacttctcgggtgaggtgatgtcccaccctgcttcggctcaccctctgtgagctgcacccactgtctaaccagtcccaaagagatgagccgagtacctcagttggaaatgcagaaatcacccactctctgtgttgatctcgctgggagctgcagactggagctgttcctatttggccatcttgccagccacctcctgtattttgttctcataatctaatattttttttttttttttgagacagagtttctctctgtctcccaggctggagtgcagtggtttgatcttggctcactgcctcttcattctttttaaacagtaaatgaatagccaggaaaaagttcaggaagcacaagaaggagaacatggtctaccagatattaagttatactctaaattatagtagttaaacccgtgtgtgagcttacagaacgaatcaaagagagtaatgaaacccaagagagcataaacatgaaacatagaatattctactagtagcattcaagtgcagggaaagtttgaactggtcaactaagggtattgaaacaactgattctctatttagaaaaaaatgttaaattcctacctcacaacatgcagaataatatattctagatgaattacggagctaaatataaaaaacaacaacaacaaagaccttagaaaacactaaaaaaaaggagaatagattgtattttaaaatttggcgatggactacgggttttgaagcaataaaagatacagcaaggaaatttcaggaggtctgactacacaaaaattgaaatctatggaccaagaagacctcataaattaagtcaaaatgcaggcaacaaaatggcttgagctcctaaaaaattacttctcaattaattgtcctgtgacattagccttcttgaaaaggtagagatttgtaaatatgcatatccatacataatgcacctttagaggatctgataggactcagagtaaataatacccacagttacccacaggaaaggatgggacagctgacagcggagcagggaagggcgcgcagagggtgaccttaaaagatttattctatgtcaacttcatgttattggagtacttcctgacatccacatttcatttcctttttatttggttagtttaaaatatttcagaaataacgtgtttttaaaagttaaataacacataggtgtgtagagttaacattgaaagactccttcagctaacaacgattcttagcccaattctactcccaagggataatacattttgtgtgtaaatccttatagaccttattctttcattacagaattaatttgagataatttttaaaaagtatgtatacacatagataaaaaaatgggaaaacacacgtaatttcactagcataaaacgtagttggttttattcatatcccaagtattttctatgcacttataaaaatataaatagttggtgtcataagatacatattgccgtgtaaccttatttttcacatcaaaatatgtattttgagtctcatttcatgtaaatagttataattctagtattgtatacaatcatagtcatctgctttttgatggctgtgattgtatacaatactataattaaattacacccttaatatttcaatattcgggttatttctattttaatgataaacagtgcttgtaattgatactttcttgtatatatcaccatactcttttctaattactttgcttttgattttgcggttaacgttttttgtaaacaacacaagaaataccaatgatatttgtattttaaaatattatggcaaaaactatcataaaaaaagtcaaaggacaaatgatcaacagagaaatatatgtgacaaataaagagttaacatctataacacaataaaatgcttgaaaaataaaaagattttaaaatctcagtgcgaaatagtcataaaatattaatagatagttttgaagaaaataattactaacgatcaataaacatatgaaaatataattaatttgactatttgccagaaaaatgaaattttaagaaatagtaagataatttcatgcaatctatttgcttaaaagtgagaaaaaatgacaccttggtgccggaaaggattgggggaaaaggcacttgcatactttgcccgtgggaacaggaataaccgcaactgttttggaaagtgatccggcaatatccattaaaaagttaaaatgcgcataccctttggccctacaatctcatttctcagaatctactctataaaaataaaagtatctgtacttgaggatgtctattgcaacactttttggcctggcaaaaaactacaagaagtgtgaaaggcaatcttcacagaaatgtacacagcatgaatccagttttataaaacaggaaatggttttataaaatattatcaaaaacagtgtttgcctctggttatatgaatgtggtgaaagttatggcaaagagtacatctggcctttatctttgggaggcagtagtttaatataaagaagccagggctgggtgatgatgatgatgatgatgatgatgatgatggtgattttactaggagtatagattactgtctaaccaaaaaaaatttttttttgggacagagttttgctcttgtcgcccaggctggagtgcagtagtgcgatcttggctcactataatctctgcctcccgggttcaagtgattctcttgcctcagcctccctagtagctgggattacaggcgcccccaccaacacgcccgactaatttttgtatttttagtgcagacgagattttgccatgttgttcaggctagtcttgaactctgtgacctcaggtgatctgcccatctcagcctccaaagtgctgggattacaggtgtgagccaccatgcccagcctcctaactgaacgttttaaaaagagacaaataagttggactctagagtatggtgaagaacttctgcacatgtatataggtaatggggcagaaaggactgcgtcatcacccgaaaggcgcacatgtcagcagcagagtatgggtctatgcagataagaccatcgactgcctatccacataaggttatgaagcatgggcttccacaacatccctggctagaagacttgttgcccaacttccagttcctggtctcttcccttatcatctccctcaacagtctgctcaacagtctgcacctgttgagttctctccctggtggtgggttccaaaggccatataagtcaccttcagagccctttccattggctgtgggtggagaagctaggaagctgcagtcttcccttctcaccccctccttctgtccctcccgtcctatgtttcctggccagcctgtgacagctttgctgggatatgctgtaatgtccagagttggatccagcaccagcaggatgaaaatagaatctgggaaactagcatagtactcaccctgctcaaaatcagaaagcctggagaggacaagaggaccgggaaatacccacatttcttctgtccccagcaggagtctggagttgcaggaaccaggaaaagtcagggtaccaggaacacacagtcagttgaaatgaggacacgaggaactggcttctctctctttcctgcccctccttggagccctggtgctggctgctgcattactcagccatctgcatgagggttgcctgggtggcgatctctggaatcacaacattctggggtgacgttcccaactaaaaataattcctaagcctgggcatttggcactctagtgcagatccaaagaggcaactccttcagtctctgaccttgaaatgagattccccccaacccaccccccacccccccgcaagagcaagaatgagcagctcttcggctccttcagccagggagcaaacaagaagtggcctctgaaagatcctaaaaccatcctaacataaaaatgcccccattctctttatgtgaactgcgtggctaaaactatcctaacataaaaatgcccccattctctttatgtgagctgcgtggccggtcagccacttttcctggactgtgtggagcaggaagcagctgcccttctcaccaacctcccgcttctcacctcattcaatgcttacaaggagggactcactggatttgaatgaatgacaggagggactttcattccagttgccttgctgttcagtctggcacgtcacatgccaggtggtacagcagagtgacttggcaggctctggaaacacactgcaggaggttcgtgagttcatgtcccgctacagacgttgggattcaggacacttctctaggcctcagttttcccaactgaaaatgaggataatgaccactcatgaatgagttaccgcagatgaagcactcagcactgagattttccagaggtatcaagggcccttcttttttattccctagtgaaacacgttgcctgctcccttataagaaagtatcattgaaaagggttttaagatgcctgacttgaatcacattcgtgagattctacatgtgcacggggctatcctctgctgctggcatcacgataggttgttcacatttattatttctacttttcataacaacccagctggccaaaagtaccactatttttatgagtggtaagctggaacttagccctgtttagggccccctgttttcctctaccctgctgcctcccgtgttccccaccatgctgagggtgtatgggcatcctggatgtgcgtgatatgtaaggcacgtggtgctggtgagacgtaggcattcccgggcgatggtctacagcgcctgcttcactcccaagtgtttactgatgcagctggaaacaagacagaggaaactcctctcagagaggctacatcacagtggacatagatggacagtaaacaattaaataagttagatacacagcatgccaagccatggtaaatgcatggagaaaatcaatcagggaggcaaacggggagttctgcatgggctgggctggaagagggatgatttgtgaattttaaacaagatgaccacttctgaattcttctctgaggtaaccataacctactggtgaactctaaacagtgtatgggctgtgagaggtgctggccagcgaatctgaactgggggctctgaggggaaaagcagttttgcagccatgacctagagccacactctttcatatggttgccaccagccatctgtggctatttaaagtatttaaagttacataaaattaaaatttcagtactttagtcatacccctcagtggccacatgtactggatggtgcatgtctggaacattccatccttgtagaacattctgcgggacagcgccattctcaagtaaagacgtggcatatggcagtccgtgagtgggaggcatggcactgtagttttgggatgtggtgtaggtttggtgataatggggtcaaggcagtgatcttgaaggaagcggttatagctccaggaggtatgtgaagcagctacctttggcaaaacactcataatacaaaagagcacacagatatacatcttcaggcaaaactttaattcagtcaacctgacttaaaatcaccatactccttccttctcctcagcttcatcatccccatcactacattatcaatatcatcatacatctgccaccaacctcctttgattactttttttcctgtgataatgtataatgcaacaggatgggttttgcttgtaagtataaaatcaacaggttctcttaggtttaaaaaattacacaaatgcccaaacccttgtgggctttaggtaattctttaggtacttctctcaataattaatcagtagaactaatagaaactgatagaaaataagcaactcatggaacaattatcagtttcataataacccaagatagttcattaagaactagaaaaaaggctgtagcataatgttcaaaagtaaaatattagtaaatgtgatgcatgatacttgggtggatcttgtgtcaaaagaaaaaagtcaactgtgaaagatattcttaggacaaagaaaaaaatttgaatatggaccaaagacgtagacaatagtattgtgagctgggcatggtggcgtatacctgtaatcccagcactttgggaggtcaaagtgggattgtttgagcccaggagtttgaaaccagcctgggcaacatggtgaaaccccatctctacaaaaaatacaaaaattagctgggtgtggtggcatgtgcctgtaattccagctacttgggaggctgtgttgagagtccaggagttcaaggctacataagccatgatctcaccactgcactccagtctggatgacagagtgatacctgtgtaaaaaaataataataattagtattctatcaatgttaatttcctgagtgtgataattatataattatctcatttaataggagagaaatgctaaagcattcaagggttcagtgtcatgatgcttgtaattaactctcagatgcttcctcaaaaaaaaaatcacatatatgtatatataatacaaatatggcaaaacagtaacaattggtaaatctaggtaaggatatgtagacgtccacttgattattttttgcaagttttctgtatgttgagtatttaataagttggagagaaactaaaggattttttaaaaatgaagtaatatgagaaactctctactacagttaccatgtttataagcctttcagaagaactagtagataaatagtttattttacatatttgaattaccactgaaaatttttttctccctttcaaaacattggtcccagcttattaaaaggattacgctttgcacttgaatttaaagccaaatttctccaagcgcttttgcataaagatttgttaatgaaatcttaacttttgggataaaaccttagcatgtcagaatcagactcttgggcatctcaagtgcaaattccttacactccttatgagtttggtcatccctctttggcggagtcagttacatttctacagaggatttcaaggagaaatgttaagatactcacgcacgctgaggggcctccagcagccacgtgccctgcctcttagggccactctgggtcacagaggacaggagaaagaaacttgggtcatggtgcaaaggagaatgaagaaaacttaccagtcattttggatcagagagagagaaaaaaaggaaacctctcccttctgttcacatcaattaggactctttgcaataagtgacagaaaaactcaacaccagatgaagcaagaaagggaactgaatgactaaactactgaaatgtccagaggaggacaggcagattccactgctcagtgtcacaagacttggtgtttttttccctctcagctctgcctcttcctgtgggctctaacttcaggcccttctctcaggggagcaaaatggctgccaaggccccagcccttatccttttactgtaaaccagtgaggagaagcaaagggctgtttcccagaagtcccaggagatacttcattgggtctcaaggtgtcacatgtccacccctgagccaattagagtgagggaggaaatgagtgtgtgcctggatgccgagacacaccctcacctactccatgacctggtgccctgaggacgggatcacagtggggccccgaatgactgctagcagaagtggggtgcatgactctgggtttccattacttcctggaaaccattagataacttaatggagcgtgcaacttagggtagaaaagagggttttaaggtggaaggagaagaagaaacatcttactcttttgaaacactgtgaatctgcaaaagacaaaacattcctttcttttgcatagaaatattttttgtttctgagcttaatggcactcggaattggattgagaatgttgtatctttccctatacgccattggaacagaaaattctctcacatttctggagtggctccccaccctgagccctgccctcctgtacccgccaggaactcctgagggtgccttctggctggaacagcagcttcctggaatggaaaagtctaagtgtggaactctgggctgtctgccctcaccactgtcagcaccattgcacggagggctaagcagcggaccactgcactagggatgtacaagaagagtccgggggtgcctgaggctggttttcccagaagcagacactgagattaagatctgagtgcaagggatgttttaggcactgatgctgggaagcactgggaggggcgtggatgtgaaacagagaagagaaggaagtcgatgcacagggtgctttacagacgttatcgctgtgggcagtagtggctcaaccccactggaagcctctagaggaaagttaggacacacgtcagactcaggtcccgcgtgtgagtcaggctccctgggcccttcaatggagaagtgccgctgcatctgtgagaagccactactgtgcaagcttccagtgggtgccacggcgggcgatgggtgcaactcagccatgtccaggagaggagcatcccaggcacttgttggaagcatcattctagggatgctgttgcctgaggagccaaacaaagaggtgattgtatccagggaaacaggacagactctcaggtcccctgggaggtgagaacatcttctttctcaggcccagatgtcacataactcacaaaaagccaaatgatggattacaaactgtaggagggctggacacacaggattagctactggggctcccctcactagccggggcagaagatggcagcactgcccagctttgcattttgaggaacccctgctcacacatcgtggaggaatctgaatgacaatctgagcaaaagcctgaatatattcactttcttgctgaacagggttacagaggagacttgtagcaatgaaataaaagggcaactacaggtggaaagtgagctaagggtcatgagtcctcatgcactccaggcaccaaagccgatttggtaaaagaacactgggccctcaacaggcaaatgaagaagctggtcatcttcagagtggaaatgctaaggctctcgcaccaagacaaatagactgagtctgaatctcacctgtactagccatgcatctttgggcatgtgattcaacctctttaagcttttagtttctcatcagcaaagttgggatgtaaaatgtaagtctgtcttgagggttagatgggatggtagatggcatgtgtaaagtgccctcgttatgggaactcagtgactgagaggcatctgtggggccagccctgctgtcattaggtatgaatatcattacaaaggctacaactggttaccttacatgctatttctataagaaggccagggaaaagaaagaacaaacacacaaaaaatagacacaagaggagaaactaagatcccctagggagatagttgactttggcaagctattaatatagtgaagttattaatgcatgtggagtgtgtccattttcttggcatctattcagtttcctattttctctagagggatgctaagtggacagggtgggaaaggaataggaaggccaagaaaaagctattatgggtgaccctttcccactcacccagaagaacttcaggaatggtccaggcttgaatcagcaactagctcagcaggtcttccatgtgagcctctttggctgaagccacagacatcctgactttgtgctcaaaatagagcactgattcagaaggcgtcttcataagagactgaaatgaaacagcaaattgtgctgtcacaaatgacgaaggagggttttaaaggactgttttagggggcgcttctttctcccctttgaaggctgaggtcattatctgcactgtgggcatgtgggctcagagcctgtgtttccgtggcactgtgggttggcagcttattcatgtggtggtgaagactcatgacttgctgttcttgcccttcattgcagggctcagtggctaaagggctttattgttgctgccatgtaaagccttctgtcctatggaagctccgtgctctggcatcatctatttcaggagcctgtgacagtggcagcgtcataccctaaagctggaacttacagacaaaagcgatgggccagtatcggtcagtgttctaaaagatgagctttgatttgacttaagtgtttcccctccacaacagcatgatagaccaagatacttctgactacatctctctgtggatctgcatctgtcagaggggaacagagtagattgtctacccacctcagaatgctcccagagacaagacagccccagtcccttccctgtaggagtggggagtccaaccattcattggcagaaagagccaagtacacatattcagttcaaactcatagcacatttaaaaacgttcgctcattttgaaatcatttcagatgtacaagagttgcaagaatattacaaacaacccccatagacccttcactcagattcctcagatgttagcattttaccatgtttgtcttatcattctctatacatacatactagttttctgaaccttttgaaagaaagtggcagccaaaacctcctctgctcctaaacagttcaatatgtaattcccaaaaaacaaggacattctttacataatacaagtatcaacatcagaaaatccacattcaaataatattatctaatctccaggacttgttcagatttcaccaattgtcccagtaatgtcttttattttattttattttatttttttttttagacagagtctcgctctgtcacccaggctggagtgcagtggcgctatcttggctcactgcagcctccgcctcccaggttcaagtgattctcctgcctcagcctcccaagtagctgggattaaaggtgcccaccaccacacccggctaactttttgtattttcagtagagacagggtttcaccatgttggccagactggtcttgaactcctgatctcaggtgatccacctgcctcggcctcccaaagtgctgggattaaaggcgtgagccatggcatgcagctcccgtaatgtctttaagagcaaaagaaaaataaattcttgtctgggatccatacattgcatttagttgtcatagctccttagtctcttttgatgtggagcagttcctcagttttaatgagattggtatttttgaggcatacaagctatccacttcataaaatgtccataagttttcatcctaaagaatgaattaatgagaaaatcaccttttggtaacagtcatagttatattgactcagacagctgtcagcggaagacagaactagctggtgaggaggaataggatgttttcatgatctcagtgcagctcctcgcggaatactgatggattacgaagggaaaaatagtcactttacactggtgcaggctggcaggcctcaccttaaccagcggatcacagctggcatcagagatggtggacttcacgtacttcctgatatgatgtgctgagaaaaacatagctttttgcacttctcttgcttcccaccaaaattgcgtatcctgaatctattcatgaagaaacctcaaacctaacacattagaatgttatcacaacatgggaaaaatctggactacaaactttttacaggcaggagacctccgcaacactagcagccttctctaagatgagttcactagacctttgctttcagagcctcagcgaggccttttcaggctctccctgctgggtcaagtctcctactctaaacacaagagggacttgctagcccgccccaattcccagtggtcctcggccttagttccttgttttggaacctctttttcctacagagacttgaagatcattcaacacttccagttttgagacaaagctgtgtccaagcaaggttgtccatgagcctcgactgggcttccctcctggtcctgcacagcccaggagctgctgcctcaaggtcatcttcactgaaccctgcacggtgctggacagccccagctctgaagtgtgggtcaggcctgaacactagccctgcagcctggtcgagtgcccatggctctgtctccattttctcatcggattcatgggaccaaggacgccgatacagtagggctgtggacagcataggtcgatgtcactgtagaatggttatcacggagctcagcatataggcaacgtgcagtcagcgttagcttttggtattacagtcgtcagcgggcttttaagcctatacattctgaagccaaagatttgcctggtgaaagtatttacaagtgagtgacttgcctgggttcaaatcctctctccactatgtcctacctctatgctctttggcaaatgacttagcttcctttatgagataattgcaaggatcaattaaatggtgcctggcacagagtatgagctaggtgagcttcagctattcttcttcttagctccttttttttccccaaaaaaagcttacatttgggtgaaacttctgggtttatgtgcacactccccttgtgatgctgatcctcactagaagaagaaagggatcatcttccattttacagacaagaggactcagggaaatcagggaaattacactacctcagcaaaactacacatttgaaatagcaaagtggggcattaatcctgggtcttgaacacaagcatactgttctttacagctgtcattcttcccccaaatatttgtgaaatgctatgtgccaagtgctgggccaggcgctgcaaacacaaagcccctgagtgggaggaatcaagtgagaagaggagatgggcggggttccagggaggtgagggtgtggcacctgctctaacataatgtgcctctaactcaggcgagggctcagggacagtgatgcttgagacaggtactagagggatttagaataagcagatggagtagctgaaagatgaaggaaatccaggaaaaatagcaatgtgaaggcaaggagggtgaaacaggcagagatatttggaggcacaagtaactgagaatggctggagccacaggtgctggagggggtgctgggtatgggtgaaagcaatctgagtgggcttcctggcaggctggagattcacactgttgcagctctgggcgattgcccacaaggcatcttcagggaggaggttttttttgtttgtttgtttgtttttaatgcttttctcctagagtctcaggatagtcattttagcactcagttttaaatgcttccaccaagcatgctgtaattctatttaattactctccttccttccccatcggagggtcccatcccttgatcagcctccatgtggtgtttggagcatgtgatgggagactggcggcccccacagccaccccagggcctgtgctaagggaacagctggtactgttctcagcagatctcagtggtgacctgcaggaatacaccagcaaaccagggttgacccagagccacaggggacaagctcatgtcacagagcagccaaccaggtgagtgacaaacctacctcttcttgaatacactaagggatggaggtattaggcaggcagagaagttgcatttggatgtgtcactgtgaggtacccatggaaggcccctaaggagatgccccatacgcagctagcagtttgcatctggagctcagaagagaagccaggctggggatggaggttttggtcatcagcacacctgtggaagttcaagtcttgggtgaggtcactcacggaatgagaagagcctgcaatgaaaggtgaggtcttagagaaagccaaaacttcaggatatacaacacctgatttcctttttatactgttttttacaggcctcctcccagccataaccaaaaattactttttcagagagctgcataagtccaatatgctaatatgctaaggagacatgtcttgatttagagctcataacattatcttcctgaccagttactgcgttcgagggctcacaattttttccctttaaatgatagataataatttacatatttatggggcacacgtgagttggttacatgcatagaatatgcacaaggatgaagtcagggtattttgggtgcccatcactttgagtgtttatcatttttgtgtgttgggagcatttttagagcattcaagtcctctcttctagtaactttaaaatgtacacaatattgttgcttaagtatactttcctagtctgctattgtattagtctgttctcatgctgctaataaagacatacccaagactgggtaatttataaaggaaagaggtttaatggactcacagttccacatggctggggaggcctcacaatcatgggggaaggcgaatgagaagcaaagtcacgtcttacatagcggcaggcaagagagcatgtgccagggaactcccctttataaaaccatcagatttcatgaggtttattcactattgcgagaacagcacgggaaagacctgtccccatgattcaattacctcccaccaggtccctctcatgacacgtgggaattatgggaaccacaattcaagatgagatttgggtggggacacagtgaaaccctatcagctatcaaaggatagcttattttttctaactgtatgtttgtacccataaccaacctctttttatccctctccttttgacttttccatttctgatatctatcattttattctccatctccatgaaatcaactttgttagctcccacatgagtgagaccatggagtatttgtatttccgagcctggcttattcctcttaacataatggcctctagttccattcatgtttctgtaaatgacaggacttcattcttttttatggctgaataatattccaccatgtatgtataccacattttctttatccattcatccaatgatgcacacttaggttgattccgtatcttggctattgtcaatagtgctgtgataaacatgtgagtgtaggtatccctttaatatactgatttcttttcctttggataaatacccagtagtgggattgctggatgatacagtagttctatttttacttttttgcgaaacatccatgttgttttccatcgtagctatactaatttacattcccaccaacagagtataagagttcctttttctctgaattgttgccagtatctgttgttttttgtctttttaataatagccattctgactggggtgagataatatctcactgtggttttgatttgcatttccctgatgattagtgatgttgaggagctcacattttaattttgtaaggtcctcctcattctctctgagttccctgtcattctcggtcaatttcagagtatcaggggcaggcatttttgcccgatggtgttttggaaagaggaatagtctctctaaataactatcctgcttcctcttcatttccataccaaagtcccttcacttcacccaccacaacaataaataaattcacagaaacaatggggctaacgaaatgcttcctctcacaggttctaggggcagcatgatctttggacagttttgcttggtggctatatattccaccccagcataatttcttgagagcatatatattacttttcccttagtattccacattagctaactggccgttttagtatggtcctgtaggaacataaacatttagagaatttcttgtaatgacaagtagagataatcggtttgaggccagtgagctagttatgtttaggaaaatcaccatgggatttaagatgatgcattgatgtaatgcaattggtggtttatgaaaattcttttagactaacctcggccgtataagcacaaccacattccttgctagtgaataggaggcagggcccagtggaatcatttttaaagtgttccattacaaacctttcacttctacctctcaagggagaaggggactggagggggagcagggaggacttcacagcgaaattttctgtggaagcctgtttgaagctataagtagtcaaaggaaaaatccagaaatagtttaggaaattagtcatctgtctccaaactgtgttcagttacagttttgggttccactttatgaaatgtaaaaaaaaaaaaaaaaaaaacagaaatctggaaagattaataatcatttgtgtaagggtcaaaaaggtccagtttttgcccagaaagaggaaaaaaagttcccatttgctaaaatattgtcaaaataattcccaggatggaaaattacattctgggaactgggaaacatgttgactttctctacttttactagttttgcaatactaaaatgttgataattaggttatactagatgtctaatgttgcttattttaaagcacgagtacataaattattaagtgcatttttcagtgcacacacacacagacacgaggaagctacccattaatatgtgcctatcctctatttttttttttaagtgagctaaaggagaactaaaatgggtcgggtgcgggggaagtagtattccactatttctatacctattagttcaccaacttactatcatgatcattttaaggcagttattttgctcttcactgttctgttaaaacctgtgttttaaagaataagggagtctagggaaatggaatggaagaattcatacagagcttatttttaaaagaaaagaaaaagtctttgcagccataacgaatcagcactgccagccttggtagggagaggctggggagaaacctgactctttactagaggccatgccaggctttcccggagagtgtttggcttgggtatttctcaggcattgataaaaagcttcttgccatcggagtgaacaggccagagagcgtcttgtacttagactgaagacacttgtaagaagttagagagcggagactctactgagctgacgcagggctgcacggtgtttactacaacccctgcctcagttgggcatgtttggttgcaggtcacagaatatgcaaaagtggttccactttttggaaaagcggttgaagatgctcacacatgcctcagtgcatgcatcaccagggcatctggttaaaatgcaaattctggcccagcaggtctgggtgggaccctggatcctgaattttagccatctccaggtgctattgattctgttggcccaaggaccacgctgggtagcaacagtttaaaaatccagcgctgattgccttctacagcaacatgtctggagactggacagtgcccaggttggtgcagtggctggagccactggccttccattctattcccctagacgctgttattctttaagacatacattttaacagaacatcgaagaacaaaatgactgccttaaaattatcatgatagtaagttggtgtactaataggcatagtaacatgaacgacaaaagtcagcccatcctccctcctgtcagccgcaggcttctgtcttcacagcggcaagggccacatcctcacacacacacttttcccttcttctgtccccccaacccccaagacagtctggtggccaggatggcttcaggcccacacctggcttcacaagaagcgggaaaagcagccatctggaatttccagctcctgtgggaaggggcgccctgtcagcgaagcagtgggcatagggacggaccgtagcagggtggacaccaacagtctctcaccaccatcccccactctgtcctccccaggccccagcaacaagggggaggtgcctccattgtgcacaaacggaaaagcaggttttactacattgaatgcaataaggaaaatcagcaagtaaagtgtatttgagattttttgtttttttttttttttttttttttgagacggagtctctctctgtcgcccagactggagtgcagtggcgcgatctcggctcactgcaagctccgcctcccaggttcacgccattctcctgcctcagcctcccaagtagctgagactacaggcgcccaccactagtgtagtcctttaaaatttgagattttaaaggaaagttctgcttttacctaggcgactgtattacatctaacactacctagcaattggagatgcgttgctgatgtgttctctctgatgatcatcagcatgttatttaatctcttgagattcaccagtctcctctctatcagggagtgaccatatcctcccctctgaattagattacactacatagattgcatgtgaaattatctcgctagaattttatgtaaaagaatcaagctcagtgcatggcacgtgacgggtactcaacaaaaacaaagctgtataatatagtacatagggttattcttgtgtctgtgtgtgtatgtgtgcttatgcacagtatgagaagattgattatatattacatttctactttcagtttttctatgccaattgaaataaatccgtgacaatattacctaggtcatcttaattagtcatgcagttagagatgggaggtctcagtcactccctggcagctatctgaattgctggtagactccaagaagaaatgcaccactttttaacgtactggcctcacaaatccaaactgaaaaagtgactgcaaatatgccagtcaccaccaataataacatagttttactagttgcagggatggaaacatcactgtctaggatgtctgcatccattagttaactgaaccagcttctaatagttttatgcctactcaaggtaatgtgacttggcttaaacaaacatgaatgttaagagttcacaattaaatcatttattcatctatcactaatttgaaaaatactgaaaatatttgttaaccatggtataaaaatatatctaaccaactttaatagttgagtaagcatttgacaccaccattccatacttaaatacctatttaacgtgaagtttgtttctttttgtcttgcacagaactcaaggaagaaacatttttgccagtgagcatatttttagttagtgtgcaactaaatttgtttcttttaaatagaatatttgatcttatttgttcttatgctagacttgtataattatacttgtcaggggcaaacaaataatgtaatgattctgaaatattatttcttaaggaaaataattatacaatgatatttatgtacttgaaagcatgttatcttttaaagttttactgtgggaggccataaacttattcaaatgatgctgaaattgctcaaaatagttttagagtctctctctttggatatgggctcaaaagccaatgcataaattatataaaatttatatcattttgtgaccaatctgaagaactgtagtaacaaaaccaaaataatttaatttggtttgcaaatgctctacaaagtacaattatatttgctctgacttgtgaggttttctaaaaaaatcaaataactgagcatgtattatttttacagtaaattaaataaaagttgggataaaaattctcgaatattatcatatatgacaaaaattgctaagtgaaataatttaagattgtaatgaagggacataaagtaattgtaaaaatagagtttcaaaaaatagtgacttctctgagaggaacttactctgaagtgtgaatataaaaaaaatcaagctggcactttggctaataagagtgcaaaatgctacaactctttgggaggggcatttggcaatttctagcaaaatcacatagacatttatctttcaatcttgcaaacttacttcttggaatttttctttgagataccacatggcagctgcaaatcaattcatgtgtagttattcactgtgccataatttgagatagctaatggtggaagcaatgtaaatgcctaaccacaggaaacaaacacaaggcaagctggggatgctttgctgtgccagaaagcaagaaaaatgctaaaacaaagcaaaaatctcagagggatatgtgagaagaacacaggtgctcactgaaagggactcccaccagccatagttgggacaatttgaacatttaaaaagggcgtaatgggttatattacattaactaaaataaacaaagaaatcttcaagtccttagtaatacatttaaaataggggcaaggcagctcttctttataaagtaatactttttaataaatatcggaggaatgaaggaatttaacaataaaattttgcagtcaccacggtaatgactgatttaggcaagaatcagcagtgcacctaaaatcattggctgaagagttaggcacacaatctcaaagcatcacccacaggttatttttaagtataaagaggaaaaggatacaccttgaagaataaatggaagtcagaattgcccaatcatgggacacactaatgatgtaaaggaagcagactacagtgccaggtagttttcttgtcaaagctgtttaaacttcatcttgctaacttaagatatataaatttaggaaagaagactttatttcttgtaaagggttacagcctgcaaggtggccatcctgcaggctgggaagtgggcctccagcaaagaccagagacaggcactttgaaggaggagaagttggatttggagctcatagtgaatgggttggctaaacctactatttgacagtttacagggaagctatgaatattcccaaacatagacccatgttcatcttgggatagagacttaacatttaaatgtattactgttaggttctatgtgatcagaggtgcagcagagacacgatggcactagtcttcagcctttgcgaaccgaccagagccagtctatggttggtgattttcttatcaggaggaggttactgattcactgccttgtccagtcaaaactgtagtcatggctggtgcagcaggggttcagttagtcagcatctgtgagcccatgagtcataattgttttaatattgcttatctcaagtctagcccttgtttagctgctagagaaaaagaaaaagagaaaccttgtggcagttagaacatagtttactctttaagtgtaggagtgggtgacttcactggcatgaccttaggtcctgtttataatttggtatcttattgccccaaagagcctgttctgtcagtcttctgatctccattttaacgtgaatgctggtcagttgttttgtctaaaccccagacgggggtggggcggggcagcggggagtataacgaggcgtgtctgaccttctgtttcatcatgagtttctctggggttcccttggccaagaggaggttggtttggtcagtcgaagaggggggcttagatttattttttgtttgcaatctaatcaagataaaaaattaagcaaatccagagagtggatgattctacaagtcgacttcaaaaagctaaggtcttgatcagcaaatcactgtgaggggactgaagaagtgtggtagccagctgtcatgtgaggtctttgattgtatcctgaatttataaaacagaaaacagcaatgaagatcattttggtgacaactgaagaaattttaataccatcatattaaatattgaatttttggagttgttaatgattttgtggttaattggaaagtatctttgttcttgagaggtgcacactgaagcggaagtgatgactgcagcttatttcccaatgtgtgtctgcatttatagagagaaaaaaggagcaacaaagtaatgtggcaaaacattaacaatcggtgaatttggagggagagtttatgggtgttcatcgtactattatttctattttcctgcaagttttagatgttttgaaagaaattggggaatattcagctgatgattttacagctacacttgatatattaatctatggaatgtggtaagattggtataaattacattatttttatcatttaaagtagaccctaatatcactggcaggaaccaagagtaggtattgataaaacctgtatacattagaactagttggaaagttactaatcgggctgtagcctcctaatgcagagtttgcacacgatacacactacaatcttttgttaatcagcgaggtctatgttttcaccagtattgttcactcaatactaagtaatttcaattcacttagtatcgtttacatttacaattaagttgttagtatcacttaaatttacaattataatttacacttacaatttacaataatacaattacttagtattgagtaaatactaaggctgaaagagttccacctacaaatgcctcctctatgcggatgccaaatgtggagcctatagttggagaggtgtcagcacctttcaggagcactaattcagaccatggccacagtgactaaattatccaaacctaaatggagcacacatctggctacatgacccaaattttcatctcttatttatttttaatgggccaattttcatattgaaggagaaataaggagaggtctgaaaattggcttcattaaacaattaagctcttaaatcctgacagtgatggaatatttggtgtagagaataacaattttcatagatgatgattccatcataatagagggctgaaattcccaaagaattccaagtgaggcctccaatacagcatgcgattgcccatggagaatgttattctcatctgcaatttgttagtgcttttcatcaacacataattatttcagctaataaaccagctaagtatgctctaatgaaaagtatcccaaagagagagaaagggaattactaaggtaaagaaagccctcaagcttctaagtatacaaaattacacctagttgtttattgagaatgtcaataaaacccgctcctaagcatgtggtgcactattcctaggtgtacatcactcaaactatgttcgagaactgatctttcctctttcaggttatcgtggaaaagagccagggtgcaggtgtttcatgtttatccacaactctactgtttcctaggagccctgacatctttatgagtctttaaaaaaagttctcctcctcactccagtcccctgtgctttatcaacaacaaatgactctctcccgtttttacaaggggccatccactctcctgcgttcttctcatacttcttcgttccctctaccatacctaattatcagtgcttttgaagacccaaagcccctttttatagtagagtgccttcacatcagggaggaatatcagctgactttttaatagtgcaaaatgcaaatcataagccctccttacactctcatatggcgctccggcttgcttgcgaagattggcacaatcccatcactgatcaatactgatgttcccggtgagtcatctttctgtataagaaaccacactgagacttggtggcttcaacatcaacaaccatcgatttgttcatgattgcgcaatttgggcagggcttgcggggacagcttgtctcttttctgtgtgccattagtggggcagctcaaatgtggctgcatcatccatgtccacatggcctcctcatgaggctggccttctggtgctggcagttggtgagggactctgccaggggtattgacaagggggcttcagctttcctctgtgtggcctccccatgtggctagggtgggcttctcacagcatggcagtctcagaataatgaggctttttatatggctgctggcttccccccagaaccgaaaaagtggaagcctccagccttcttaaggtttaggcctggacctggcaaagcgtcacttccaccacgttcttctggttaaggtgaatcacaagagaccagattcaaggggaggaatgacacgaggatgtgaataccagcaggtgacatttattgggggccatcaatgtgtcaaattaccacatcattcgactcatcaagaaaagattgaattcagaccaacacattgtgtgagaaatgtgtatgatcactacaaagttttgcatttaaaatgctaacatttaaaaaataacatgtactgtttcaggggtagtgttttcaggtcccgtatggagacatgaagtaactgcttcctcattgattctggatgctgagtcatggctgtccatgcctcatgctgcagacgcagtttcaggcttgtcactttgggtctgactagtcaacaagtacagtgggcaggtgtgggggtccctactctccacccaggctgagggtcagggtcagacaagctttgatgatagagaacagatgagggcagtgagaccaatgtgctggaagaagggaggccccagtgacgcacaccagtaatggctggagaaaaccaaaaagaccagtctgcaagggaatgaaaggggaaggaggtcacgtcagcagcagagtagaagcagctgtttctgtttcttgccttccaccaacaaagagagagctatggatcttcctttcaaatcaccgcagctccgttccttcttctgtttgaagggaggatttaggctcatgtaagaaggctgggagaattctggtgtccaggatgttgaactggcatgttgaagggaagagttggggttattggccaatgtgcccaaagggatggctccaccccctcgccaaagccacactaggaataagatggccatgcattttactcctggatgtcttaggcccctgagtactgcatgaaggaatatgcactccaatttgattttgagtcctgtagggccctcttttctaggattcccaatgaatgtaacaatgtagcactggcacctttacctcctcccctcgatgagtcagcaggtgaagctggtaaacactatctgccaaaggatttcatgttgcttccaggtttgaaatcttgtctcactgatacagttctattgtatgtatgctaaaatgttagactagccaggatggttcaataacttatggggagagtgagctgaaatatttgattttatttttattttatttttctgaggcaggttctcactctgttgcccaggctggagtgcagtgatgtgatcatagctcactgcagcctcagtctccctggctcaagtgatcctcctgcctcagcctcccaagtagatgtgactacaggtgtgtaccaccacacctggctaatttttaaaatttatttttcatagagatggggctgcgctgtgttgcgcaggctagtctcaaactcctgggctcaagtgatcctcccaccttggcctcccaaagtgccaggattacgggagagagccatgagtcccagcctggactattttaaataaaggcaatatttaggaagtccggcctaggggattggacccaggggctagcccaggagtgtagaatgacttaaacaatagtgaatatgaaggaacgtattatcagtcctggagaaaacagtgatgggaatgaatttctgtgggtgtaggaagctgggtgactgagtgctgtcatctgtaggcaggcatgtcctgctctgtaggtgagtcccctcttctgatatacaggtgcttcataccaaccacagctaccgtctcctgctgatgaggacagacaggaagggaagcatctggagggactgatcctgcttctttggttaaactctgacagatacattcaaaaataaaaaagacattgcagaaaatttatctccagcagaactgtgctacaagaaataccagaagtcctttttttttttttttttttgagacagagtcttgctctgtcgcccaggctggagtgcagtggctcgatctcggctcactgcaagctccgcctcccgggttcacgccattcttctgcctcagcttcccgagtagctgggactacaggcgcccgccaccatgcctggctaattttttgtatttttagtagagacggggtttcaccatgttagccaggatggtctcgatctcctgaccgcgtgatccgcccgccttggcctcccaaagtgctgggattacaggcgtgagccaccgtgcccggcctagaagttcttctttaacctgaagggaaatgacacagctggaatccagaaattatttcctctagaaaacggaggaagagggaatacttcaggagcaagagggaattacttcatttatgagatcaacataaccttgatacaaaaatgaaaccaagacattgcaataaaagaaaatcgcagacattagtatccctcatgaacatagacatgaaaatccttgacaaaaatcttagcaaaccaaaatgcacacatttataaaagggtgacatatcctgatttaataggggttatcccaggaattcatggatggtattgaatgaatttaacattcaaaaactcaatcaatataatttaccagattttcaacagttaaatatattttagaagttaaatataatcatcccagtagatgcagtgaaagtatttggcaaaattcaacatatattcatgataaaaactctccacaaactaggaatgtattgtagattagttgcagaattaggaaaagtaaacttacacacagaccagatgcaacatttcaagtatctaaaaattgaggggggtgggaaggaagcttaaaagtcacatagtctttatccttgcgtttgagagcctcccagcaaccttgaggcaaactatcatattcatataaaagttcaaggacccacaactctaaagagagatttcaaatcctcaaagcatgctcagctaatagctgttgagttaattaggaggactaagattagaatattaaatctttgaagaaaatgtaatggtatggtttaattcagagaagaggttgaggagtaagcttataacacttttcaaagctgaaatgagctaagcacttggatcagtgttccccaaatgaaaggatgaaaggattcacctggaacccttgtttaaggatcacacgcccaggtctctactctgcagactgggattttgaggtggggcaactgttcctgttgaattgtcattatcggctaagtctgagaaactctagatttagatgcaccaaaaaatgcctatggcagtaatgtccctgtgaaagtgtttaagataggtatgtttgttttatcattaagtacaatatttgggtttagttttgatagatactctttattggccggacacggtggctcatgcctttaaatcccagcagtttgggaggccaaagtaggtggattgcttgagctcaggacctcaaggccagcctgggcaacatggtgaaaccccgtctctaaaaagaaaagaaaagaaaagaaaaaatgtagctgggtatgtgagtaagatatgtgagtcttagtagttgtctgaaaatgttccattgccacctttcaggtaggatcaagcatcagagtctcaaaggcagtattaccagtatggaaaaaaaatcccatagacagtaacagagctctttcttagcaatgccgtgtttccaaccctcctgatgtcacagaagatgagaatgtttggaaaaacatgaacattgatggctctgagtcttgaagaaatcccaaagcatgcacctataatcccagctacttgggggctgaggtgagaggatcacttgagcccgggaggtcgaggctgcagtgagccgtgtttgcaccactgcgctctagcctgggcaacgaagtgagactttgtctcaaaaaaaaaaaaaaaaaaaaaaaaaaaaaaaaaaaaccaacaacaaagaaaacctatttattaagggaatttccatgcattcctgttgtactaaaatattgctttcgaaaaagaaaatcaagacgttgaattatgtataatgcctcttagtttccatagatatgttttttctaattttataataaaggaatacaataaattatattttagaaattttcaaggttgagccatcctagaataaattgacttgatcttgatttattctacttttagtaaacatgtaagatttgataatatatatgtaagatctttgcaatactagccataaagtgggatcatttgatcattttcctccagaaaatggaggaagagggaatacttcaagaggaagagggaatgacttcatctgtgagatcaacataaccttgatataaaaatgaaaccaagacattgcaagaaaagaaaatcacagacatcagtatccctcatgaacatagacatgaaaatccttgacaaaaatcttagcaaaccatctgtgccatcttcctcaggttcagtaatcagagctatggaggctaccataaaaaagaaaaattcccaatttttttcctatgcacaatcataagaaaagatcctttaagtttactagaacacaaattttaggggctagggttatggttagaacacgttgcttaggatgtttagaagcagacatgtgatgcctctccatgttttctgtgctgctctatctggtcaggtttttttctaagtttagtaactatgatgaccaaaagaggagtagtggctgtgacccttcttaacatcgaggagacctatggtaatatttctacccacaaatgacattgtgcattaaaagatttcatctaccaaaccgattgctttcattaaggaaaaacaaataaattcctccactttattaatgatatctgagtacacaaaactcagtagcaacagaaatgataacccacagcagtaagcaagtataaaaataggcagtaaactggctaaaccccaggctcatgaaaagaaacagaccattctagttagcctctgcagacttattatttataaatgttttgtttccattaagctttaggaaagattgaaaataactcccaggctgctaaaattactattgttgcactttcaaggatcaaaagactccatgttgaggaaatttcacaattctattctgataaaaacagaggcgaaatgtaaagtagcaacgggcttcctgggagaactctctcccacggttttaataggctggttaggatgtgctcgacagctacctggctggctggagacatgcttcccacaggctaaccaagtgcatacagtgaaggtggatggtggtgtctgttcatctcggaagagcccaggatcaaactatcactccctagtcaccctgtggtctctgccatgtttccacagatctctaaagttgcttaaccctgatttatgcagtgctgaacatctctttcagcgttagaactgaatattaccacctctgatgatttctcaaggaagcagtagatatgacagtaactgtcattgagatggtgaggcaaaggtgggggtgaggagtgtgggaagaaaattccatggtcctcactggctggggaatagtggctgcagtgaccacctgtctgtggctacccaaaagcacaagtgagatttgagcatcctctctcagtggtttttcatggccagtatttctccaaccttaatgcccatagaaaccatctgagggtcttgtgaaaagacagttctgattcagtaggcctggagcaggacccgagactgcatttctaataagctgctgaagctgctggtctgtagtccactgtgtgagaagcaaggctctagtccgcatagggctccaaccagcccgattcctgaaatttggaggagcccaatgggaggcagaagcaagccttaggaaaagcaaagtccctccactgaatttcaaaagccaacatgaaagagacaaaatggactggcctcttcctgtcaaggcagaaatctcagcaatgaattctcagatgcaggcctcaagaggccttcttcagctggatgagttgactcattcctgtatctcagcactttgggaggccaaggcaggaggatcacttgagcccaagagtttgagaccaggctgagcaacacagggagaccccatttttctaccaaaaaaaattttttttaattagttgggcatagtggcatgtgcctgtggtcccagctagtcaggaggctgaggcaggaggatcccttgagcttaggaggtcaaggctgcaatgaactatgattgtgccactgcaccctagcctgggcaatagggcaagactctggaagcaaaaaaaaaaaaggccttcattgatcattgccaccagaagtttacctgccctgaggagtcaactttgaatccctcactgattttgcatatttgttttttattttattaatatctgttctcaccttcactgtttccttctttttatgttctttgggttgatttttattttattaatttcgttttttcttctatcctacctagtacagcgctttcatttaagactaaaattttttctcttaagttcatttaaaaatactttccaactgccattatgatttcttatttgacttgttggttatttagaatcataattctcatgttaaaatattaagggttttccagttatctttttgttatagacttctatcatagattatgatcagacagcacactctggaattatacggtcctttcaaatgtgttgagacttactctcaggtgcacaaggtgggaaatttctgtcaatgttccatgtgtgcatgaaaatattttatattctggagtattttactctatttcaatgattttaagacacatgcaaaatttgggacacattttataatcacagaggaacaaacgaccacctgtgacgttgtcattgcctgtgcacatatgaatgtctacatgtatggtgtatgacacagcaactgcaacctcttcaccttctagttgtcagatcgtttaaggaccatttgaggaagatatgtgagtcttagtagttgtctgaaaatgttccattgccacttttcaggtaggatcaagcatcagagtcttaaagtcagtattaccggtttgggaaaaaaaccccatagacagtaacagagctctttcttagcaatgccgtgtttccaaccctcctgatgtcaaagaggatgagaatgtttggaaaaacatgaacattgatggctctgagtcttgaagaaatcccaaagcaaataattctcaaagacatttcagaaatagctaatacaatttatttctcttatattcccctttaaaaatatgcacaagaacaacataattaaatataaaggagcttcctcaatcagtgtggtctaacaatgtcaagtgatgagaaatcattgtgtctcagttaacatggttctcttttttcttagtgcctcataaaataatagtgtgtcttccagtcaaggacttcttagattcaaggaactatgtcatatctgtctgtaggtcaagtttgtggatcatgttgattaaatattctttcctctggattttttggttgtcattattctgtcaattaccgcaaaatatatagtaaaatctcctactgtggttgtgaattactgtggctctatgaggttatgtggttctatcaatttttgctttaagtattttgaggctgcgggtccagttacgtagtgattctcattgtctctaattgtgtgtttttccctcaaagtatacattgtatttgcctggtattagtacagctataccaattttattttgtttaatgataactggatttcttttttcatcctttatttcaacccttctgtctccttagatttacaatatatctgtcattttgttccacctgttctgggttcttttccattgttttcttatctcattcatattgaaagagtcttttgttaggctgggcatggtggctcacgcctgtaatcccagcacttttggagaccaaggcgggaggatcacctgaggtcaggagttcaataccagcctggccaacatggcgaaaacctgtctctactaaaaatacaaaaattacctgggcgtggtggcacctgtaatctcagctactcaggaggctgaggcagggagaattgcttgaacccgggaggctgaggttgcagtgagcgaagatcgctccactgcactccagcctgggtgacagagcaagactctgtctaaaaaacgaaaagaatcttttgttttattttgccatcacgtaatacatctatgtaaaacaatctttttatttcgtttttctctgttttagtttgaaagttatacactctttttctcttctattaatggttattttggaaatgacagaatacatcttggacttacctagatctaatatcaactgttactctttcccttctcccagccagtgcaagaagcccaggacatttatctccatttatcccctccattcttttttttaaagttctggggtacatgtgcaggatgtataggtttgttatataggtaaatgtgtgccatggtggtttgctgcacctatcaacccatcacctaggtattaaacctgtcatgcattagctatttttcctgatgctctgccccccaacaggccctgtgtgtgttgttccgctcaacatcactgatcattagaggattgcaagtcaaaaccacaatgagataccttctcacaccagtcagaatggcgatcattagaaagtcaagaaacaacagatgctggtgaagttgcagagaaataggaacacttttacaatgttgttaggagtgtaaattagttcaaccattgtggaaggcagtgtggcgattcctcaaagatttagaaccagaaataccatttgacccaacaatcccattactgggtatctacccaaaggaatatacatcattctattataaagatacatgcacatgtatgttcactgcaacactgttcacaatagcaaagacatagaatcaacccaaatgcccatcagtgatagactggataaagaaaatgtggtacatatgcacaatggaatactatgcagccataaaaaaggaacaagatcatgttcaaaaatataggcactgcggtgagacccacataggctggggtggatcagcccctgcctacctggcaatgaagacccaatgactcgtggtaggtagagcacagacagcgctgcataggaaatggtgcaggcattaaagcttccattggtggtgtcctggagagaggaagtgcattaactcgtgtgatatgccaagggtttgggaaaagtgggggaaatactaaccataacgaaaaggggattggttggctattgctaaacttgattgacctttgggaaagaaaataaaaaagctgggataatcaattagcaactaacagctaagaatgaatgcagaagccttctttggtcatgaatagagaaattctcacctcctgcactgaaaaggaagggagggttgagtgccagggtcagacctcccttgagagtggcagagctccaaatgaggtggattcccaccaaggtgacactgttatgtcaaggtgaggccatggctgggaaagaacgggacccagcatagaggatggggacatctggattaatgcttcctaaaatatcaaatctccagattcccctgaacctctgagcttgcacacaggaacctcggtcctgcctaccctttgttgaagatgacttagggtcctctcctcccgatacctgtgccttcctcaggatctgcctctacctcccttcctggataccagaccagtaagtaggttaaatcacaacacaaaccagcctggaactgttgggcctgaaaggggaggaaggcaactgtaccctaaagaaaccagaggatctagcagcagatgctgcctggagctataagaatgcacctatataaggaattggagggtgcttggtcaagggagccagagcagaaggttgaataagagacggttatttgagttagttatttccccaataactctctttttatgtctaatctcttggcatctgcttcttagaagacccaaactcaacacagaactgcgtcaaagttccacttcttcctctgccacccatgctggtcccctccccttccatggttgttaatcccaagagcactcctcctaagtcttgaagctcatctccatcctgggtctatttcctggggagccagcatcggacggctgcactgcaaaggcctttgtttctgtactgtctggactgtctccatcctgctttctcattctttcctaagctttcacagcttactttaaatcttcttctgttatattattgtctcttctttgatgtcttacagatctcctctgagttcttacttcactgtgattatgcttcctttgatttccgtgagttcatggagaaatgttaattcacattttcttttacttctgatgtatattattcctctgtctttgtttgttgtcattgttctctttttggggaattattgttcatgttaatgaggatttgctaagagctgtgtggggaagggacagattgaggtggggcggtctcctgaactcaggggttctggaaggactttctcatggatgcagtgtcctctgtgcaaggacccagtgtctgctcactaatctcaatgggccattccaaggaaagcaggcccatgtggtttgtagcaaagcctggatgttcgagtatatttggggtaatagagcagctcatactaagctgactgccacatgctttgcagaaattctaggcatcttgatgatctcccccccgcctggctcatccaaaatgccaggtgtggacaccctagccaggacccttgattgcaccccttagggctgtgctacccttttatgggaaactgtcagctggaaatgacctgtggggttgcatatgcttcttggtgttatgtcccagtgtgatccaaaatgtattgtcttttgcagttattatttttaacctatggttttgcatgtattttcaaggaaattggtttcttctctattgctcattctttttgtcattttcagttggccattggggaaggaagtgaatctggattagaattctaaaataattttttttttctttgagacaggatctcactctgtcacccaggctagagtgcagtggtgcattcttggctcactgcaacctctgcatccagggctcaagcaatcctccaacctcagtctccaaagtagctggaaccaaaagtgtgcaccaccatgctgggctaattttttttttttttttgtatttttggtagagacaagttttcgccacattgtccaagctggtcttgaactcctgagctcaagtgatccactcgcctcggcctcccaaagtgctggaattacaggtatgagccaccgtgcccagcctacatcttattcttttaaaaaaatccaatttaacaccttaaccacatagctgtatatttaaaatatgttaattagtaagatattagcaacccaaatcacaagagatacagaataaagagaaaggtactgaaagcatgaaaaaaaggtacttaaagcatttaaacacagacatcattttttaaatcatgagttagaaaattagatatgaaaaagaaaaaaaggttagtttgggattgcttcagagacacaaaactagttaaaaacacactggtcccagctatgttcatagtgttctccattgctcataaaaactgccttcaagaagtggtgatgatgtagttctgggggagaagcagccgatgcaatggtaagcagactcccccacgtatgaagtcatctgcattgcgtggctggatgaacatctgccacataaactctgcgttggttgcagtgtgccacaaaaacattctttgtttctctctgaccccagctctcattttgtgaggtgaagattggttgacataatgagaactttctgaagtcatttcactgaggacatttaatacaacttctttgcaagcgatgtcatagacttcagtgtctttgtctggcatgtgctgttgctgcaacatgattcacagtggatggcgggggaggagctgcaggcggcagagagtaatcaagcactcatttacgcgcctccttcctttcgtcttatcaagcagctaaatgccagctcagaatcagcccacgccacagtcgttttctggactttcactattaaaatgtccacttacataggaagaaaaaagacagtgactcaaatcagactcaatgcctggtttataaattaagaaacagctattttggccccccaaaagaaaactacttctcttttctcttttttcagaaatgcaaactatgagttttatgaaaactacaatttcattttatgaaagggtagtcaattccattacgtctttcaaacccattggcaaaacgtgtaaaaagaattggggttaaagtgggaaaaatcttacccagttctggattttaaagcaatcacaaattagtacaatgtgaactaaagaagagcccaaagcttttggttctaaggaattagagaatctttctgtttccactaaagtgaaagcatgttccaatgatgaacctccagctgcataggtgacagtctttccttattcaatccctgaatttaccttacatagtaggtggacggccacccaaagatatcaggtcctagtccctggaaccagtaaatgttaccttataaagaaaaagggtcttggcagatgtggttaagaatcttgacatgaggaggttatcctggattatctggatgggctgtaaatgccatcacaagtgtcggtaaaagacggggagatgacacacgcagaagagaaggccatgtgaagacagaggtggagactgcagtgatctggccacaagcaaaggaatgcaagcagcactgcaaattggcagggaaaccttgatttcagcctactgaaactgatactgaacttctgacctcctgaactgtgagagaatacatttctgtttttttttgttttttttttttgaaatggagcttcactctgtcacccaggctggagtgcagtggcgcaatctcagctcactgcaacctctgcctccccagttcaagtgattctcctgcctcagcctcctgagtagctgggattacagatgcccgccaccatgctgggctaatttttgtatttttagtagagaccgatttcaccatgttggccaggctggtcttgaactcctgacctcaagtgatcagccagcctcagcctcccgaagtgctgggattacaggcatgagccaccgtgcccagcccatttctgttgccttaagccaccaggtttgtggtaatttgccatggtaacagcaggacattaatacacctatttctatggaaatatggcatggctttattcaatcctctcttatcacttaattaaatcatggatatcccaaaaattgaagtataaaacttaaatcaagtatttcctagaatttgccgatttaacgttgaaaattttcttttgccaagtgcatgtaaaaaccagcctgggatgatattgtgccagtgtcagtttcctggtttgatcatgtactcgagttatgcaagttgccgccattggaggacgctgggaaagtgtacccaggccttttctgttctgctttttgatcttcttatgagtctatactcatttcaaaataagaagttaaaataaaacccttttctttggcctgtcttttgtttcttcaccttttatattggacaatgattgattgctggtagcttcagagttgagctgtgaaaaatgaaacagttcatttgcttttcaagaaaaaattattcacaccagtggtttataaagtgctagaagatttcatattcaagtttcccagaaacaaaagtagagagtgaacagatagaggatgctggctgctgtgcaagcacgtgccaggcatggggcacaatgtgcccactctgcgctcttaccagctctgatagtgtggtggttaatcaggctgttgttcaaagctggaagctggtgaggaagaaggaagcaagtcccactgagaggtgaagccagctggacttcctgggtggagtggggacttggagatcttttctgtcttacaagaggattgtaaaatgcaccaatctgcactctgtaaaaatgcaccaatcagcgctctgtagctagctagaggtttgtaaaatgcaccaatcagcgttctgtaaaatggaccaatcagcactctgtaaaatggaccaatcagcactgtgtaaaatggacaagtcagcaggacatgggcagggacaaataagggaataaaagctggccaccccagccagcagcaaccagctgcgggaccgttcagttcctcttccactggttgtggaagctttgttcttttgctcttcacaataaatcttgctgctgctcactctttgggtctgtgccatctttaaaagctgtaacacttactatgaaggtccacggctgagaccatgaacccaccaggaaggaaccaactccggaccaccacttcaaggtgtccaggccttcctgtctaggatgacaagcgcccttcctgggagtgacagtgaaaaggcctagggagatgatcatcagagccttcagggggagaggtgtttctttcctacaccagatactagctagataacaaaagaaattctagtactgccagttcccaagagcacaataaatcaaacagtggtattcctgaactttacaggggtcaggtatacatgaaaataatttattgtcccttttctttttgccttccaactttgcctgtgttcatccaagaagcccagtgtctgtgtgaccccttagaatttagacagacagacgtatttggagagatccttgcatcctaggcaccaggtgccattaagtaactcaatgtttcttttcatggtacattttcagttactatgttcattcattcaacaagtatttgccatattccaggcacagttttgggttttcagcacctgggatacatcagtgaacaaaactgacaaagaatcctgccctttggagcatatattcaagtagagagaaacaaacaaaaatagtaagcttaagaaataagaattacagtttaatacaagatagaaagagaagggaatattgaaaagacaagatttgaacagactttaaagatggtgaatgagtgaatgtgagtatctaggaggcacagggcaaatagaaaagccagcggaatggcctgcagaagggagcgtgttcaagaaagagcagagactcaggatctgaagcctgcgagaggggatgggatcctttgcgtaagtggaaaaactggttctaggtagaagcactagttctcaagctttaaggcacatcagaaaaacatggggggcttgttaaagtacagattcctgggggcagcgcttccacagtgctggggtcaggagcttagcaagtcctttctctgagaagaaacaatgcaactgaaaaaaaattatttaaaaaaacccaccatttcaagactctaagaatcaaccaaaggcattccacaaattaagaaaggttgagtgagaaaactgcgggatctcaggtagttgtggctcttttttgggggctggttccacccccactgcctgctctgtcagtgaagtatttcatcagggaatgaaaaccataagctttgctaccagagggtgataacttgatttggagtggagagtaggaagaactccattctcctggatgttattggaaacaatagtaagcccagtggcaaaggaacagggaagaagaacactgcagtcagcccgaggcttgattccggtagagaccagctgacctgcaggctagccagaaatttaaccaggaaatcaagggaatgagacagccatagtggaccttggtaagctcccacatttctgtcggtttaaggctgtgcatacgtgcaaggctgtgtgcacattcagaagagaccagagaggaccccagcaatccacacatctctggcttaacctgaggctatacatacccagaaagaggtacaacagggctgggtgaaaagtaagagccgggacaaattgataaatgagctgaactttaaatgagtttcccagccacaaacagagctattggcacagaaaagaagccttagtcgtttaaggtgtttgatcataatccctgaccatcactggctaacttgtcaggcatactgatacaaagtgacccatggatgccagccatataagtgaaaagaataaaaatagaaggaaagaaggaagggaggaaggaaggaaggaaaaaaacaggagggagggaggaaggacagaaggaaggatggaaggaagaaaggaaagaaggagaaaggaaaggaagaaaagaaaggaagaaaggaaagaagaaagaaagggaaggaaggagaggaaggaagggagaaaagaaagaaagagaaagaaaggaaagaaagagaaacaaaagaaatagggacatcaacaaagatacaccacagaattagtttaggcaaattatcaaaacagacaagcaaaaaaagagtaacaacaacaacccttgaggtggcgtgggggagaatcaaaatttctataatatattatctaagatgtttagttttcaataaaaacttaggagacatactttaaaaagcaggaaagtgtgacttccatgcaggaaaatgagcaattcatagaaactgcctctaatgaggcccagatgctgaacttcacagacaaggaatgtgagaagctataaacagaaaaaatgggatcagagacccataaacagaaaaaatgaagagagcttcagagacccttgggacacaagaaatgcatgcacttgtgcgctctctctctttttcatttttattcttctaatttatatggctggctttctatgggtcactttgtatcagtataccttagttgttagccagtgatggtcaggggttatgatcaaacaccttaaatgagtaaggcttcctttctttgccaataggtctgtctgtgggctagggaactcatttcaagttctgctcatttacaaatttgtcctggctcttactttccacccaaccctctcatgtcccttcttgagtgtaatggaactccctagaaagagaggagagagagaaaggggaagaaaaaatatttgaagaaagaccaaaaaaattccaaaattggaatttaaaaagtataatctacagattcaagaagctcaactccaagtagaatgaacacaaagagactcatacctaaatatttcatggtcagactattgaaagacccaaaaatgtcttgaaagcaacaagagaaaaatgattaatcataaaaagctgactcaaataataaaggtcacaaggcagtggaacagtatacttaaaatgctgaaagaaagaaggaaaaaaaccccacctattaagaagtcaatatccagaaaaattgtccttaaaaattaaggcaaaataaagtcactcccaaatgatcaaaggctaagagaattcatcactagcaatcgtgtcttacaagaaatattaaagaatccttcaggctgaaagggaataacactagacaataactaaaatccacaaacacaaaaaaaaagcatggggaaaggtaaatatattggaggtgtgacaggcaataaatatttttctcttttctcttgtgtaatttaaaatgtgtaagattgtataaaactataattataaaaccatattgtcgagcttatagaaaaatgtcatttgtatgacaataccacaaagaaattatattggagcaaagtttattttatgaatggatatgactctggagtagattgtaattagttaagatacatgttgcaaaattgagaacatcctcaaagaaaataatttaacaaaaaagaaaaataaatgatacactagaaaatatcaatctaacaaaaaagaagacagtaaaagaggaagcaaaaaagagaaatgacctgagccatatagaaaacaaatggaaaaaattgaagacataattttaattacactaaaaattacattaaatgtgaatgatttaaatagtccaatcaaaagacagagattatcagactacatttaaaaaaatacaaagtccaactctatattgtttacaagagatataccatagattcaaaaatacagtttcagagtaaaacagtggaaaagacacatcatgcaaacagtaaaatataagagagccagagtagctatactaagacaagattgattttaagaaaaaagcgttattcgagacaacaaggaaaatttcataataataaaaaggtcaaggtaccagaaagagacacttttaacaagagttacaaaatatgtgatgtaaaacctgacaaaatttaaagaaaaaaattaatgtttcaacatagtccaagattttaataatcctatctcagtaattgacttaaaactatatatgaaatcagcaatgatatagaagacttcaatagtactatcaaccaacttgtcataactggcatgtatagaacacttcatccaacaacatcagaatacacattttttcaagtgtgtatggaccttctccaagacacactatgctaggccataaaatgaatgtcaataaatttaaaagacttgaaataatgtacagtatgttctccagccacaagacattaaattagaaatcaagaacgaaaagaaatttggaaaatcccccaatatttggattaaatagtgcatttctaaaataactgtgggtcaaaaaagaaatcacaggggatattagaaaatattttcaatgaaaatggaaacacataaatatgtgaagatctatgggattcaaataaagcagagattagagtgtaattcattgttttaagaacctatataacaaaagaagaaatatcttaataacctaagctaccaccttaagaaactaaaaaaagagcaaattaaatgcaaagctagcagaaaaacaaataataaagataacagtgaaatattgtatgattttatgtttgtgaaatgtcaagacaagagaggtaggaagtcgattagtgattacctagggtggaagggagggggtttgtgggcgttaacagtaaaagtacatgagggatctttttagagtgatgaaaatgtctaaaacagatttttaataatgatttactgtattagagctttccagagaaacagaaccccagggaaaatacagagacagaaatgcaaagtggggaagagattattataagaagttgactcatgtgattatggagacagagaagttccaagatctgccgttggcaagctagagagttaatgatgtagttctggtccaagtctgagggcttgagaaccaggaagactactggtatacattatagcctgaaagcatgcaggctcaagacacaagaagagataatgtttcagtttgagcccaaaggcaggaaaagatgaatgttacagctcagtcagacaggcagcagttctcttttactcagcctttttattctgctcaggtcttcaattgattggatggggcccacacacattagggttgcaatccactttactcagcctactgcctaaaatgttaattaaaaaaaaatcccactctcttggacacatccagaataatgtttgacaaaatgacttggcacctcatagtccagtcaagttgacacataaaattaaccaaaataaggatgcctgcttctcccacttctattcaacataaatattaaagttctagttaaaccatttaggcaagaaaaaggaatcacaattgcacaactcagtaaaagtactaaaacccattgaattgtacacctgaaatttgtgatttatataatgtgcctcaacaaagttattagtacagtaaagagttagttctttggaaaaatcaaataaatttacaaatttgcaagattgacaagggaaaaagagagaagacacaaattaccaaaatcaggaatgaaagatggggcacttttttctactgtgataggctgaataatgccccaccatcaagatatctacatcccctgtaatctcagcacttttggaggccaaggctggcagatcacttgaggtcaggagtttgagaccaacctgtccaaaatggtgaaaccctgtctctactaaaaatgcaaaaattagctgggcatggtggtgggtgcctgtaatcccagctacttgggaggctgaggcaggagaatcgcttgaacctgggaggcagaggttgcagtgagccaagattgcaccactgcactccagcctgggtgacagagtgagactccatctcaaaaaaaaaaaaaaatctacatcctaatcactaaaatctgtgaacattatctttatggcaaaagaggatatgtagatataattaaattaagaatcttgagattagaaaattatcttgaattatataggtgggccctaaatgtagtcacaagtgaccttatcatgaaggaggcaagaaggtcaaagatggaagaaggaaattgaagcaaaagattgaagtgacaccctttgattatggaggaagggattacaaaccaagagatacaagtagcttctagaaattagaaaaggaaaggtaatggattctcccttggagccgccacaagaaatactggccttctgacaccttcattttatatttctgacctttagaactgtaagaaaataaatttgtgttgttgtaagccaccaagtttatagtaatttgttatagcaacagtaggagactaaaatactcatcctagaaaaatcgggatcataaggtaatagtatatgctattttttgctaaaatttggacaacttagatgaaagccacaaatgaccaagactgactcaagaaaagatagtaaacgtaaataatttatagaagtaaaaacttgtgctagcaactgtgatattatgatacatatatgttggtttgcattcgtggttcctagtgcgtaactctcataacccttgttataatgtcagggtgcttttggcctcataagcagcctcagaaaacagaatcgctctctctgactttctcttgcccacctttcacctgcccctttttctcttcaaggcagaaaccttcccccacctttctgtcttggagctggccataaattctctgacctgccttctgattgtgggtcctaagacccccatcttaaaaggatactgccccatacccagaaggagggaatgttacacagcaaggtcaagaagaatctgaacagataggctttgtcaggttttctaattcagtccgttagtattatatcataccctttttgtccaatcacatttctacacagaagcagagaacttatttgcaattttctaatctatctgcaagctgttcaagggactggtttcagtctcacctgactcagagttcagataggaaaaagcagcatagctcagatctcatgcttgcaaaggccacacaaaacagtggcaggtgtcatggcatgtgaaagttgtaggggaatttgcagacctatggatgcctaatttctaagaaattagaagcagaagaatacaatggaatatctaacggacattgaaaaaaaggcacacacacacaccagcccagataggacacatgcccagaaaagaatttaagcctttactccaggcagataccaaggctcagaatgtgccctgctaatgaatgaaggtcttctctgccagtttgcaaatattgggagaagtggttgggttttcaattctcaaaaaaagatcacaaggcatacaaaaaaaaaagaaaaccataacttattcaaagaaccaaaataaatctccaagaatgatccctgatgaaacacatattggatttactagacaaagactttaaaacatctgtcttaaatatggccataaagctaaatgaaagtatggataaagaactaaaagaactcaggaaaatgatatataaacaaaataagaatatcaataaagagatagaaattattttaaaaaccaacagaaattttagagctaaaaatacagcataacactggcaccaaaggcaaagatgttacagaaaaagagaagaatatagatttatatcctttatgaatattgatgcaaagacgttcaacaaatactcacaaattgaatttaacaatatatcaaaagattatacatgatgatcaaatgagatttattcctggaatgcatggctaattcaacatacaaaaaaacaataaatgtaatacaccacattaacaaaataaaggattaaaaaaagaccatttcaaatactgcagaaaaagcatttgacaaaattcaacactcttgcatggtaaaaacagtcaacaaactaggaatacaaataatgtacaacaaaatataggtgatatatgaaaattctatagataacatcatatgtagatgaaagaattaaattttttcatttaagacaatgaacaaaataaggatgcctgcttcttccacctctactcaacatgaagttctagttagaccatttaggaaagaaaaaggaatagaagatattcaaattggaaggaaagaaataaaattatccctgttcacagacaatatgaacttatatgtagaaaaccctaaagattttatacacacagacaaaaatgctataatagaattaataaattcagcaaagctgcaagacacaaaaccaacatgcaaaaatcatttgtgtttctgtacactaacattgatcaatctgacagggaaatttaaaaaaaagaactccatttaaaatagcatcaaaaagaaaaacaacacttagaggaatagacttaaccaaagatgtgaaaggcttgtacattgaaaactacaaaatgttgctgaaaggaataaaagaaaacacaaaaaatgaaaagacatcctgtattcatggatggaaaggcttaatatcgttaagatgtcaatgctacccaaagtgatctacagattcaattcaattcctatcaaaatcccaacaaaattttttgcatacatagaatagtccattctaaaatttacatgtaatctttattagccaaatagctacaataatattgaaaagggagaaaaaatgttgaaagtctcatacttttttatttcaaaacttaccacaaagctatagtaatcaatgtgatactgtcaaaacccagtcacataaaccaatggaatcaaatagagggtccagaaataaaccctcatgtgtatactttggcaaggatgctaagaccatgcaatagggaaaagataggattttcaacaaatggtcctgggaaactggatattcacatgcaaggaattaagttgaacccttaccttacgccatctacagaaattaacccaaaatggaatagagacctaaacataaaactaaactagaaaacttactgggaaaaaacctgcatgacattgcatttggaaataatttcttggatatgacatcaaagcaaagcaataaaaaacagattaattgcatttcatcaaaattaaaaacttttgtgcatcaaagaacacatcaacaaagtgtaaagacaaccgacagaatggggaaaaatatttgcaaatcatttatctgataaggaattgatatgcagaatatataaagaactcctacaatgcaacaacaaaaagacaaacaagtcaggaatggtggcacatgtctgtagtcctagctacttgggaggctgagatgagaggattgtttgatcccaggagttcaagaccaggctgggcaacacagtgaaatcctatccttaaaaaaagacaaattacccaatatggaaaagagcttgaataaacatttttcccaaaaagatattctaatggccaataagcatatgaaaagaaaaccacaatgagatgccatttgtcacctattaggatggccactataaaaaacaagagaaaatatcaagtgttggtaaggatgtggggaaattgaaaccctgtggagaaagcgtggcagttcctcaaaaattaaacacagtatcaacacatgatccagtaattccacttctaggtgcgtacttaaagaaactaaaagtgaggactcaagcagatatttgtacgcacatgtttatagcagcattgtccacaatagccaagggtggaagtgacccaggtgtttattgacagatgaatggatagaccaaaagtagtctatccatacagggaatgttattcagccttataaaggaaggaaatcctgacacatgctacaacacagatgaaacttgaggacattgagctaagtgaataagccagtcacgaaaggacaaatagtgtgattctgtatatacatggtacctcgattagtctgattcattgagacagaaagtagaatggtggttgctggggctcggggagaagggaaatgtggtttaatgggtatgaaatttcattttgggaagacgaaatgttttgggaatggatggtggtagtggttggacaaccacgtgaatgtacttaatgccacaggaatgtacacataaaattggctaaaacggtaaattttatgttatctatattttaccacgatttttttaaaaaagagaaaaaaagctttccacaaaaacatactccagaatcagatgactttgcaggtgaattctatcaaatcatatcagtccttcacaaactctgagaaaagagaagagaaatttattgtaggaggccagcattatcccagtgacagagctagacaaacacatcacaagaaaagaaacgtacagaacaaaacccccagtaaagagagacagcaaacttcacagcgaaatattagcaacctagctgcacataaaaagtattatttaccatgaccagataagattatcccataagttctttaccctggaatcaggaacaggataaggatgtccactttaccagtgctattcaacttagtactggaagttccagccaggataataaggctaaaacaaaacaaaaacagaagatggaagttaaagatatccagattggccgggcgcagtggctcgtgcctgtaatcccaacactttgggaggccgaggcgggtggatcatttgaggtcaggagtttgagaccagcctgaccaacatagtgaaaccctgtctctactgaaaatacaaaaattagccgctcatggtggcgcatgcctgtgatcccagctactcaggaggctgaggcatagaatctcttgaacccgggaggcggaagttgcagtgagccgagatcacgccattgcactcccatgtgggtggatgacagaagaggtctccgtctcaaaaataaaaataaaaagagttcttgctctattcatgagggatagtggtaaggaagattacttgaatatgtagactttgattctgggggtcctgaaccaaagatcacaactggtgaaaaaaaaaaaaaaacacccaagacttctaaatctgaggatgtcactgtgattgaacatattgtttggtatgatgtataacagtgcatcaaagccagtgaagaaaggagcaaatagaattggtaaaagttcataatacagcaagcctaacaagaaacagttaatttgggaatctcagcttaaacttttgaccttttgaagagaagaaatgttcgtgccatatcactcactgtctggtagcccctgtgccattgaccctaccttggagagtttgtgtgaaataaaatgagattccctttgctctgccccactgtgagtcaccagggtgccttggaagtggcagagtctggttggagcaggtgaagtgagagtgagtctggaacacactgctgttgtcggaaagcaaagatgccaccacagccagacctagggggtgtgaaaatggaaaaatagtgaccatcctgacaacagggtcccagtagtaatgacttgaacattaacaaggaagcaaagattttggcccattggaatcagttgagtgtgtggaaggccacagttcttgctatggtgggaaaagggcaaatcacatccactgtgccggagcagaggctctcctgctagtgtgttcgtgcatcaatgcctgggtttcttccccagtgtcaaaaagggacaaatcttaccactgcttttcgcctttttaagaaaagtgaaacgatttgttgaattcagtgcttctcaaagtgtggttcattgatccctggggttccacaaggtcaaatatttttataataataataagatgtgatttgtttttctcagtctcatcctttggtgagtgtacagtaaagatttccagaggccacatgacctgtgatatcacaacagattaaatgcaggagtagatacgaaaattccactctgtgtgtactatgcagacatttaaaagtttcacaaaactgtaaactaatgccactctgtctggaattttttttttttttttttttttgacggagtctcactctgtcacccaggctggagtgcagtggtgtgatcttggctcactgcaacttctgcctcctgggttcaagtgattctcctgccttagtctcctgagtagctgggattacaggcacccaccaccacacctggctgatttttttttttttttttttttgtatttttagtagagacggtgttttgccatgttggccaggctggtcttgaacccctgacctcaggtgatccatccgccttggcctcccaaagtgttacaggagtgagccacagcacccagcctggaattttttttaacttaaaatatgttattttttaacttaaaatatgttatttgtgttagcaaacaatgggtttatatattattattaaataaatcaagtgcatatcttttattgtctccgttttaatttctagtacagtaactatcagtaaacaaacaataaacaaaggtttttggaggccctcaatagttcttaagatcataaagggatcctgagaccaaaaactgtgagaaacactggtttgctccactttcttcttcttgcctttcaagttcacatatttattgcagtgggaggcacgggcatttgttgtttctgtcttctatgcaagaaatgccttaaaagaaagaaaggaaaatcagccccactttagaatggcctgcagcccctttggagggctggggaggggtgttccatgcatctggaaaatgcaaggacctgtaagaactaaggaatgctctacagtcattgggcacactcacagctcatctccagaaaagcatgggggtctagggggacatgactgcccccagaacaccaagggtgggtgaggggcttcacaaagcactgatggaatccttcctccaaccagatgaccacatcatctatctgggagccttcatggggacttggggtcaggctgcagggctctctgctctaaatggacactacacgtacattttgcttacatttaagggagctcgcatgcctccccagtgtctgttcaactcttctcgtccatcataacacctttcaataaccacagagattgacaagctctatcacagagcaattacaaaccacaacagaacgttgtcagaaatggacatgacttttatcagcaggcagtcttctgacagaacttacttaaccctctcctttaaagggtctcttgaaatctctgggttcctccctcccgaaagtgagaaaagcctgtcagataaggaaattttcaggaatgccttatttaaacaacagcgccactgacagaagtgttacacaacaactaacaatagatggtatttgaaaagaaaaagtgctccagagaagatcaggcaaactagtaaacatctgcaggaagtgaattctcctccccagttgtagagactcatcttgctgtcagagaagagagaggtaagatttagcagtgttagataagggaaggtataggaagtccaaaattgtaaccttcaaactattttggattctgagaacaagatagtactcaacataattaaaattttcggaaacttaaagtgggccaaggaaaagcaattgattgcttacagtgcacaccatgaatccacaaaactgaaatttacccccagaaatagataccaataagagccattggctaacagtcctgctcaatggcatagatcttctaagagtgacagcatatggggaggtcacttttaatgtttcccaagtctttcgaaatctgtggcaagatgttttattaggaattgggtgtagcctaaccagacattcgggagagccctcatcaggcagagagaaagcatatatagggtggggtctgtaaggtgggggggtctgggagggtgggagtgtgggagcctcttgtgctcatgtgctttctttgctgcttagtgtgcaatatttatttacttatttttatttttatcttttttgagacaaagtctggctctcttgcccaggcttgagcacagtgatatgatgtccactcactgcaacctccatctcccaggctcaagtgatcatcctgcctcagcctcttgagtagctgggactacaggtgtgcaccaccatgcctagctaatttttgtatttttggtaaagacagggttttgccatgttgttcctgggctcaagcgatgcacctgccctgttcttgggcttaaacaatgcacctgcccctgcctcccaaagagctaggattacacacgtgagccaccgcacctggctgctgatacccaatattagcatggtgtttggcatgcaacaggtgctcagtagacacttcatgaatgagtgaggatggtgttattgcattggatcttaccctaaaaagaaagaaatggaaatcagggaacagctatgagaaggagattggggaggaagaaggatacatttagcaacattttattacttttccaggatcaacacaccctggaggtgctctctcactgtctgggatgttctacgcccttggggtttaggccctgtggctactttctcagtcttctttggtgctctgggaaagttttgtaaaggacttacttttatctctctcttttaaattgttctctttaaatgttttgaaaagcaaaaagtactagaagtgggcttgaaaggaacttaatgccagctaatggacaactcagtcaaattagatgaagattgtgttacagagctgagaagaggtagtcagatggcggaaacaatctcctcctgattggggaaaagaaatcagggcatgtgcatgcagtgtgtccgtcttccggtttctatttatgaatcatacctacttcatcatctctgtggggaataaatgagataaataaaaagtgcttagtgtgcaatatattcttagtgaatattagtgcctctccttccttccttgatttgaagaagggagtggagtcctcatatgcttttcacattttattttaatagactttattttgtagcacagtgttaggttgaaggaaaaattgcacagaaaagtacaaagagttcctatatacctcctctcccacatccacactccctgttattaacatagtgccttagtgtggtacatttattacaactgatgaaccgatattgatacattatggttaagtaaagtccacagactacattagcattcactcttcctgttgtacattctacaggttttgccaagtgcataatgtcatgtatccatcattacagtatcagaaggaatagcttcactgccctaaagaccccctgcactccgcctagtcatccctccctccccttgaacctctggcaacctctgaccttttaactgtctataattttgccatttccagaatgtcatgtagttggaattataccgaatgcagcctttttagactggtttcttttacttagcaatatgtatttacagttcctccatgaatatttgtgacttgatagctcatttctctttatacctgagtaataatctatgagtccattatatggacttatatgcatttttaataccaattatctactgtcatcttaagcactggagttgaggtagaatgcatagctttaagcactatggctagggaaaatctgacctctccaagaggcaatatacatgtagttgttaaaaacattgcttttgctgttaaacatacctgagtgtagcaatattcaacatccgaaaagtatgtattgaacatggtgtataaccagtgttgcgtctgacactcccggccctgcagatagagtgggagcaacacagacacagtccctgtgttgctgtcccgctggccctgcctcccaccccacagatgttctgtctgtttcacacccgcctgtacttactctgcaccaggaactgtctgacatgcctcataaatactgactcatttaatcctcaaaacgaccttatgagtcagtcccattattagtgccattttacagatacggaaactgaggcacagaatattaagttacttgctctccattcccctactactaagcagcaggggtgggattcagactcaggcagtgtggctttagagtctccttcctaacaatggaactatgctgccttgagcggaaggccaacacgagggtggagaattaggtaggcgatagcaacacagcgtgtttggcccacgcttcacctggttgtcattgcagaggggcgaggggagtggtcaggaaaaactagctgggcgaagcagcactgtcgtgtgctctgaaatacattaaagcctgatgggcatttcctaaagtgtgaatgagactcaattcttgacttctccgtgcctcgtgtccccccggtaatgagagcagccgccttacaggttgtgaggtctgagtgagaaataaacggtgccatgggaagacagccacactcgctagctgtgatgaggagcgtaaggaccaggtcctgacttcctgcaggctctcacttggcccttgtctgagtccttgggctggtgtccactgctggggaagaaggcagagtaggggaaagaaggaagctcagaaacaaggtacagggggctgcctgcagactacttaagagcatcagtttgcttcttaaactgatacactggctctgaagtcagtgccagaagagctccagaatggtttctagtggtggtatcctaaacacacacacttccagggggcagttttgatgcagaaccctcatttggactttttcttttttttttttttttttttttaagcaaacctctctttgctttataccagattgcatagacagccttttagaaatcactcagaaaatgtgtcttcctccagtcactgtagttcaccataataatgtgaaatgtaggacctgtggattgactttatgagtccaggacctatgttagcactgcattcctttgagtctggtcatcttcaagccaaagccagtaacagtgcaggcttgctcacccacctgagcctgcagctggtcctgagctttctcccaacaatcccctcagatctgtgtctgaaaatgcatctgtaacagtgatggcattccctcatcatatgacactttgtattttatttgtataaaataaagccagagttactgtattaggcagggttctccaaagaactagaaccaatggagatatataaatatatgtatgtgtgtatatatgtgaatttatatctgtgtgtgtatatatatattatattatatacaatacctgatgtcacaccattcagaattcagtaaatgtgttaacttttgtcactcctataaagtcaggcattgggtcctaaacatgtattagaacatgtcaattacctttttgtgttatgctctgtattaacagcctgaaccaaggagcgctataaaggctttgctttcccctcattagtggctgactttgcacgttatttctcatctggacattggattctgcaagtcctccatttatggtaaggaatggtagtttcgtttgtctggtttaggtagattttattgttgtttactttcagatttcataaaaatatgttactttcagatttcataaaatataaaaatttcagatttcataaaagtatgttaaaaatatactaaaaaatatttttggacatatgggcaaaggggcagacaaggatactttaacattaaagactttcttgggcctgatgtcttaaccgtcccagagggatctgtactgacccacctccactctcccaaacagtaattattcagaaaatataatcaatgcagattgtaaagattaaaaaacatgaatgatttaaactaagtattatttccctttggaggacacacatgcacacctgcacaagtgcatatgtgcacacacttcatcctatttaacaggaaaattgttggaagcctacttctttatggaagagctccattttgtattccttgttacctgtggagacaaacttaatacatgatttctaagatggtatattcaagagccattctctgtgacttttcaggctcagatttaatggctagtgatgtagtgaaagcctggggcagctcatgatgaggaccctcagtttctcagcatgaggctctatctcactggccactccactgtcagtaataaccaccatcgaaaattgaagtcccctagcaaaacacgcccattgctgttacttcattttgtctctgagacaaaggtctttaattggaggacaccctcagaagtgttgggcagtcacctggccttgatgcctttatcatcatggggaagcctgcactgaccacctccaatctcctgctaactccactccagcctaacaaagcagaagccgagagaagccctctgcgcagacacgcagcatctggggtgccaacttcacactctttcttgtcaaggccctggcactattcttactcttcctaaagaaagacttagtgtttcagaaggatgtacagcatgggttcagcccaagaaacacagtgagtggccatttaatcaaaaactaatataaatagcttaaagagtgaaaggattattccaataagggctgagtctatttttctataaggagtgaagccagggagctgaagcagcccagttactcacaaccacagaaatgacctatactgaagacactccactgagtcactgtttaaccacctaggcccctcggcaggaggggactctgctgacaagcctttggggtcagtcctgagacaacaccttgatatgtggcccagtgggtagcaaagaattctgaggtgttcaacattccccagttgaaaatgcattgaggggtagaagcactatggaaggccagggtcacaaagtgtgagtgctgaaggccgacttgtttatggtgtctgagtctcacattgctgctgtcctatgtaaacaaatgttagcagggccccatggaagtgagcaggcttacacgcctttgggaggggcatgcaccagcatgactcttcaggaggccagcttggcagtgtgtcttagaagccctttgacacagcgatttacgtggaagagtttatgagacacaaattgctgcatgatttatacaatagagtttgaaaagatgtgaaacacaggcatgatacaaataaattatgtacctctatccagtaaaacactctatagtcctaaaacattacatgctagaagaacatttaaggacagaaaaaaaattcaccatgtatagttaagtaaaaagtgtatgaaacagtatcaccctgattccattttaaattatttaaaatgccaaattaaagtttaaaaattaaaattaaaaagtgtctagatacatgattaacaagattttaaacaagtcccttgagatttcattcccttacccccagaacttgtgaacagggtgaggtatcactccatgattatgttatgctatatagcacagttgctcttaatacagaaagattctcctcgtgggcctgacataatcacatgagaccctttaaaagcagagaatctttcaggctgtttgaggaaaggaagccagagagatttgaagcatgagaagtggtcaatgcaccgctgttggtgtgaacctggaggaagcaggtgaggagggaatcagacaaccttaaagagctgagagatggggagctgacagttcgccaggatacgaggatctctgtcctgcagatgcaaggacttgaacttggtcaagaacccagtgatattggaagcagattcttccccagagcctccatggaagagcctagcctggccaacgcctcaatatcatcttgggagacactgcacagagaacccagtcaagccatgcagaacttcggatctacagaactgtgagctaataaatctgtattgcttaaagctacatatgtgtggtaatttgttacacagaaatgggatactaatgcaaaaaaaaaaaagcacagaaaagactaaaagatgagaatctaaaacaataatagcagccagtctcagtaatagaatgcttccattattgtggatcttatgtgatgggtatgggctctctttgaattcaggaaaaagacatattttaataagcagaaaaatgcataattatatctttacaaaagaaaaagataaaataatgtgtatggtattcattcagaaagggtagatttaaaaggagaaaaaacttctttctctaacttaccaattatatccagggattctttgtgttaaaagattttcttaattcaggaagttcacttaggaaaagtgagacagtttataagtgtgtcactttatatatggtcatttctttgtcccatacaggcactcaaaaattatttgcataatcctcctaggtgtacaactccagttacctgggaatctcatccccatcccccacagcagccgcagcaagaccggcccaaggagactctgagctcagacacgcctagccctgcccccatctgatggtccttctctacccaccctggtagcagaaaacaaaggacatataatcttgggatttctagggccctgcccactgccagtccctctccacactaccacagctgatgctttctggcaagtgccacctcctggcaggaggccaaccaacgcaaaaatagagcattaaaccaccaaatctaaggaccctcacagagtccattgcaccctccgtcacctccactggaataggcactagtatatacggctgagagacccataaatggttcacatcacagacaacccccagaaccagcttggagccaggtagactcactgggtggctagacccagaagagagacaataaacactatagtttggctcacaagaagccacatccataggaaaagtgggagagtactacatcaagggaacaccttgtggaacaaaaatatctgaacaacagccttcagccctagaccttccctctggtagagcctacccaaatgagaaagaactagaaaaccaaccctggtaatacgacaaaacaaggctcatcaacagcctcgaaaaatcatgctagttcaccagcaatggatccaaaccaagaagaaatccctgaattacctgaaaaagaattcagggggttagttattaacccaattagggaggaaccagagaaacgtgaagcccagtgtaaggaaatccaaaaaaatgatacaagaagcgatgggagaaatattcaatgaaatagacagtttaaaggaaaaaaaataaaatgtcaggaaactttggacacacttttagaaatgcaaaatgctctagaaagtctcagcaatagaattaaacaagtagaagaaagaaattcagagcttgaagaattaacccaatccaacaaagacaaagaaaaaagaataagaaaatatgaataaagcctccaagaagtctgggatgatgttaaacaacaaaacctaaggataatcaggttcatgaggaagaagacaattctaaaatcttggaaaacatattgtggggaataataaaggaaaacttccccagccttgctagagacctagacatgcaaatacaagaagcacaaagaaaacgtgggaaattcgttgcaaaaagatcttcacctaggcacattgtcatcaggttttccaaagttaagatgaaggaaagcatcttaagagctgtgagacagaagcaccaggtaacctataaaggaaaacctatcagattaacagcagatttctcaacagaaatgctaacagctagaagggattgggggcctatcttcagtctcctcaaacaaaacaattatcagccaagaattctgtatccggtgaaactaagcatcatatatgaaggaaagatacagtcattttctttccttcaacaaatgctgagagaattcactattaccaagccaccactacaagaactgctaaaagagctctaaatcttgaaacaaaccctggaaacacatcaaaacagaatctctttaaagtacaaatcacacaggacctataaaacaaaaatgcaagttaaaaaaacaaaaacaaaaaacaaaaaataaagagcatgatgaatgcaacagtacctcacgtttcaatactaacattgaatgtaaatggcctaaatgttccttttaaaaggtacagaactgcagaatggaaaagaactcaccaaccaactacctgctgtcttcaggagactcacctaacacataaggattcgcataaacttaaagtaaaggggtggaaaaagacatttcatgcaaatggacaccgaaagcaagcaggggtagctattcttatatcagacaaaacaagctttatagcaacagtggttaaaagagacaaaaaggagcattatataatggtaaaaggccttgtccaacaggaaaatatcacaatcctaagcatatatgcagctaacacaggagctcccaaatttataaaaccattactaatagacctaagaaatgagatagcacaccataatagtgcaggacttcaatactccactgacagcactagacagattatcaagacagaaagtcaacaaagaaacaacggatttaaactatacctgggaacaaatggacttaacagatatatacagaacatttcatccaacaactgcagaatacacattctattcaagagcgcatggaactttctccaagatagaccatgtgataggccataaaacgagcctcaataaatttaagaaaattgaaattatatcaagcactctctcagaccacagtggaataaaactggaaatcaactccataatgaactttcaaaaccacacaaacacatggaaattaaataaactgctcctgaatgagcaccgggttaaaaacgaaatcaagatggaaactaaaaaattctttgaactgaatgacaataatgacacaatttatcataacctctgggatacagctaaggcggtgctaagcggaaagctcacagccctaaatgcctacatcgaaaagtctgaaagagcacaaacaatctaaggtcacccctcaaggaactagagaaacaagaacaaaccaaacccaaaccagcagaaaaaaggaaataaccaagatcagagcagaactaaatgaaactgaaacaaacaaagaaaaatatataaaagataaatgaaaccaaaagctggttctttgacaagataaataaaattgatacaccatcagcaaaattaaccaagaaaagaagagagaaaatccagataacctcactaagaaacgaaacaggaaatattacaactgacaccactgaaatacaaaagatcactcaagcctactatgaacacctttacacgcataaaatagaaaacctagagagggatacattcctggagaaatacaaccctccttgattaaatcaggaagaattagataccctgaacagaccaacaacaaacagagagactgaaacagtaattttaaaattccctgcacgttctgcacatgtatcccagaacttaaagtataattaaaaaaacaaagcaacctattttgcaaagctgtaggatatactatcagtatataaaaatcacttgtgtttctatacagtagcaatgagcaaactgcaaataaaattagaaaagcaatttcatttacaatagcatcaaaaagaataaagtacccaggaatacatttaacagaagttgaaactttatttaaaaaaaaaattccaacaaaaaaagtcccagaccagatggattcacagcagaattctaccagatgttcaaagaagaattggtaccaatccttttgacactattccacaagatagagaaagaaggaaccttccctaattaattctatgaagccagcatcaccctaataccaaaaccaggaaaggacacaaccaaaagagaaaactacagactgatatttttgatgaacatggatgctaaaatccttaacaaaatactagctaaccgaatccaacaacacatcaaaaagataatccatcatgatcaaatggatttcataccaggaatacagggatggtttaacatacacaaggcaataaatgtgatacaccacataaacagaactaaaaacaaaaatcatacgattatctcaataaatgcagaaaaaaaatcgacaaaatccagcatccctttgtgattaagaccctcagcaaagtcagcatacaagggacataccttaatgtaataaaagccatctgtgacaaagccacagccaacataatactgaatggggaaaagttgaaggtatttcctctgagaacaggaacgagacaagaattcccactctcaccactcctcttcaacatagtactggaggatattacactaagtgaaataagccaagcacagcaagacaaataccacatgactcacttatatgtggagcataaaaaaagtcaaactcatagaaacagagagtaaaatggtggttaccagaggctggaaggtggcagaattggggagatgttggttaaaggacacaaaattagacaggaggaatattgtacaacgtggtgactcggattagtaacaatatatagtatattttaaaattactcaaagagtagattataagtgttctctccacaaaaaaaagtatgtaaggtaatgcatatgataaatagcttgatttagccattccacaatgtatacacatatcaaaacatatataggtataggaggcatgtatagatggtatatataggtatagagggcattgtacagtgtaaattgtaccttttatcattatcaaacgaccctgctcactgaatgctctttgccccacattaaatctttcctgatatttttattgccaccttgctttcttctgattttgtttccctagttgtttgcccatcttctgtcatctcaaatgtcctgtgccattttgtcatctgttatttgtttttatatgcagcttttacatgggttatgagtcaatctgaaaatcattttttccttttaataaagcagttcatcccttatttgatgttacggatgtgtttgcctttctctcttcacctcttattttcttatgtcttctgtgccgctgcttcattttaaaaatcttttgctgtttggcttctctttttgagtgtgtcaatattttcctttttataaagaagtagctttacaactcttcataatttacttaaaccttttttctttactgacaaactttaataatatctattgattccctgcaatgaaacaagcacttcctttgcctaatttttgttttaatattaatactataattctacaagtggctgttattatatcttttaacatgccttcccaattcaagatcacttccatgagccctagatttggccagccaactgtctacctaacatcactgctgggtggctaagtgcctccaacttgatgtgtcaaaaccaaatcatgattccagcctcccagacgctttcctttcacactttcccacatttcagtaaagagatgactcttttacctccttaccaggtcaaaaactgaggtgtcatcctcaattccttctttgtctttatccagcaaagttcaatccaacaagtcatgtcatttcttctccacagcacaattgattccattcacttctcaccctcatcactccagccccctcagtgtgacaccagcacgtcttcctggaggaggcaggagcctcattactaccccctagccctgcacacacactctaccctcaacattcattcattctacacatggagataacactactgtcctgctttacatccttcacagactccattgttcttaaactaacactccatttcttcctcaatgcctgcaaggcagggttctgcaatgggccagacattctagggcagcctctctgtatctctattgccctagcagggcttggtcatcctgtccagctctgaagccctttccactcagggctcatacacttgccctaaaaggttccttcccaggtccacacacgactgccacagctactccttcaggtcaagctcagacatcacctccccagagaggccattcttgacctggcatccactttctccaccacatctctacccttactatcattataacaaagaccaccaagttaccgatcttactgttggccaatttttggttgtcttctcccctcactagagtgcaagttccatggggacaactgcatgactgtctatcccaggctggaagctgtgacagactcagaaaagattttcaaatgaaggaatatacttaaacatatttatttatttatttatttatttatttatttttgagacagagttttgctcttgtccaggctggggtgcaatggcgtgatctgggctcaccacaacctctgcctcctggattcaaacgattctcctgcctcagcctcctgagtagctgggattacaggcatgtgccaccatggccagctaattttgtatttttagtagagatggggtttctccatgttggtcacgctggtcttgaactcccgacctcagatgatcagcccacctcagcctcccaaagtgctgggattacaggtgtgagccactgtgcccggcctaaacaccttttttgtttatcaaatttgggaagtatatagcaattccatatgatggcagtggagaaatttactcactttacaccttctccatcttctcattttcttagtcccttctcatttgtgtctccttgttgcttataatacagtacttaccttccattcgatacacacaatccccgtgctctgtgaattttatttatttgttttttaaattgaaaagtaggccaggcatggtggctcatgcctgtaatcccagcactttgggaggctgaggtgggtggatcatttgaggtcaggagtttgagaccagcctgacggacatggtgaaccccgtctctattaaaaatacaaaaaaaaaaaaaaatagccaggcatggtggcgcatgcctgtaatcccagctactcaggaggctgaggcaggagaatggcttgagcccaggagacagaggttgaagtgagctgagattgcgccactgcactccaacctcggcaacagagcgagacttcatctaaaaaaaaaaaagtaaacactatgtatatttagggtatacaaaatgatcatgaatctccacattccaaataatctattatcaaaatttataaagcaaaaactgaaggaaacacagggagacatggaaatacaacagccgtaggagacattaactcacttgtcagctactgacagatcaagtagagaaaaattcagtaagaacatagacagtggccttgaaaatgcaccgtgcaccggaattgtctgtgatgtgcctaaaactgccatccagaagcttctatgttagcaagtccggagcaacacccaggaatctgagctttcacatgctcctcaggtaattctaatgaacagaaaacatttcaaaataaaaaccatgaggagattctaaatgatgcacagaataaggtaaatctaataaatatatagtgaatgctatgcctggaataaaacagaatacagcttattttgaactgttcatgaaatacttactgattatagataaagccccaaatgaaacttcaaaaaaaattctataaagtagaaatagttcaggtaacattttcagattacactgtattaatgagaaataaaggaaaattaacaaacagaaaaacgcaaacatcaaaagacatttaactttctcttgtacaataagcagatctggccccaaagagggactcaaaatcaaatttgtgcaatacttacaaagtagtactttaaaaaaaagtatgtatcataatccataacacttggttagcttacactcagggaaaaattctaggccttaaacagttccactacaaaacaagaaagaatacaaataaatgaaagggaagagatgacatcttagttttgcaccatctcagagctatgagattggctgataatctgttcatatgcctgctgaccactgcttttcccctttcactttcttctgtttgtatcttttcttaaaggttggtagaaaatatttacgcagttttctccacctcaagttcatgaacattttttcttatactttaaataagttttatcataaaagactttaaaattcagagaagattagagaataaaacaatccaaatcccatacatccaccactcagttacaacacattttcatattttgccatgttgctcgtttttgccattttaatcaagttttactataaaatactttaaaattcgataaatttaaggaataatataataaatacccacatacccaccacccagtttttacacaccctaatattttgcctttttttgcctatttttttttttaagtattaaagtatcacctgtgggcattcagagggcttatggtggcagtaggaattttgttttgttttgttttgtgacggagtctcgctctatcgcccaggctggagtgcatggcgatacctcagctcactgcaacctccacctctcgggttcaagcaattctcctgccccagcctcccaagtagctgggactacaggtgtgtgccagctactgcactacaggttgacccactgcaacctctgcctcccagggtcaagtgaccctcctgtctcatcctcccaagtagctgggactacaggcacatgccaccatttctggtgcatttttgtatttttagtagagatggggtttcaccatgttggtcaggctggtctcagactcctaacctcaggtgatccacccacctcagcctcccaaagtgctgggattacaggcatgagccaccgcatctggtctattctctctactttagaaatgtcttcaaatttccatgataaaaagtttaaaaattataattcatgtaaattttttatgagaggctttcagtttcacctctgacatgtcagagcttggaagtcaacgttcccatcctagtaacaagaaaaagctgtataaactgaaacgtaatgacttttccggggcccatcagagaactgaggattcagggcaagttgccatcccaaaatcttgaaagaggcaagtccagagactcacggttgacatctacttacctggaacagaagccactggagtcataagctagtagcaaaacttcaatggtaattttggcaaatgactcagggctgagtgtagactagtgtgggagtgaggaatgtctgggtctgcaggctctggcgggcacactctgctgggctttccctccaggaaccccagcaggttcccataatgaaacactaagaaaaagctctaggactagagtaaaaggaaagaaattgtaaaattcacccagaaccattcccagggaaaagactgctagagctgtatgccagctgttccagccccctctagccttcctctaagggtgaacccagaatcaagaggagtgggggtttcaaggaaacagactgggaacatggcagccaggaaaaggagtcaggggcagggaaagacaaaaaaaaaagaaagaaaaaaagctatgctaggggagaactacttgtgaagatcatcttcttggcctgctgtccagaggagcccaaagtggctgggaggcagtcttaacttccagttcaatggactcattgctgtgcctcccgatggaagcatttctccctctggaactaaaaccacaaggccagcagaacctgaggttgtggagacaggaaacaaaaattttgctaataaatcactaggggtgatggtaagtgatgccactcccatttctaccccttgatttctggaccagtgaactctggctatgggagaaacagcaccatagattagttgctgatttgcagcataggccgcctcctggagaatgttgccccagccctgcaaggtattgccacttacctggcactggcactgagactttgaaaggccattccactgttctgtgaagtcggctgcaccatgttgatggggaacatgataagactaatggattccatgagcatgagcccattgctgtatgtctttggctgtgaagtgagttccttgatcagaagcaatgctgtgtggaatactatgatggcaaatggcattctataagtccataggtggcagttttggcaatagcactgcatgcagaaaaggcatatatgtatctggagtatctattccagtaaggacaaaacaatgcctcctccatgatggaaggtgttcaatgtaagcaatctgccaccaggtagctggcggatcaccgtggggactggtgccatatctgaggcttagtgttggtcactgctgctgacagtttgggcatgcagtcgtgtctgtggccaggtagtccttggtgagtggaagtccatgttgctgagcccatgcataacttccatccctgccaccatgacactttgttcatgagcccattgggaaatgacaggggtggctggggaaagaggctgactggtatccacagaatgggtcctcctatccacttgattattaaaatcctcctctgctaaggtcaccctttggtgagcatccacatgggacacaaatgtcttcattctttctttctttcctttctttcctttcttttcttccttcctttctctctctctctctttctttctttttctcattcaaagagttttatccacacacctcttcctcagatctccttctcagtaattttccactcatgtttcttctaagtccatgaccatccagcaaaatcattggctacagcccatgaatttgcatataatcacacatctggccctgtctcctttcaagcaaaatgaataagtttcaagtagcactgcttgaagttctgcccacagagaagatttcctagaaaggggttcttgtgctgcagctatccacttttgggtagtgagtgcgtattgtgcagaattgtctataaataaggcctaagccttctcctcctctgtcagctggttgtagggaactccccattaggtcataggtgcagtctgggagagaggaggcagtgtagctggagtgggaaccatgggcatttgggccacttcttcgtgtaccttacttgtaccttgagtgctctgtcctatttgatgacagtgctaccgttcgtgtctcactttatggcttggagggtcaaataacacccagttcatgatgtgccgctcaggtcccatagttacttggtggcccatagttaagtgttccgtgttactaaggcccagtgtcactaaggctaaaaggtgtttcccaaaaggaaaataattatctgcagaggatgagagggttttgctccaaaatcctaaggtcttgcactacaattcacttatagggccctgcctaagactgcaaacagcatctctatctgctactagcacttcaagcaccacttcatctgctgggtcatatggcccaaggggtaaagcagcttgtgcagcagcctcagcctgttgcaggccttcctcctgctcttggctccattcaaaactagcaggttttcaggttacttggtagatggacaaaaaagcacaaccaaccaaatgagaaataagtccgcttcaaaatctaaagaggcccagtaggtgttgtgcctctttcttggttgcggagccagatgcaacaactcctccttccccctagaaaggatagctccacgtgccccacaccactggatctttagaaatttcgatgacatagaaggcccctgaatttttgtcagatttatttcccacctactggcacacaaaagtcttaccgagaaccttagattagtcactacttcctgctcagcagatgcaatcagcataaggacatccatgtaaggactaatgtgatgttttgtggaagggaaaagtgatgaaaaaccctggaagctaaactatgacagagctggagagttgatatacccctgaaatcgggcagtgaaggtatattgctggcctagccaactgaaatcaagtagcttctgatggtctttactaataggaatagagaaaaaagcatgtgccagattaatagctgtataccaggtattagggatgtgttaatttacccaagcactgaaaccacatctgccacagcagctgcaatttgagtcaccaggttaagccatgattctatgtttttatgatttaagttaattttttattcacttgatgtagaattcttctgcagatcaagtaaggatttagtaagcatcttacctatttcacttctagaagtaccatgatcaccagccagtgccacagttgtctgcaggtcagactattacgatggctgctttgactccattgttcattacagcagccccacctgccttgtctttagtgactgagtgccaacacatggtccctgccacccagattcaactaccctcctttgcattcaggttttccaattcagtggcagcagttcccactctagtttctgatctacagagagaagagtaatcaaggggctcctcaaggatgctggagatccccttgcaaatttgtttctcacagttgtagtgaaaggtgtatcctctagactctccagagtgagtgagcaggtctgaggtgacaaatctactctgccgttctaatttcacaagcctttgactctctttctctacaaaatgccaaggcaggtgtggcatttcacatttatttcctgtgggccacgttttgctccttgtttcatttaaccaaccgagcaacttgtagagcctttctaactccccaagctgcaacattaaatttagaatatccacttagtagtcgatgttaacagttccagctggatccaactttatatccaactctatgttctttctctctttattccacacccttactatccctggatttctgtctgcgtacactggaaaaatcatgtagttttttggagtgtagtgcactcttcgtggatcccactatatgccttacctttaggggtcttctgggatgtgagtctagttataggcctagaagcagagcagtgctgggggtggatcctgaggggaatcagcattgtcttgtaagacaactaccacggaggataccattacagtttcctcagacggggatagaataatagcttctactggtaaagaaactcagcagaatctaggggttcaatgtccccagcctcactggggtcttcctatatatccccattccattgtttggaatctcattccttatcaatccctcactttaacagtagacaccttacaaggctgggaattctatttgtattgtaattcagtaacttgtaggatgagattctggatttggttttccgcaatctcagctttgcaggtacaagagttaagtgtctctttcagggcacagaaagctttcagatcattcatgtggatttgaatcaaatctctgaactccttttcttcttcaatttgtccattgaaagcaggagctaccggccaatcttgtcttactcattagcttgacaaaaatgtttgaagggtatcacccagatccttgcttcttgatgagtgtttgattaggagtatctaatgacggtcttttgcagacctgtattaccacacagcaccatggactatcagtgctccttttactactggaaatagtcattcatgtctttaaatctaatcagattagagacaaaattacagaaaccccaacccagaaaactcattcttaaaattctgttcctttagaaccactttcagtaccaaattctgtgttagggttctccagagaaacagaacctatatctgaatccatattggtacatatatggtgtattgatgctatattttggtttgtttgatattttcaagcctcatgttgagatttcatccccagcgttggaggtggggcttaatgagagatatttggtcatgggggcagatccctcataagtagattaatgttctccgtggttggcgtgagtgagttctcactttattagtttctgtgaggggtggattttaaaaagagcctgacacttcccctctcccttgcttcctctctcaccatgtaatctctgcacacactagttcccattcccttcccaccatgagtggaagcagcctgaggccctcaccagatgcagatgacagtgccatgcttcttgaacagcctgcagaactgtgagccaaataaaattcttttctttataaattgctcggcctcaggtattactttatagcaactaagacatttgacatgtacagttagccttctatatccaaggtttctgcagaagggggttcaaccagttgtggatcaaaaatgctcagagaaaaaacaataaaaggtatcaatacaataaaaataaaacccaatacagtataataattattaacatagcatttacactgtaataggtattgtaagtgatctagaggtgatttaaagtataccagatgatgtatgtaagttatatgcagatactatgctattttgtgtaaggaacttgagcatccaccaattttgatatctgcaaggggtcctggaaacaatccttctcaattactgagggacaactgtatatagtttgtgcacacacacacacacagacacataacacacacacacacacacacacagagggcagggagggggaaagagaaaattttctcacacatctgtataggttgacaagtccaaaatctacgataggctagcaggctggagacctagggaggagcgaatgttacagcatgaatccaaaggcagtcttttggcagaaatccctctttctgagggaggtcattcttttttctttaaggccttcaactgcttgatgaggcccacccacattgaaaggtaatcttctatactcaaaatcaactaatttaaatattagtcattgcttaaaaaaaagcatcagagaaacatctagaatagtgtttgaccaaatacagtagtcctccctcatcctcaggagacgcgttctgagacatccagtggatgccagaagctatggatgttaccaaaccctatatgcactatgttttctcctatacatacatgcttatgataaagtttaattgataaattaggcacaataaaaattagcaacaataactaataaataataaagtagaacaattaaaataatattctgttcaaatttcaagaatagatttttatcttactgtagatattagcaacctcggcttatgatttttttcttattaagttgagaactttcaccttttcacttaaagtaagcactttacagcttctctttggcatatttaaattgctggcattactacttatgtgctttagggccattatgaagtaaaatgagggttacttgaacacaggcactgtgatacccttatagttgacctgacaaacgaggtggctactaagtgactaatgggcaggtggtgtagacaggatagaaatgctgtacaaaggccaggcgcagtggctcatgcctgtaatcccagcactttgggaggccgaggcaggaggacacctgaggtcaggagttcaagaccagcctgaccaacatggtgaaacctctctacaaaaattagctaggcgtggtggcaggcgcctataatcccagctactcgggaggctgaggcaggagaatcacttgaacccacaaggcagaggtcgcagtgagctgagatctcaccattgcactccagcctcggcaacagagcaagactctgtctcaaaaaaaaattaaataaataagtaaaactttcatttaaaaaaaaaaaaaagaaatgctggacaaagggatgattcatatcccagctgggacagggcaaggtggtatgaaatttcaccgtgctactcagaaggaggcacaatttaaaacttatggattttttatttctggaattttccatttaatatcttcagaccacagttgactgcatgtcactaaaactgtgaaaagagaaactgcagataaagaggaaccactgtatctgggtactgtggcctagccaaatcaacatgtgaaattagcaactaaccatcaacaaatatttaggtgtaaagctaacaaaatatgtttaagatctagataagaaaaactacaaaaatctgatgggagatattacagaaaatctcaataaatggagagactccatatacatggataggaagattcaatattatcaaggtgaccttctaacttaatctagagattcaacagactcccagtcaaaatcccaacaaattattttattggatatcaacacactgattctaaagttaatacagcaggccaggcgcagtggctcatgtctgtaatcccaggactttgggaggctgaggtgggttgatcacttgaggtcaggagtttgagaccagtctggacagtatggtgaaaccccatctctactaaaaatacaaaaatcagctgagtgtggtggcatgcacctgtaattccagctactcgggaggctgaggcaggagaattgcttgaacccaggaggcagaggttgcagtgagccgagatcacaccactgcactccagtctgggtgacaaagtaagtgagactctgtctcaaaaaataaaaaataaatacatatataaagtttatacaacaaacagcccaaaatagacaaaaaaaaaatattgaaagagaagaagaaagtagggagactgacagtacctcacttcaagacttgtcataagactacagtaatcaagtgtgaatagacaagaatagacaaatagactaatggaacagagtagcccagaaagagtcccacacaaatacagtcaactgatttttgacaaagaagcaaaggcaaattaatggaggatagtcttttcaacaattggtactggagcaactgggcatccacatgcaaaaaaaggatagaccttacaccttcacaaaaattaactcaaaatggaccaggaaacgaaatgtgaaaattcaagtctataaaatgtctggaagataatataggaaaaaatttaggtgaacttcgatttgacaatgactttttagacacattccaaaagcacaatacataaatgaaaaaactgacgttgaattttatcgaaattgaaaaacttgcattctgtggaaaacactgttaagagaataagaagacaggccacagactgggagaaaatatttgggaaagacatagttgataaaggactgatatccaaaatatacaaagaattcttaagactcaaagtaagcaaatgaaaaagttaattaaaaaattaatttttaaaattaacttgcaaaagacctcaacagatacctcactaaagaagacatataggccaggcacagtggctaatgcctgtaagcctagcactttgggaggccgaggcaggtgatcacttgagctcaggtgttcaagaccagcctggccaagatggagaaacctggtctctactaaaaatacaaaaattagctgactgtggtggcgcatgcttgtaagtcccagttactcaggaggctgaagtgggaggatcacttgagcccggaaatcagaggttgcagtgacctgagttgaggagtgtcactgcactccagcatgggcaacagagcgagatcctgtccaaaaaaaaaaaaaaaaagacatatagatggcaacgagtacataaaaagatactcaacatcacatgtcatcagagaatttcaaattcaagcaacaataataagctacacacttatttaataagctatgcacttattaaagtagctgaaatccagatcaaatgctggtgaggtttggagcaacaggaactctctctcattgttcatgttagtgtaaaatgactcagccactttggcagaaaatttggcagtttcttacaaaacaaaacatactcataccacacaatccagcaatcgtgttccttggtatttacccaaatgagttgaaaacttatttatacacaaaaacttgcacatgaatgtttatagatgctttattcataattgcccaaactgagaagcaaccaagatgtcctttaatatgtcctattaaaggtggtacatctcggtcctattaaaggtggtacatccatacaatggtctattatccaaaaataaaaagaaatgagctgtcaagtcaagaaaaacatggagggaactgaaatgcatattgctaagtgaaaaaatttaatgtgaagagggtacacactgcatgattcccactgcgtggtagtctggtaaaagcaaaaccatggagacagtaaaaattctggtaggaaaaggagggagggatgaataagtgaagcacagaggacttttagggcaatgaaactcctctgaatgatactatcatggtagatacatgtcattatacatttgtcaaaatccaaaccaagaatgaaagttaatgccactatggactttagttaataataatatatcaatgtcggttcatcaatagcaaaaaacacaccacactaatgcaagatgtttataataagaaaaattatggggggtggggatgctgggggtttagaggaactctgtactttctgctgaatttttctttaaacctaaaactgctctataaaataaagcctattaatttagcattttttgggtgttttaaggtctgctgtcagtgctgagacaatgccagtgaccacctgcagatggttcatgctggtggcatccttgcatcttggagctttctccagctgccagaaaatgctcaatctgtgggcagggcaggctgaaaataccatacagttaacactcacaggagtgtctccaccaataagaaaagaaaatcaggaatcaatatcccagtttcctcatccccggttgtcactctgctgaagtgttttctgcacagttgctcaaagggtcccagtgggattgagctctattacccacaacagtaacccactcaacaatgagtccttcgataactttcctgtgtccccatctcgctttcctatgtcctcgctgggcttcctgccattaccgctcaaattcgtctcagggttggctgtgggggaaacccaaaccaagacaggaccagaaccaagaaaaaaaggctcgcagcttcgcctcaggctatccacaacatttccaaatgccctttcattttctttctttctttctttctttcttagtttctcgctttcttgctttcctttttcttttttttttttttttttttgacagagtcttgctctgtcacccaggctggagtgcagtggtgtgatctcagctcactgcagcctctgcttcctgggttccagtgatcttcctgcctcagcctcgtgggtagctggaattgcagacactcaccaccatgcttggctaatttttgtatttttaatagagatggggtttcaccatgttgcccaggctggtctcgaactcctgacctcacgtgacccatccaccttggcctcccaaaatgctaggaatacaggcatgagccaccgtccctggcctcatttcttttctaattgcatgtgattttcacaagaaccaacctcagaaataagataattttttaaattttttttactgttttcctatttgaatgattgatattgttgcagttttgttttccacacttttcattgcagatgcagagtgttttaattatactatgtattgaaaagtttctcatgggctggcctgagacacaaccaactttaacactgtttctataggaaagggaattccaaatgaaaaggaacaaacttggaaaccaagtttcagaatgtgtaaattgagtgccaaaaagtttaggtggaagataccaagcaaactggcccaccactacgtgtgaccatgtctaccaactttatcttaaggttttgtttagtttttttgtttgtttttgttttttggtttttacttcttttaaatttattttgattgcttgataatagacacatttagaagcttctatcagtttccctacatctgccagcgactggcatcattccattttgcttggataattcagtagcatagcctcctgtggaaatagctgcttctggcaaaactgtttagtttatcatttaatcaaaacatttgcatagttccactcagttagaacacaaaaatgaggctgatcgtttttgcataaagacaagtcataaagtcataaagcaaaggaatgctttaaaccatgaaatgaaatttaattaaatattggaaagacaaacatttcaccatgagcagacattcttaaataatggttaaataatacacaaaagaaattacagttttacatgaaaagggtatttagtggtgactttataaatgtttccaaaaaaccatttataaacgctgggctgatgtgtcttgctgcacccaaggcattgctctcctacctttcagcacgcagttggctgtacctcatatgtatttggcctggacgtgttctcatgtgacagtagcagtgtcccctgaaaaacaccttgcaaacattcatacgctgcctagtctgtgcgatcagcaactcacagggtcacctaaaaacatactgcccctctccaggttgaggagaaaggcttggggaaaattggagaatccaagtgtcacccaacacggcggggctcagaggcactgaaagtcacttgagatgcggagggcacttggaaggctgactgggtcctgtggaccaacaagtttaagaaaggatctatcctaagggaaaaggcagtgtttctaaagtcagcatccatcccatccttttcaagtgggaaagagctgcataggaggccctttgggattcaggaaacatccagcaaggaagccaaaccgctttagacaaaatccacaaacttgagaatctgatcaggactctgggacctctatagttttcttctcagcagcctcattaagatataattcaatattatgtagttcattcaattaaagcatacaactccataatttttaatatgttgtcaaggttgtgcaaccatcatcacaatctaacctaattagaatattttcagtttccaccctcaaagaccaggcacccattagcactcactcctcataaccctcctaaccagccctgccctaatcaacgcctaaactactttctgtctctgtaaacttgcttatcctggacatctcatatatacagaatcacaaaatatgcaggcttgtgtgactggcttctttcacttagcataatgtttcaagttcatcatatcgtagcatgcgtaagtatttcatttcttttcatgccaataatgttcccttataagaatatactacatgttatgtatccatttgtcagttgatggagaattggattgtttccactttttcactgttataaataatgctgctgtgaacattcgtgtcaagttcttgtatatgtgtatgtttttaattcccttgggtataaatacctgaaagtagaattactggaacatgtagtttaacattttgagtatctactaaactgttttctacagcattcccatcagaaacagaggaggattccaattcaccgatcttgttaacactgttattgtctgtcttttttattgtagccatctagtgggtaagaaatggtatctcattgttattttgatttgcgtttccctaaggactaaaaatgttgagcaacttttcatgtgtttatcagtcatttgcatatttctttggagaaatatctgctgaagtcatttgtacttttgaacattgggttgtctttttattattgagttgtaagagttcttcatatattctggatacaagtcccttattagatgtatggtttgcagatgtcttttcccgttctgtgggttctatttttgctttctcaatagcatcatttgcagtgcaaaagtttttggttttgatatagagcaataatcttttattttctttcattgcttgtgcttttggtgtcgtatgtaagatgtccttgcttaatctaaagtcatgaagatttactcctatattttctgccaggagttttatagttttaacgtttccatttgggtctatgatccatttttagttaatgtgtgtgtatgatgtaacataggggtccttgtcattcttttgtgtgtggccatccagttgttcctgtatcttttgttgaaaagaatattctttctttattgaattgtcttggcacccttgttgaaaaacagttgactataaatctaagagtttattactggacactcaattctattcccttgacctatatgtttatccttatgccggtacaacactatctgttgtagtgtatgcaactacaaacactacctttacggtaagtttcacagtcaagaacaatgactcctccaactttttttttcaagattatttttactattctaggtcctttgcatttccatataaattttaagactagtttgtcaatttctggaaaaagctacctgggattttgctaggaattatgttgactctatagatcaatctggagagtattgccattttaacagcaacaaatccaaaacaatgggatgtctttccatttatttagattgcctttaatttcttttaacaatattttatagttttcattatacaaatttttgtacttcttttgataaatttatatctaaatattttattctttttgatgctactttaaatggaactgttttcttaattttatttttagaatccttgttcattgcaaaagaataaaaatagaattgacttttgtacattgatctttcatcctgcaatcttactcaactcatctcttatttctaatagtttttagtagattttattaggattttgtgtctataaagtcatatcatctgataatttacttcttcctttttaatctggatttttttctctctacttgtttctttcttttgttcttttttcccctgactgcctccagtccattgttacatagaagtggtgagagcagacatccttatcttgtttctgatcttagaaggaaagcattccttccttcacccttaaatatgatgttagctgcaggctttttgtaacattcctgtctagaacactgaataagtttgcccctattgctcaccagcattcttctgttttctgaagctggatgtgctcgtagcgtgttagtaaatgtataacaactggttcttcaaaacattttttgttgcatttggggatttctgtggtgtaaatactcccaccatggtttaatcaagctacaaacctgacatcactgaatacagagttgggaagagatactcagtatcacatcagtatatagtatttccactacacagatacaataaacatatataattttaagaacataaatggactgggttcccctctatttctagtttgttgaaaagtttttgtcatgaaagggtgttggatttctgtgaaaccctttttatatctattaggctttattctaccaatatagttcattgtattaattgagccctcacaatggctttctgcttctacatttgctactacatgagttgcttatttgtagaaaaccctgtataatagcatattttgctaaggaatcgaagagggaagttagaggctgaactttagttgaaaagtgtgttccagccgggtgccgtggctcacgcttgtaatcctagcactttgggaaactgtggtgggcggatcatctgacgtcaggagttcgagaccatcctggccaacatggtgaaaccccatctctactaaaaatacaaaaattagccaggcgtggtgatacacgtctgtagtcccagctactcgggaggctgaggccaagaagagtggcttgaacctgggagatggaggttgcagtgagccaagattgtgccactgcactccagcctgggcaacagagtgaggctatgcctcaaaaaataaaataaaataaatgtgttttggggggaaagagagaaagcagaaacaggaaactgatgatgtccacttcaatgatgaagggaaagtaattggaatctgtacagaaaagagccagagggacggtcaagtgggtacatagactttaagaggcatttttcacaaagtcatcattgttatagtcattaaaaataaactctgaaattacaatcaactattttatcaataatgataataagtactcaaaactcatcactgcctaattagtttgctacattttactgctacttatgctcttaaaaatatgtatgctcattgtatctgtgtagtggaaatactgtatactgatgtgatatttaatatctcttcccaactctgtactcagtgatgtcaggtttgtatcttgattaagttattgtgggagtatttacatcatagaaatcagcaactgtaacaaaaaaattttctgaagagccaactgttacacatttactagtgcaccaccactagcacactcagattaagaaaacagaagtgggatgggtgctgtggctcacccctgtaatcccatcactttgggaggctgacgtaggtggatcgcctgatgtcaggagttccagaccagcctggccagcagggtgtaaccttgtctctactaaaaatacaaaaattagtcaatcatggtggtacgcacctgtaatcccagctacttgggaggctgaggcaggagaattgcctgaacccaggaggtggaggttacagtgagccaagattgcgtcattgcactccagcctgggcaatagagggagactcagtgtcaaaaaaggaaggaaggaaggaaggaaggaaggaaggaaggaaggaaggaaggaaggaaggaaggaaggaaggaaggaaagaaaaagaaagaaagaaagaaagaaagaaagaaagaaagaaagaaagaaagaaagaaagaaagaaagaaagaaaataaaagagggatgcaggtgagcaataggaaaacattatataattttctagacaggcatgttaaagagaaatatatagctctttcctactgtttttccctgggaaggattaagaataagataaattcaattcacgaaaggtttactgaaggcaacttcctgtgtgttcagcactgtggtagaaatccagcataaatgcttagaatgatttatgcaaagggtgcctctttgtggagatggaattaaatgatccacagaagtttcttttatttcaaagaatctattcatctataaagaaatgcataatacaaggcctagtagccaagataattgtttttctccagactgttgaattgcaacatcattttcttctatttacatttaaagcattcgggtcattcaacgtttgagctccttctaagatttatataaacagatttttgaaatgcagataattgttatttgatgtagctcttccttattgctttaaaaatgacttagagaactcaaataaattaatctggagtaatcttctttttagtgatccaaagcaattgtctttcaataaaccctgtgcttataagagctgcataatccagtcggtgtccctgtctcctcttgcttttgcctgagctactgatgtgtatagcaggacacaggaagagaatcacagtcatcttaaaaaaaattattcccttcattttaatctgtcatctttgctgaacaatatcattttaagagcttaatcttgaaaacagagccacatttaatttttattttattagaaaaattctttctgtctacacaaccacaaatagtgtttagagatcccaaattaaatctgctgttgatgtgaagtggccaagctcgtggtggtgttgataggcactcaacagcactggggcatccataaaaatattcatggggcttcctcttccaaccacatgaagccagaatggacatgaaacttcttcccatttcaaatatgggaatgctgaatctagtagagaaaaaaataaattttaaaaaataagcatggatgggtgcagtcattcacatctgtaatcctagcactttgggagacctaggcaggtggattgcttgaggttaggagttcaagaccagcctgggcaacatagcaagatcctgtctctacaaaaaattttaaaatgtgcctgtggttccaagtacctgggaggctgagatgggaggattgctggagcccagtaatttgaggctgcagtgagctataatcgcaccagtgcacttccagctgggtaacagagtgagagaagaaagaaaagaaaagaaaagaaaagaaagagagaaagaagaagggagggagggaaggaaggaaggatggaaggaaggaagggagagaagaaagaaggaaggaaggcaggaagggaaggaaggaaggaagggaaagagggagggagggaggaaggaaggaaggaaaagaaagaagaagagaaagaaaggaagggagaaaagttcgactatgcagtttatctcacaagaaagaaaatgccagacacaaggaacaatcggagagtgggagtgtcaaccttgcacgatcttgctatagcatcctggggaatgagaatggtattagatgaagttataggtcaaacagccagacttggatgttaacacccacagaaagacaagatatgaggctgtgggtccaagtgttaagaccttggtataaattgggggtttctaaaggttataatgtcggttaagaggtgataaaaagttcctcccaccagccagggtaacgacaaagaggcttcttccatcaaaggatctggaaagaaaacaaaatatctttcattaggaataaaaatgccaagccagagccacatgtgagtctagaatttatactgtcctcgtgctgtaagacgcttcaaggcaagaaactcacaaaactgtaatggattaagaactaccccagaagaaataagcacacagctcttttggagaaacagcttcacaatgcatgaaatgtggggttgccacagaaaaaacaatctccaacaaaggaaggatttttttaagcaaacaaacaaaaaaaagcacagaccatgaattgaaatactttttaaaatccactacataaaaattaacatgtgaaagacattatggagtaaaaggaaaagggagatctttcactgagagaagatattttcatgtgcttagcttgtagtatattaaaatctgaatatgtaaagaaacaccacagataaagaagaaaaatacaaaaacccaattagaaagacaaaggttattgtaggggccatggtaagttgcatacctaatgtcctttctctcatcttccctgcaactttgaatcagatttgattatggtaacagtgaacatactcctggataagagtcttgcttttccagtctttcttaggtccaagggtagccatgtggcatggcataggtctggctaatgagacacaaagaaagaatctgctgagggggcttataggaaaatcatttctctccggatagaaagggggggggtggatcttactagagccatgcctccctctgccttgaaggctaatgtgatatctaaaatgatcatgtagacacaggcaagagagaaaggcccagagatggccagaggcagagggtctgccatcaatgagccattgacacagaagtgctaagtggatttaacatttgaaaatcaatcagtgtaatccaccatattaacatattgaaaaagaaaaacaatacaaacatgtcaacaaatgcagaaaaaccatttgatgataaaaaaagaattaataaacagatttattaactggtcagtcagactcattgaaggtggaaaaactcagactgtttttcctctgctcacaccacaacaatcaaccagaagacttccgtgactgaagggccatggagtttcctacacacacaaagcaagcaatcagttctgcagcagacaccaactgggtgtcctccaattcaattctgactctatctacctggagatagcatcaaatcctgcaggctgagggctcagtctctcacactaccccctcttcagacaccaatcacaagtctgggcctccagaacttctaactggttagcttcaagttgggcttcctacaaccctttcttcaggtttgataatttaccagagtggctcacagaactcagggaaacacttatgtttactggtttattataaatgatattaaggccggtcgcatgcctataatcccagcactttgggaggccaaggcaggcagatcacatgacgtcaggagctcaagaccagcctggacaatgtggtgaaaccccatctctactaaaaatacaaaattaaccggatgtggtggcgcacggctgttatcccagctacttgggaggctgagacaggagaattgcttgaacctgggaggcagaggttgcagtgagccgagatcacgccattgcactccagcctggggcataagagtgaaactccatctctaaataaacaatattacaaggtaacagataaagagacacatacggtgaggtatgtgggataggtgcagagctcccatcccctccccaagcatggcaccctccaggaacgtccacgtgttcagctatccagaagttcttcaaatcctattctcttgggtttttatggatgcttcattttgtaggcatgattgattacatcactggccatgcttctctgccttacccggagtttgaggagtagggctggaagtcccaaccctgtaatcctgccttagaggtcataggcccaattgtttctcatatatatgtctttgcagtgaccaggccccattttgaagctgcctaagggctgccaaccatcagtcaactcattgggatacaaacagacgtcacttaagcgagtctaaggattttaggagttctatgccaggaaacggggattgaagactaaatatatattttatctggcctgttgctcaggctggtctcaaactcctggcctccaggggtcctcctgtctcagtctcccaaagtgctgagactacaggtgtgagccaccactcccactcaccctgtatcttttaatatggtattttacattaattgattttcagatgttaaacaacgttgcattgctggtagatactcccacttgatcgtagtgtaatgcttattattattatttgttgctggattaagtgcgttaatatttttaaagactttttatgtgtatgttcacaagtgatattgatctgtggctttctgtacttgcaatatttttcttttggctttgttattacggtaatactggcctcatgaaatgagttgggatgtgttccttgctccttgactgtggcagaagaacaggcaagtttctaaactgtttggatgcagagcctttgactctgaaggtaggaggtagaattttatcacaatgcacgcgctaccttcccaactgagcctggcctcaggacttggaccttaggttaggggttctatgcttgacacatactagtagtgattgatagggacaggatgtttatgttctgaagtttttgtataatcctttttatttttcctccttaaatatttgaagatcttcactagtaaatccatctgagcctgggtttttcttttctttcttttttttttttttttttttttttgaggttgagttttgctcttgttgcctaggctggagtgcaatgatgcaatctcagctcactgcaacctccgcctcctgggttcaagcaattctcctgtctcagcctcctgagtagctgggattacaggtgcttgccaccaggcccagctaatttttgtatttttagtagagatggggtttcaccatgttggccaggctggtctcgaactcctgaccttaggtgatcctcccaccttggcctcccaaagtgctggaattacaggcatgagccactgtgctcggccaggtttttatttatggggcaatttaatcaccaattaaaactccttacttgattttctatttcttcttgaaacagtttcagttatgtctttctaggaatttgtccattccattatggttcttgggtttgtttgcatgcaattgtttataatatctttctaatccattcaatttctttagtctgagtgatgttccctattctgtttctaattttggaattggtgtcttctctcttttcttcttaatcagtctacctagtggtttatcaattctgttgatctttccaaagaatgaattttttatttcattgatgtttctgtattggtctttttaaaaattgacttttttctggtctgattttcattattgccttttttctttttctacttactcttgctttaattcactcctttttctagggttttggttttttatgttttgttttagtctggacactacaatgaagcaggatatttccctgacctctctgtgggtgggaactggagtgcacgggcactggaactagccactacttcagcaccgacagggcaaactccacttgcttgaacctgctgcgttccacccctcgtgggagggggacttcaggtgagcaggtgctggagccaggacgagcacttgtgggctctggcaggagcaaaactctatgcgggcctgcctcaacatctgcaaggggtacccatgacccctgaagccccagagggagtgttacagtactcctttagctctgctgtccacgggcagcctaagtgttaacagctcagtcaaccttctgccttttcgcctgaggcagctgcctcctgccagcgagggcaaagggtcagtgtgacagccttttacatccacactcgtgacacccaagctcttgtccagcgtccaggaaaaataaggtcacatgaacaaattgaaggatggtaaatgtcagggatttattgccgatggaagtggctctcagcaggaaggggatctgaaaaagggacagagtgggaaggtaatctcctgatgtccagccttctccggccagattcttccctaaagttacactatcaagctgtccctctgaagtcaagctgcttctctctgatgttcagccatagtctctgatatccagtggcttctcctctctctgctggctgagcctggggtttttatagacacaggatgggatggggtaggggtatgggtggttttggaaaaggcaacatttgatggggaaaacagggatgtaagttctcactttgggcagtggtttcaggctttttggcttgaaggtgggacccttgctgagcactcaccatcttctgtccagaatttccctgcatcctgtccctatcaatcactactagtatgtgtcaagcatagaacccctaacttaaggtccaagtcctgaggccaggctcagttgcgagggtagcatgtgcattgtgataaaatcctacctcctgccttcagagtcaaaggctctgcatccaaacagtttagaatctttcctattcttctgccacagtcaaaagaggatccacagccccgtgtggccctctcccttctgtgctcacaacccttcaaggcaccctgctgcggagttaagcacaactttttttcctgaccttgggcagctggcagctccccaccccatgccctcacagaagcctagggcttccctctccaggatcaggcattccttccatcccccaccctcctaaatttaggacagggatgctttagtgccactgtctctcttccgggactgaccacacttcattccaaataggaaaagatagaggggaaaaaagggaggggcgggagacctggatgctggagagttaccccctacaagctgccctcagggaccaggtgcccaatgccccacggactgcagtgaacccagagggagccctcagtgcccagagggagccctcagacccctgctttgcttgccccctgggctccatgcccttgattctcaggccagagaggaaagggtcccttccctctcactctggcagctggtggagggtaggatgcagcactgagccctttttctagcttcttgatgaggaagcttgttattcttttttaaaactttcttttttcaaatataggagtttaaacctataaatttccccctaagcactgatggcatcctataaattttgaaatgtggtactttcattttcattcaatttgagatatttttaattttgtttgtgattccttctttgatccatgaatacttggaaactggtagtttagtttccaaatgtgtaaccgttttccatatttatttctcttgttgattgctaatttaatttttagtcacagaacatttgcattattgtaagccctttacattttttgaaacttgcttgataagctaaaaaaaaaagatctccccaaaggtattcatttcctaatccctgaaacctgtgaatgtgacactatatggaaatagggtctttgtaggtgtgattaaattaaggatctcaagatttaagtcatgcagccacaagccaaggaatgctgccagcctccagaagccagaatttgccaggaagggatcatcctctagagcctctgcaggaagtgcagccctgctgacttctggatttcagcccagtaatactgatttcagactggaagtttggaattctggagtccagacttgggagaggatacatttctgttgttttaggccaccacatttgtggcaactggttacaacagccacaggaaactaatgcaactcgtttcatggcttagaatagggtctagggtctattctgtagcacagcggtccccaacttttttggcaccggggaccagtttcatggaagacaattttcccacaaacgggtggagtgggtgttgtgggatagaggtggtggatggtttcaggatgaaactattccacctcagatcatcacatattaggttctcataaggaacacacaacctagatccctcacatatgccgttcacaatagggttcgtgctcccacgagaatctaatgccaccactcatctgacaggaggtggagctcaggcagtaatgcacacccgccgcttacctcctgcggtgcagcctggttcctaacaggccacagactgggactggttcctgccaggggttggaaatcactgctgtaggatgttccttgaagtccaggaaagaatgtgcattctgttttggggtagcgtgttccatatatgtcccttaggtcaagttggttgatagtgttgttcaagtcttctatacccttcttgactttatgaattgctgttctatcaatatttgaaagactataattaaaatctccgactttatttctgctctcaattctatcagtccttgcttcatgtattttgagacccagtgttaggtgcatttacatttataattgctatatctttctgatatgtttaccctcttataattgtgaaatgccttctcttctcttgtgatttttcttctttcaaaatcagtttcatctgatattagtatagctaatccagctctctttgcctactgtctgcctagtgtacattgtgtcatccttttattatctacctacttgtttctatgaatctaaaatgtgtctcttatagatagcctatagttgcatggtttcagggtgaaactattccacctcagatggaagtctgtgacatctgcaaaagatgtcctaggagagaaagtgggagagagagagagggcatagattcaattgtttctcatacagacatgtctgtaatttccacaattactgccctaccctgcaattcagttggtttcccaacatccagcagttctcctgcttagcttctccagtgaataatactcatctcatctataggggcagtggttggaggacctggaggagtgacttgcctgagtgtggagggtgaaggtgttctagagtctgactgttccacagtctccagccagccctcattaatccagctgaccactgtatgtactgcctcaaattcctgagcatttcacaagttctgcaaggcagaacactctcttcccattagcctcaatctctacaggcaccatggattgtaaatttcttcccccttctaaaccagttgtatcatctgatttttctctcccaaaaatctgttgaaattcctttttttccccatcatcttctgcacattgcttccacctcatgatcaaaacgactgctcaaattctggctactacatctgcatttcattcagcaggaaagagagggaaataagaaggacattccatcctcttaaagactcttcctggaagttacttgcaacattctgctaccttctccttgaccaagtcctacccacatggccacactaaacgcagtggaggctgagaaatgtggtcttcattcaagacagcatgtgtctaactaaaagttgtgagtctatagccaaaggaaaagggaagacagagattggtggacgtttctgtcacactcaagacaatacaatgtttcaaaaaaaaaaaaattaaacaagctcataaaaagaatggctgttcattgaaattacccacattaggccatctcaggtgagtagcaactaatagtgcctattaagtatctaataaatatttgtcaggtatttatttgtctgaatggatgaacctgaatcaaccatcagcctgagagaggggtggctttctgtttactatgacccacgacaggtgacaacatccatttttttcttttactgagtttatcaacaaacagaaaacctcaacctgcttctgacatcatatgccagctttgcatcttgctactatattatacctggtcttaaacctccaggcacactaaccggtgccaagtagaaagactggagagaacaaagagaaaaatcaggaaacagcaagaagtctttgactcacatgtaccaacaaagcctctcccaacacagagaaatggtgataacgtaatcacaggcatgctagccattgttccagtggacttgaagccaaagccgggattaaataaatggctggcatttttcaaagaaccagaggcagcactgtttaaaagagctgacagctgtgagatagagtattcttattacagaggcttagcggggagacttaaagtaaacctttccaccagcagagcactctcaaatgggagaaaaagtagaaaagctccctctatgagagcagaaaaatgcacgaggatataggcatggttctggggctgtcataaagatgtgagaagaccttagtaaaatatcttcaatgttattaaaaccttactctttagaggtaagaagaaatatggggggcaaaaataaagagggaacaaaaaggaacagtgttttgtttaacccatggagatgcaagttaaaatttggatgagtctacgtagcttttctttgtacttcccataaagatcaaaataaaggttctttgttcatcctgaaaatatgcattgaacggaaatattgataggaccctacattctagtgatggcaagaaaggtaactaggaagtgagcacacagactgtttcagtagtaatggcggctagaaaaaggcaccaattgggcagtaggagacagaggggtgattagtggggtaagctgctttagacagtggggccaagacaagaatctctggggaaatgcctttcaagtagacacttgaagtgtaagaagaagctagtctcatggccaggaagtatgaatggggtggagtgaggacggagtgaatttcaggccgcagggtgagcaaggcatggggggtggggctgggaacgctcgctgttgtttgttggtgagctgaggccccagtgctgtggcatgtgtgtggcccatgtgagacaggagaaggaggaaggaggcacatccaggaaagatgtgctggccatgggaagggatcccatgctgggagcattggaagccatcagagggaatgaggtcaggtagtgtcattaacatttacattgcacacaggtcactgtggctactgggtggaggatgagcagaggagacagattagggaaatgagctcgagggctgttgcagtagctgaggtcagagggagtatggctttgctgagtagttgtaaaatggaaagatggagaaagaaatgagagatactagtggaagtacaaaaggacttggaggttgatatggtttggctctgtgtccccaccgaaatctcatcttgtagctcccataattcccacatgttgtgggacggacccagtgggagataactgaaccatgggggcaggtctttcctgtgctgtacccatgatagtgaataagtatcatgagatctgatggttttaaaaacggaagtttccctacacaagctctctctctttgcctgccaccatctaagtaagatgtgacttgctcctccttgccttctgccactgtgaggcctccccggccatgcggaactgtgagtccattaaacctctttcttgtgtaaattgcccagtctccagtatgtctttatcagcagcatgaaaacagactaatgcaatggtggagatgaaaactttgttatacagctgccattgaaaatactagatttaaggccaggcacggtggctcatgcctgtaatcccagcactttgggaagccaagacacatggattgcttgagctcaggagtttgagaccagcctgggcaacacggtgaaatcccatctttactttaaaaaaatacaaaaattagccaacatgttggtgcatgcctgtagtcccagttactcagtggggctgaggcaggaggatcacctgagccttgggaggtcgaggctgcagtgagccatgattgtgccactgtactccagcctgggcaacagagtgagaccctgtctcaaaaaacaaaacaaaacaaataaaacctagatttattatcctgtttgatacctgaaaacacctgtgtgaagccacaatataaaaaaaaagaagtcccacaggcaataacctcctatgttagtagggaactggcatcagcattttagagtcacgtctcatacttaaccaaatgaggaaaaattaaaatttagtaagtatgatttatcatgatatggtagacctgttacagaaaataacaaccataagtgagaagtgttattaccaggcacaggagcccaggtgttcttgtgtgtgtgtgtctgtgtctgtctgagtgtgtgtctgagagacttaggattctctagaatatgaggcctatagcaggggtccttcctgtctggatctaaaggcaatactatttatagatgccccccaaaaggagatgggaggcagatagagcttcctggttttctgatgtttttgcccctcaagtggcaaaaagaaaagtataacaaagattatcttccttgaccaaatttgtcagtttcgtcaagcctgaccaggccctgttcttggccatgtatgcccaattttagcaagaatctttctaaattagtttaaccagaacctcccaacttcaagaactgatggccatcagttctcatcctctaccaccccaggtgatgtctggtcatcctgagttgcctttagcaagaatcatgtttggctggtttagccagaatccccatcacccctgatgtttcttcttaggaacttttcactcactgacccccatcttttttctcggctataaattctcacttttccttatttatgttctgaattaaggtctcttttcccctattgcaatagttcctgattaaaatctgttttcactcttttaactactgtcgggctctgggttttgggtttgtttgttttctggtttgggggttggtttgtttgtttgcttgtttgtttgtttgttttgacacggggtctcactatattgcccaggctggcctcgaattcctgggctcaagtgatcctaccagcttggcctcccaagaaactgagagtacaggcaagtgccaccacactgaacaggctctgggtgattttgttttttgtttttttggacaaatgcgtacaatgggtcctgcaaaaaaatgagaacaacaaatcacaaacatgcattgaacacctactatttatttaccactgtccttggatgaggagaacataatacaagcagttttgtgatgtaactggagacaaaggatgagtctttttttttttttgagaccaagtttcactcttgttgcccaggctggagtacaatggtgtgcaatctcggctcaccgtaagctccgcttcccgggttcaagcgattctcctgcctcagcctcccgagtagctgggattacaggcatgtgcaacacacgcggctaattttgtatttttagtagagacggggtttctccatgttggtcaggctggtctcgaactcctgacctcaggtgatccgtctgcctcggcctcccaaactgctgggattacaggcgtaagccacaatgcccagcaaggataagtcttaaagtgagggactacttcctagctccatgtcaccatcagattctatgcaataattgcacctactctgtacccaaaagaaaattggcaaccaagaaagtgctaagttgtgcggaatagagaaaaagccaattatgtgattcaaacgctgcatgcaaaggcttaaagaaaggaagaattccacaggctgtaggagttccttggctgccttcaaggaaaaagatgtagaaaaggatgctgagttggatgagatgcggctaaccgtgaaaggacatgggaaggggtcattttttcaaagaaaaaatgttattaatagaaatgtatgaaaataaacactaaggagactgcttagccatgttatccttacaaccataaatttccacccgggtacttcccatttaaatccatatctccccacggaaggtggaattctgattcctttgttattccaacagctgtgtttatcaagcacggactgcagggattctcatcctgcagactgactttgcatcccgtaaggtaactgctatgtgtaccccccaaattaatatgctgtggccccctacaaatttatatgttgaagtcctaccctccagtacctaagaatgagaccttacttggaaagaggtctttacaaagttatttataaggttaactggagttattaggttggccctaatccagtgtgactggtgtccttgtaagaggaggaaatcaggacacacacacgcagaaggacaatcatgtgaggatggagaaggcggctgtttacaagacaaggaaagaggcctggaacagattctccctcacggcctcggcaggaaccaactgggatgacagcttgacccccaacttcaggcctccagaagtgtgacacataatccatttctgtcatttaagatgcctgcctagtctgtggtactttgttatagaagccctaggagaccaacatagaaaccaacacttccaatctgattttatttattttatttatttatgttagagacagagtcttgctctgttgcccaggctggggtgcagtggtgtgatcacagctcactgcagcttccaactcctgggctcaagtgatcttcccacctcagccccctgagtagttgggactagaggcacatgacatcacctctataatttttgcattttttttttttttttgaggagacagggtctcactttgttgcccagattggtcttaaactcctagcctcaagtgatccttccaccttggcctccaaaatgctgggattacaggcgtgagccatcttgcccagcccagtcctgaagaccattctgtctgcagtggaaaagggtcaggactagtagaactttgctatctattatttctcatatttatcaaaactgccctccaactatagaattaagaattggttttctccagaggaccactggaaatgtttcagaaacccatagtttactcttcttttgtgaaatacattgcaagataatgaaatcctttcctggacacccagctggcttgtgcgtgaagtgattatgtgtgcccttcacctcatcttttcctcaccaaaggcgagaaaaagggtagatggggaagagagaaacaacgaagtcacttttaatgaaatgcttgaaataggcctattctgaataaggctgttcaaatgtagacactatattctgtagttatatttcacattgtcctgagttccctgatggcacttcttgctcaaagtccaagacttggccctcagatgtgaccctgttgagcctgggcttcacaaacagtcaaatttgagcagagtgttaaaatattgtaattatccggaaaataattcttggtggaaaacattctgtcttttaaaatgggagggctctggactgctgaataggacattctgcatctcagtggtgtgaaactaactggcttggggctgccccttaccttgaatccctgcagaatgaacgcacgctggctgaggagtgctatctctgtaacatccagccagtctcagccagtctccggcagctgactaattaaactacacccaaataaggcaaacgctgaacatagccaatccagctacttctgtgcctcacttttctttctctgaacttctgctggttctgagggctgcccaatttgccagtcttctttgctcaaataaactctgttaaattgaatttgtctaaagtatttattttaacaatggtgaaggagggctagatgttagctccctgtcttccctgtagataacaagcagatggcttcccaatttgggatgcgtgcctaatgagagacaatagggcctgggaagacagtttggtcccacgaggaatcttttcaccaaaattgcaggagttcatgccaggcacccgggagttcatgccagttattagggtggccctaatccagtgtgactggtgtccttataagaagaggaaattaggacacacacaggaataacgacatgaaatacacgacttgaatgctattactgtgtttattctcataaagaaaaaaagtaagttctattccttgctgccaccagaacttaagcattatacctttcagggagaaagggatcggggaaaatctggagctaggatgcaagacagttaaagaactgcctgtggcaaccttttccccaagcaagaagacccactgtgcctctgcaggccagaacaaagctctgcaaagcacaaaagcaatggagtcaggggtggatgcaaacaccctccttggcagtgtcgctggaaaattcaccaccatcatccccttgactagctgcacgagagctccaaatcttgggggcaagttccaacactcacttgccatctaggagacatcagagacctactttgcctgaaatcgctcattgggcaattaatggtgctcctaaggattcatttatgaactcacgattcctggcagtgcttgtttggcaaaagctgtttgttcccaggagccagagacagctctcagtagccagggctgattcaaaattgcatcctgggaagttcccgttcataaatggggttccccagagaacagaccaaaggaatcctggaactcccacagggtggagagttctctggaatcctcaggttgcctttatatgtctttctggctttgctccatacgggtaaggaaaagctgatgggctactcccagcaagcaaggggctgggagacaaagtgtggcagagccctgggtgtcctcctcctgtacagaccttgggcagtctgctcagaaggggccaggacatcaggaaagctgaattgattttattctaatctgtatgatactacatggtgattgcatcaatatacatttgtcaaaacccatagaatctacaacaccaagggtgaactctcatgtaaactatggactttgggtgataataatgtgtcagtgtaggttcagcaattttacaagtgtgccgctctgctgtgggaagtccgtagtcagggaggttgtgcatctgtgagaatagcaggatatatgggaactctctggactttccactcaggattcctgtgaacctaaatctactctagaaataaagtttattgatttaaaaagctcatatgctgatttccactctgggctttatacgacttttctgtctaatttctttacaatgctttattctttttttacaaaccttaatttgaactaatatatattttcaatcttagtttagtagtgcatttcaagtttataaatattctcttcatgtaacactttagctgcaaggcacacatttttatttttggtatcttcttgttgttataaatacttaagaatctctattgttattttctctttagtatgtgacttatatttaggtttacatttttaattcttattattttccctttagttatattgaagttggagcacatggtttctatgacatatactctgaattcagttttttggggggaaatagcatatgattggtttttataagtattctacataaccttaaaaggaatatagattctctagctactgagtgcaacagtctatcctgagtctagctactcaggtggctgatgcaggaggatcacttgagccaggagttggaagctgcagtgagctgggatcacacacactgcttgggtgtttgtatcgaatcaagcttattaattttatagcccaaatcttctactgcctgactaatcatgtaactgatatggcagtttgtgatataattttaccaaaatatcccacttttctctttcttcttgtaattatgtcaattttttacttcatatatttcaaagctatgttgatgagtgcatataaattcatggctgttattacttcttggtatattattccttttttcataatgtattatctattttaatccctatttatgctctctgccaaattctattttgcctgttagaaatattgctgcataagctttcttttaattgcgacttgtctggtatatctggaaacctgaatttaaatcctggctctgattttaactcgttatgcattaggtggaaggctgagacaagccactcaaccacaatttccttactggtgagattaaaatgctgggctggacagatcccaacacctccagctctgacatcctgttagcagcctgttcagcagtcaccacaggggctggttagcacctcctccctggcccttctcagccctgcagcaccaacctcctaccagagatgtctgcatggggtggtgtagtcatatattcttttctttgtaaggttaaactcctctgaaatggaacttggggaaactgtcttctacagcaggctcagggatctcctccttgacattatctagtcctcagtttcaacatattttattttctgactaatcttgtcttgatatggggggaaatcaaatttaccatgaagctccccagtttctgttagctcagtttgaacctctcctttaggttttaccaggctctttaaggcacagactgagtcttctgcagacactctagctatcagagacgctcctgtcttccgagcagccggctcacccatttctctgtcccaaatggcatctaggtgcagggaggcacatcccagcctcgaggcattggaggagcctgctgctccagattagctgcccactgcctagctgtctcaccctggtctctggctccacttgctctgcagctacctgtactcccccatgctgcacaaatggggctcagacgatgctcctgggaggtccccatctcagcccctgggggcacaaatccttcagggtctgtgtgcaactcccactgggtcccaccctcagctcctactctggggtccctgtgcaccttgttctggtgcccttgaaagctccaaccagcaatctcaggcacagtccctgtcctgtggcttccacagagaaaaggccccaggctaggccatcatctgaagcttcactcttagccattgctgcttggccatggctgtcttgggaagttccaaataggagcagggataagcccacactacattgcactccacctcactccatttggggtctataccttctcacggagggctgataacatcctcaccttggccctgtccttccctacaaacctccctctccaatccatccccctgcccacctggaggcatgagaccccctcctcggcctccctgttgagggattcccctgtgcagagcctcagatctctctgcctgggctaagagggcatgtatggtcagaactgctcatcttcactctttatatatgatggcaagtttgggaattccaaactctgtctctctctccacaaagctgggcttgctttctcaccaagtgcttcaagagtttatcttagaagttaaaagctagacattgcctctttctctttgttttcatccataaaatgtctaatcttccccagataacataaggccctggctgaagaagaagatcacattgaagaaggtagaaagaacaggtgcatcaatattttttcaaacatttgctatcctgccatctagaaaagggagatttacttcttttttttttttttttttgacggagtctcatactgtcaccaggctggagtgcagtggcacaatctcggctcaccacaacctccgcctctctggttcaagcaattctcctgcctcagcctcccaagtagctgggactacaggtgcgtgccaccacacctggctaatttttgtattcttagtagagatggggtttcaccatgttggccaggatggtcttgatctctcgacctcataatccacccacctcggccttccacagtgctgagattacaggcgtgagccaccacgctaggctgcttttacttctttaaggggttcaaaagcctcattctgttgattggcagagagggacattgaggtgttctgggaaaaaccccttccctcatgccttatttcatgggtttagacacatggagaagagactatattataggacatcatctgtggtccctaaataggtgtgttctttcagggaagaacacctttgtggaaatatttttaccattttggcactttatgtcatgctatattgccacatactttctactcctacagtaattatgattatccacacactaaggggaaccagagctagtttttaatagccaataaaggataatgttagcattaacggcgctggcttggaaaaaagcctggctgtgcttggatcctaagggtcccagcgagaccttcttctcccctttatttcagacagctggggctcccccactcttatgcccctgaagctgggcttgtgggttacccaactggcttgcttttcaagactgtgcactaggaaatcggtagaatttctctgtgccctggtctcagtccaataagagatgatgagtgtaaaatatccggcacttattagaggtgggtaaataggaaaacactgacatttgccctgtgaatttggcaaagcaggaaagtttattctcctcacccgtggaaactgtacaataacaaatgcttattgttttaagctgctgtttgtggtcgttttttcagcaacagaaaacgaatccactggaaattggaattctagtgctttttgaactctttatcgccccgcctcccattttttaatggataggaaaggtggaaacactcatcacgtgtatcttgtgtacgcactagggaaagtttaacagttgctatgagaacttgcttggacccctgcctttccagccttcctctatgtagttatcagagtataatagacaggacctggacagacccagtaagacagacctttactgctttcatggagaggcaagagatgggagtcacccgaggcatggggaatatttccttggcttgaatgactcagcattgtcctcccatttgaggtccaagaagaggaattatatattttttaatatttttctttcatcactagtactatactgaatgataaaaagaatgagatggatgaatagatggatggatggaaggatgactgggtgaatagatgggtggatgactggatggatggatggaggatggaaggatgagtggatgagtgggtggaggttggatggatggatggatgggtgggtggaggatggatggatgagtggatgagtgggtggaggatggatggatagatgggtggatgggtggaggatggatggatgagtggatgagtgggtggaggttggatggatggatggatggatgggtggatgggtgggtggatggataggtaggtggatgcatgggtggatgagtggatgaatgggtgaatggatggaggatgaatgctgggtggatgagtgaattgagtagatgggtggatggttgaatagatagatgggtgggtgaatggatagatggatggataatgaatgatgaatggatttatggaggtcaagcatgctgttagtctcttgtgagcttgggcccattctaggacctggacttacattttgtttctgtaatggaaatgtgtccctgcccttgcccttgccagcctcctcacctatacccctaaaggtgcaaggctgccagagagcctgtcttgattactgcatcttccctattcctggatcctggatcccaacctgagctgaacagccatgtcttggagccttggctgccattaactgtggtcttacaaatttcctccatggatgaccttggggttaaacctagtttctgcttcccctccatcctcatgggtctgcagttctcaggaatccctctcccctgacctggcttgtctaactgttgcccacccactcccctccctgacaggtgctgtaaaacgtagtctcagcaggcatgcaccacgccatatgggatattgtagaatagtgtggttactattttggggaatacgctcacatactattttggggaatacacttgcagaaacacgatgatggcagccacctccgggtggcttgcatggaagcaggaaaaagtgtttccagctcctacgcttggctcctacgtgctccattgcataggcaaggtcgggggactgtgagctcaccagggaaactgctgtagaatgggattagcccctcaggttttattgaggtgggtatgctgagctacctgacttgctcttttggcaaagttgaggtctcgtggggccatcttggacagctgtctgggcagctgtggaagtggacagtgccctggtctcaggggaggagggtgtcgtgagctgcttcagcccagggctccccgtcactgccacctggcaaggtgggagagctaagcaggccctcaggagcacacactaaagccaagcaaaagcacatgggttcatcaaagccacatgaaaatcgaagaggctggagttgggtttcctccccaatcccacatgaagcacaatgctggaaaagtcattgtgaggagctttatagtcttttttaaaaaattcatgaagattacataattttcagttaaaatatcattttcagcccgagattaatgtgcttctcaggacagggccacttcttaaaggcctagcactaaaaattgcatccatttttgtctatcagattctgctttagatgcattttttcaactgtccctaataacagttctgtgggtgggttattaatattactcccatttaccagtgaaaacaaatgagcggggccacacagctagttaacagcagaaccagggttcaaagtgtgcccggacagctccacagggcaagatgctggtggtgcgacaccctgcaggtcgaactaaggaggcaagaggctcatcgggacctggtgacttcacatggatgttgctgctgggaagagctttcttgcttgtttcagttcaattctcagccccatatcctggctggggtggtgccagaggcccccaggtttgggtgttctcagagctagcaccccatgccatctggcatttggctctgtgaatgtgtgggtgctatttaacctaacctctgcttctcacatgtaacatgggaaagctagcagtacctacatctcataccgtggctgtgaagaaggcacgtttataaagtacctaagccagtgcctgacacaaaataagcactaaataattgttagctgtggttattaatcatgcaacagatgttggttttgttgaagaaaaggtgtccttaatggttagtccctacaggaaaaagccctggacacctgatctgaacagcaacttgttatgattgatgttccacggctgagcacagggttggagacagatcacgtgggtgctgtggatgccgtggatgatggtgatgatgcaggaaatgctgtgttgcctcgacagacttggggcttgagatactactcagcagccctgtcagagacgtcagtgagcacatcagtcttcttttttttcctttttttttttttttaaagacaggatctcattgttgcccaggctggggtgtaatggtgaggtcataactcactgcagccttgaacttctgggctcaagcgatcctcccacctcagcctctcaagtagctggcattacaggtatgtgccactacacctgacttatttatttatttatttatttatttatttatttatttatttatttatttatttattttgagatggagtctccctctgtcgcccaggctggagtgcagtggtgcgatcttggctcactgcaacctctgcttcccgggttcaagcaattctcctgcctcagcctcccgagtagctgaaattacaggtgtctgccaccacagccggatactttttctatttttagtagtgacggggtttcaccatattggccaggctggcctcaaactcccgacctcaagtgatccgcctgcctcggcctcccaaagtgctgggattacaggtgtgagccaccatgctcagcccaatttttaaaaatttttgtagagatggggtctcattatgttgcccaggctgatcttgaactcctggcctcaaataatcctcccacctcacctctcaaagtgctgggattataggcgtgagccaccatgtctgacccaaataagtcttcatgatgacaaaccttgaatgtatcagcccaaaacaactttctgctagatgggggcactctttactacaatatctgtcaggatgaaatgtacatggccatttccccagccaatgcagaagcgctcacagcttgttttctgtatgtgaatgttaatggtgtctctgctggatgaaacacgggttgcagagtgtgtaaagcaagcccctgcagaacctggagggactactcaacacggggtggtgctttacaaagagcgctttgatgtggtcggccacagtcagagctgcccagcagcctctcctgtggcgtctccagtggcatcgcacacacccaagcctgatgtgctgttctcatctttggagcgaatcctagcttatagaatgctctggaaatgttgccagagaatgatgaaaggtgttaatttgactattaaaactcaacaaaagggcctccttgttaataaaggacaatttcagacaggaaagaaactaaaacaacatcgaaactgctactgaagtcatccaactttacagagtgtcttagagggagtcgcatttcttatacagaatcaatactaaaaatagcaatgaaaacaagttggtgccttcttcaaactacacacagtaacttgaggatatcggttctttgggtctgagagtcccaaccaaacactagggcaaggctataagtcagtgccttgttcactcagtatcccataaaatgctccttcatccacacttttggtttttctcccctcatgctcccacttagactagtggtggacattgggcagaggagggctctggccaaatcccccctctactctaccccagcttgtggggctgagcaatttgtccatgcccctgagtcccagctccctgtgtaacagggaacaatagtactagagttgctgggatgactcagtaagacgaaggggagaactagcatctatgtaaaatgcttagtacagtgcttggcaagttctgtctttgacaaacgttagttgctgttatattgttgttgttattgctgtcattgttattattattattgttagtagtagtagtagtcaattcttccagacaatcatcccacctttctggccagcttgactctggtgaggcactttgtgaacattcagaggtgactgctctatgctgcactcaggtcaggcccagtaggattctaaccatttccatccgttcattgagatgtttatcaagagtcgaacgtggcatggaattgacacacgagtgttttagaagcgactctctaatagtataaattgaatattcaaaaaaacgacagtatgttttctcactggagaccttaattaaagaagtgtcttactgactgtttcgtaaatgaatctcgcttcttacgtgaaagccctggataataggtgcgtagcaccgggatggagaaatctctcttaggcctcatcaaccaagtgttcctggaataactgatgggctccaaagtgcagtactgacaacacagggaaatttggggctgtgacttcttagtcgggtggaaaggagaaagaaaaaagcattcctcttcatttctgaatgcctcaacctaaaccaaacagttcagttttagaaggctgtagagtcaggcttaatgaagtctacaaatgaccaatgtgtagaatgctgagaaaaattctccaagagttttttaaaatgcagttatgatattatttaagtatttgagttttaaaacaagcaataaaatatccatttttggccaggtacagtggctcacacctgtaatcctagcactctgggaggccaaggcaggtggaccacctgaggtcaggagttcaagaccagcctggccaacatgatgaaaccctgtctccactaaaaatacaaaaattagccgggtatggtggcgcatgcctgtaatcccgactacttgggaggctgaggcaggagaatcgcttgaacctgggaggtggaggttgcagtgagctgagattgcaccactgcactccagcctgggtgacagagccagactctgtctccaaaatatatatatgtatatatatatgtatattttggatatatataatatatatcccagatgtctcctggctcctgcctgcccatgtcgacatgagactccacagggataaaatgcaacagaggtctctgcattttctgtaatttaatcctctgcggatctattgtatataatatatatataatatatatatttttttttcatttttgacctggccttcctttcttcttattttccttcattcgttatatcgtttttccctcccacaggtttttcattaactagcccaggagttcttaacttttgtttttaactctctttaggccacagactaatattttgaattccatgaaaggaatggagtttctccccagaaaagtgaacaaacgcacaatgcggacctcctggaacctctgagcactcagctagatagacagatggtaggtaggtaggtatatagataggaagagggcaggtaagtaagtggagagacagatagtgggtaggtagatagaagacaggtagaggacaggtagataggtaggtagatgatagatagatatgcatatgataggtaggtagacagatacactggtagatagatgataggtagacaaagagatagacagatgataggtagataggtagatttatttcaaggaatggctcatgcagttacggaagctgacaaccccaaaatctgggagtgggccagcaggcaagagactcagggaagagtcgatggtgcagtttacgtccaaaggctcttacagagacaccgtgaataatatgtgaccactcattcgggcactgtggttcagatatgtccacacataacgtgaaccatcataaggggccagggcctgggatcagagaaccaggaatcagtccagccagggccagcatccttgatacttcttttcttcccctgggctcctcagcccttgctcactgtattaactggcttccccttgacgttctctcccccatgtgagtgggaggcttgccaagagaaagtccctgacgcaggggtttcccaacacatgatgaagccatcttcaggaaagcaggtcaggcactagcgtgagttttatttgttatttgtgtattgcttttggcaaacgacagagcaggccaatcctgggtgtagaattggcacaactccacatcccccaccctcaccatcatggcagtagcccaggttcccacaccagagggagcacagagttctgacggggctccctgcagcctgctttggaggaggcggcttccccggggctggtttctaagcagcacatcgcccattccagcaagaactgggagtgctggggggacactggacctcaaatgatgtatgtgtgagtggcaagagggtgttgtcgtggcctcgaggagatgacagattccgggaggggacagccattcctgcggctgccaggtcaggaggcgaccctcacaactgcttggcgctgtggagggagcagggggcagtgccagctcgttccacccatgtagttctggggacttgtccctaatggatgtttgagtggggaggggtcttcctgcctccacccatcagtgtctgtgaccacaggccctttctgtggccagacactcattgcagccctggcaaaggacagctgagtcagggcattggttcatatcgaacagatgccatcacggactccgttcactctcagtattttcaggtgtccccaagggcccaccccagcctcttggtgaagagggacccaacctgagcccagcccccagagctcctggacatctcctggctcctgcctgcccatgtcaacatgagactccacagggataaaatgcaacagaggtctcattgcattttctgtaatttaatcctctgcagctctttgggggcagttgttaaatggaaatggaaatcaaaacaaaataaaacaaaaagtgccccacatttcctaacagacaacgttgccagggtacacctacttgggaaataagatttttttttttaatccttctttttcacctggacactgtgtccctcaagcctatgggagattactcaacttcctgaaagaaaatgttgagccagaattatgcagagattcagaagtataagggaaagaaacgcaacgcactcaggtatctcagtgaaagctacaagggttaggaactccgtcccctccacatcagaatgctctgaggtgtcagcccagagcatcatcgcatagccacagaagggaacgttaggcagaggcccctccctagccatgttggcctcacaatccccaccagcccatgcctgtgaaggagacagacactgtccaatatatacgtgcccagtaccaccaggccctgtcctttttcttactctctcctgatcctgcaaaaatgatgaaggagaggcataggtgtgtcttgactgtcagtgatgatgggacattctacagtctcatcaattcctaagcctcaggggaccgtggacacagcctgatcctgcctgcgtcctcccacagctccatgcctgctcccagtgtgcttccagaacagcagttttttgttttttgtttttttgacaggatcttgctctatcacccaggctggagtgcaatgacacaatcatagctcactgcagcctcgacctcctgggctcaagtgatcctcccacctcagcctcccaagtagctgggaatacaggtgcgcaccaccatgcccagctaatatatatggagatggggctttgccatgttgcccagtctggtctcaaactcctggactcaagtgatccaccagcctcagcctcagaacagcagctttgacactcggagagccagggctctcaagatgtatatgtcctggcccagcagcttcgacatcccagggggcacgggttagaaaagcatgctgtggggccctccccaggctcgctaagtcaggacctccaggtggaccagcctctgtgctctcacagccccctcacctgctacccccactcgcagagcattctgctgcttctcaagccagagcctgccttgggggtgagcttcagggattgctgacagggagctttggctctgggaacctcccctcaggatgaccttagaaagggctgcccacaacagccaactattggtttaatttttttcttaaggagaaagacgaccgcacaaggcctaggtctccccaacaggcctgcttgaatctgagggctcatcctcgttccctagatggcaagttgaaccctggcccaggcagcccctgtgagcaccacctgggtctatacctgagccagctccactccgtctcactcagcctgctcttgagggttgtcggctttaggatgcaaggagtttgcagagcacacccactgacttgggggttcccaaagggaacactttggcagaagaggcacagaaacccgatccccacaccacgaggattcctccctccttccctttttattcttcccttctccctttcttccttccttccctctctcctttcttccttccttccctctctccttccttccttccttctctccttccttcgttctctccttccttccttctttccttccttccttctctcctttcttccttccctctttccttcatttcttccttccttctttccctctctccttccttccttctttcctcccttcctctcttccttcctttctttcttccttccttcctttttttgacagagaataaatcaagcaaaaaatacagtgacacagctcctgcacactgctgagagcacattaaccttctgcggttgcttccgcttcttacgtagagcttcataagcagggctgaaaatcccacaccacatgcccggcctccatggaacccttctccttaagtttgtgtggctttacagatccacgtttttatacctttccctcactattatgcatccaaagccaaggtatagcattctgttgtgtgttttacatttttacacaggtgtgcattgccttgcaatgatttacttttctttcttttcttttcttttcttttttttttgagacagagtcttgctcttttgcccaggctggagtgcagtggtgaaatcttggctcactacaacctctgcccccggggttcaagcaattcttgtgcctcagcctcccaagtaactgggaggactgtcattctgttgagtcattttgcaatgtttagggagagactcagcagcaaattcggtacaggagtactgaattttctgtgccaactgggacacacaccaccacacccggctaatctttgtatttttagtagggacgaggcttcgccatattgcccaggctggtctcgaattcctggcctcaagtgatctgcctgcctcggtctcccaaagtgctgggattacaggtgtgagccacctcagccagcctaccttttttatttaacaactttttttcaagattagtttatgttgttacattcattttcactgattaacattattttattgtatgaatatacaacaatttatctgtccaagtccctatagatggacaacaaatcggcttccagatttttgctgttacaaatacaatcattcaccacataacgttttggtcaacgatggactgcacgtatgacagtggtcctataagattataataccttttctatgtttagatacacaaatacttaccattgtgttacagctgcttacagtgtttagtacaggaacatgctatataggtctgtatcccaggagcaataggctctaccacatagcctaggtatgcagtaggttctactagttaggtttgtgttaatgtgctctgtgatggttgcacaatgatgaaattacctaacaaggctgggcacggtggctcacgcctataagcccagcactttgggaggccgaggcaagccgatcatgaggtcaagagatcgagaccatcctggccattatggtgaaaccccatctctactaaaaatacatgccgggcatggtggcatgcacctgtggtcccagctacttgggaggctgagtcaggagaatcgcttgaaccagggaggcagaggttgcagtgagttgagatcgtgccactgcactccagcctggtgacagagagactcagtctcaaaaaaaaaaaaaaaaacttacctaacaacacatttctcttaatgtatccttgtccttaagtaatgtctgttattttccattttccgtcacatattgtcattaagtctctgacaattaccgaacacaattaacattgtcgtgtttaagagaaatcatttaccgatttctctaaaatactccttcctagtactgaatttgctgagtctctccctaaacattgcaaaatgactctgcagagtgacagtcctcactatcccatatcttaccagctctgagaattatcacacctaatgatttttttcaatcagatgggtgcgaactgtttcatttattatttgcatttcctgatttttgtgaagctaaacctctcactcacatttattagccaatcagattttttggtgaattatcccttcttttgcccatattgcactttttctttttgatttgcccaaatgttcttatattatgaaaacaccaatcttctgttagtctgtgtctgtctctattttatcttccatttcctgtattggcaatgctatcatctgcaaatgataattttgtcttgttcttttctgcaacgattacttctatcttttccatctcatctcattgtcctggttgggaccttcacgacaatgccgactggacactgtggtagtcccagtctcactgcatatctgcttttaaagggactatttctaatctttgcctgttaaatgttaatatttgctgtaggtttccagcagatagtatttacctggcataggagtcccattctaatattatattagtttgctaatgtctttctttctttctttcttctttctttccttcttttactttatttttttgttgttgttgttgttgtagtttttagacagtcttattctgtcacccaggctggagtgcagtggtgcgatctcagctcactgcaacttccgccccctgggttcaagtgattcttgtgcctcaacctcccaaggagctgggattacaggtgtgcatcgccgtgcatagctaatttttgtatttttagtagagacagggttttgccatgttggccaggctggtctctaactcctgacctcaggtgatccaccagcctcggactcccaaagttctgggattacaggtgtgagccaccacactcagcctgctaatgtatttcttaatgagtaaatgtagaatgtcatcaaatgcttttttccctgcgccttttgaggatagcatgctttttcttctttaacctgtaactcaatgaattatattaatatatttcctaaggttaataatcttgcaatcctcaggtgaggtgtgctgatgtgtgatatacaccgaagcatttcatttgtaaatttttaaaggatgtttgtgtttatgttcacaagtgagattttcttctctccccttgttttgtctggttctctcatgccattctgtggaacagtcttaagataagaagttatcttttcttgggaaatttgataaatttcacttataaaatcatctaagcttggccaggcgcggtggctcatgcctgtaatcccagcacttagggaggccgaggcaggcggatcacgaggtcaggagatcaagaccatcctgtctaacacggtgaaactccgtctctactaaaaatacaaacaattagcctggtgtggtggcgggcgcctgtagtcccagctactggagaggctgaggcaggagaatggcgtgaacccgggaggcagagctggcaatgagccgagatcacaccactgcactctagcctgggcaacagagcgagactccatctcaaaaaaaaaaaaaaaaatcctctaagcttggtgctttttggtttattgatttttgactactgatttaatttctcttatggtcatttttaaacctataagttctatggctatggttatatggttaaaggtctattcaggttttaaatctgtacttgaatcagttttgacaggacacccttttctagaaaaataaccattttgtctaggttttcagatttattggagtaaagttgtccattgtatttggttataagttttaatctttgggacagctgcattgaagtctcttttttcttccttctttgttttctttccttctttaacgttttctcttttttccctaatcaaaccttccagagattgtagactttacttttttccccaaaattagcttctgcttttgttaattctcacagatatttttggttgtctaatttgccaatatctcctcgtttctttcttatttccttacttgattttggtttaactcttttttccaaaagtaacctcttgagttgaacgcttatgagcttttaatcttttttcttttctaatatatttatctaatgctataattttctgtacgctgtgttttcatatgtttttatatgcagtgttcttgtcattcaattctatatattttatgatttttataaaggcaattttttttctttttcaagttcaggggtacatgtgcaggatgtgcaggtttgttacacaggtaaacgtgtgccatgatggtttgctgcacagatcagcccatccccccagtattaagcccagcatccactagctattcttcctgattctctccatctccccaccccctgtcctccaacaggacccagggtgttttgttccgcaccatgtgtccatgtgttctcagcatttagcttccccacttataagtgagaacacgcggtatttggttttctgttcctgtgttagtttgctagggataaaggcttccaactttaaccatgtccctgcaagggacatgatctcattctaaaggttattttttgaacccaaagtatctaggattgtttttgaaggcaaaacattattactaattataactattttacattttgatcagaggatatcatctatagcacaagccagtaaatatttttctgtaaagggccattattgtaaatattttaggctttgcaggtttcattgaatctctgctacaactacagcaaagctgaaaagtgatagaaacgtttgactgacatactcaggggtgcgacctgatcattaagccaggtgaaaaagcgcctgctagaagattcttgaggcagagctagaaattacaccaagagtagacgtgttttctttttgatttgtacctagcagaatggtgtggcaataatttctcaagcattccattcatttcatgtcctaggtagaaataacctagaaagagaaaaaaggcaaagaaaatcaggtgtccatgcctacgtgaaacagaaaaagaaaattgttcaggtatctgtaaccaggcctaggcaaataaaggcaacttacaaaaatacaaacactattaaggtgttttattttgttttttaaggaaaactgggaagggagaataaataacagggacatcaggggcaagatcagttgcacctgcagagttctgcagcttgttagaaggcaggcagcttgagttagctttcagcagccaacccccagagctacatgcaatcatcaaccagtgtccacaaggaacaaacaagcaaggggctccagtagaagaaagggaaggtgctggttggtgttgcaggtcctcttaggaggaccaagttcatatccacgaaactcgtgggctgctcctgcacccccagagtccagttgcaaggccatgggcaccgagacatgctcttcgtcttttccagctctaacctagacagtcttctctttttatggaatactcttctgagaaatatcccaagtgaattactgaatgatgctttgatgagatccttgaggaccatcaaaagaaacagccctctgaagacaaccagatccagtggtgtgcacctgagtctcagcagttcctcatccttttctaaaggaggtgcagaacctgagaccgagcgtgaggtctgagttccagttccattacctaactcgctgcgggactctgggcaagtcactgaccctccctgggcttgctttcctcatctgtgaaatgggatgctacttgaacttccctcatacggttcttgtaaggatgagtgagctcctttataaaactatcggacagtgctcagagcacagtaactactgcaccctatcttctcaaatagacttttttttttacagcagttttaggttcacagaaaaattggtcagaaggcacagaggtttcctttatgctccctgctccctcacaagcacagcctccccaactatcgatatccacccccctcacagtggtgcatctgttccaatcgataaacctacactgataccttattaccacccaaagtctacatccaatttttattagaatgattttttttccatggggcagtacaaacatatcttggcacaaacttattctcaagcttgtacactctattttcttgggataaaggtggttcaaggtgtagaattttggtttttaataagacccattgaggaatgttattatctgaatgtgtgtgtttcctcaaaatttatgttgaaatcctagcctccaaggtgatggtataagaagtgcagccttcgggaggtcatgaggccatgatagtagagccctcatgagtgggattgagaggcaacagagagacccttgccccttcccctatgtgaggtcacagcaagaactgcgcagtctgcaaccgtccccaggtggccctcaccaaaacccaaccatgctggcaccctcatcttggactcccagccaccagaacagggagaaataaatttctattttttaccagccacctggcctacgatattttttatagcggccttaatggactaagacagtaagggagtcaattagcagaggaaatagtagacattggagatagaggacctgggtttggctccaaattctgctgctagtagctctgagaccccagttctctgaagctcaagggtaaataaatgcagtcatagtccccaaggatggtggccaggctaaagtggagttcacaacttattattattattattatttttatttttgacagtttcactctgtcacccaggctagattgcagtggcacaatctcggctcactgcaagttctgcctcctaggttcatgccattctcctgccttagcctcccgagtagcaggcgcctgccaccacgcccgggattacaggcgcctgccaccacgcccggctaattttttgtatttttagtagagatgggtttcaccgtgttagccaggatggtctcgatctcctgacctcgtgatccgcctgcctcggcctcccaaagtgctgggattacaggcgtgagccaccgcgcctggccacaacaactattaatatcctgatggtgcatggctgggtggagcatacatagtaacctcacatttatccttttccatgtcttcccccagcatctctgtcccgtcttaaaagaaaaggtgcatcatttataattttggatggtttggtgcagggaatattatcagggtaggtggcaatttacttgaggagtattgacacgttagcaaatactctttcctttgctgcaatactgggaaagtccataatacaatgggatttttttcttgtagtcaaaagcagttgtacattatttttgcttgtctctgatggtgtcaagtctaaatcacagccatcagctgactcctgatgcatgggtagaaaaggtcctgacaagccccatcttttcctgcccaagaatggtaaacaagttgctccctctagcatcaatacactctctgaaggtggcttcctaagactgtgtgtaccacaacaggctatttctttgtgcaaatgactgcactttaacttttttattattaaaaatgagaatgagtgggccgggcacggtggctcacacctgtaatcccaccactttgggaggccaaagcaggtggatcacgaggtcaggagatcgagaccatcctggctaacacggtgaaacctcatctctactaaaaatacaaaaaaaattagccaggcatggtggcgggcgcctgtagtcccagctactctggaggctgaggcagaagaatggcgtgaacctgggaggtggagcttgcagtgagctgagatcacaccactgcactccagcctgggcgacagagcgagactccatctcaaaaaaaaaaaaaaaaagagagaatgagtggtaggaaaacaagtcctttgtgtgtgtcccagataatttcatctgattgtaaagttgagatacattgggttatgtcattaacctttggtagcttcttaagaaaatagtttctctagagtatctatactgtgaaatgtatttttattttccaagtagaacatgcctctgggattttgagaaaaaataaaaacatacataagttcagtaacatgaatattgacatttgtttttgaagaaaataaagctgagctttcaaaaatgatgtcagctttttggaactcacaatctatagacgattccatctaatctttattgaatgcctgctgtatacaggcaccagtatgtgaaacctttttatggggtaggctttactttatttattcttttatttatttatttttttgagacagagtctcactctgtcactcaggctggagtgcggtggcgccatcttggctcactgcaacctctgcctcccagattcaagcgattctcctgcctcaacctctcgagtagctgggattacaggcgcatgccactacaccttgctaatttttgtgtttttagtagagacggggtttcaccatgttggtcaggctggtctcgaactcctgacctcatgatctgcctgccttggcctcccaaagtgctaggattacaggtgtgagccaccgcacctggccctatttattctccttttatagatgaagaaactgaacacagaggggggaattattcaccaagtttgcatggttactatggggcaaggcaagattcaaactgagcattggtcatctaccaagcccacacacttcccaggtggctgcactgcccttctcaggacctaagggaggctccagacctgtgctaagcagtagcctcatgaggctattgagactaactatagagtaattacaattaaatcaaatcaaaattttaatccctcaattgcaccagccccagttcaagtgctcaaagtcttatggtggccagtgctttcccctgtacagcatgtcctgtagaaccctttacagcagaaggctgtcttagacatggccatttggttgctctccacctctcagcccctcggcttctgctggaaaatcatcaggtgcctctgtggaaaaacgacacccaaagctgagtttcctggtcctggcttaccttctctctgggctctgtaaccccaagtccttgctcttttgctagctttctggttccttcctacagttttgtccatgttttctagctctcggtaggagtactggcctgaaacaagtcaggtcactttctccagcatttcattttccctatgcatctgtccacatgcctttcctttgctctaatccacagagtcttctgttgcctggtggagagtacacctaaccatgcctaaaatttaaaatgtattgtttataaacctcatctagtgattgtctcaatggaagatagccccatgtcatgcatccagaaaaccccattatatccaaatgccaccagcctcatgggcatctacacacacatgaacccacatggacagcaccaaggccaggtcctctcttggcactcacatataatccccccttagccaactctttcagggcttccccaaaacgtgccttgcttgcccatccagggcatcaacaaccgtccccactcagcttcacctgctcgcccctgcagcttcaatctacctatcaatcaatacacccacagtcctgaagaccactgcctacaggacttgccgtgaggatactgttatttatgcctcttgaggctggctgagtttccagattccaagaagccagagcaaacatgtattctaatgtaattacatttattttgtttttattttatttttgtttattacaatgtaataagcatgtaatacaatgtgggaagaacagcttcccaactctttgctgcagcttgttacctggttcccaagtgccactgcttgttcccagagcattccaggaaagcggcctctctctctcttttcttttctccttccttccttccttctttccttccttccttctttccttccttcttgtctttcgtttctctctctctccctatctcctttcttccttccttccctccctccctccctccttccttccttcctctctctctcttctttcctttctttctttttctttctttctttttttcttgcttgtttgcttgcttgcttgcttgcttgcttgcttgcttgctttcaacagagtctcactctgttgcccaggctgaagtgcagtggcatgatcacagctcactacagcctcaacctcatgggctcaaacaattctcccaccacagcctcccaagtagctgggatcacaggtgtgcgccaccatgctcagctaatttttgtattttttgtagaaatgagttttaccatattgcccaagctggttgcaaactcttgggctcaagcaatctgtctgtctcagcttcccaaagtgctgggattacaggcctcagccaccgcatctggccacaactttattttttaaagcatgtttaggttcacagcaaaattcagaggctggcataaggtttcccatatacctcctacctctacatatgcataacctcccacattattaacatcccccaccagagtgataccctggttacaactgataaacttacaccgacacatcattgtcacccgaaattcatagtttacactggggttcactcttagtgttgtaaatcctgagtttaaacaaatgtataatgacacatatccatcattatagtatcacacagagtatcttcactgccttaaaactcctctgtgctctgtttctctccctatccccaaccccttgcaaccacagattttgcaaccactataagaatgtcttatagttagaatcatacagtatgcaggcttttcagattggctccttttatttagtaatatgcctttaaagttcctccacatcttttcacagattgctagctcatttctttttagtgctgaataatattccattgtctggatgtaccatggtttatccatccatttaccctactgaaggacatctttgttgcttccaagttttggcaagtatgaacaaagctgctataaagctgctatctctgcgtagatttttgtgtgtatgtgtatgaacatgttttcagctcctttgggtagatagtaaggagcatgattgccagatcctatggtagactgtgcttagttttgtaagaaaccaccaaactgtccttcaaagtggctataccatcttgcatacccactggcaatgttcctgttgtcccatatcctcaccagcatttggtgttgtcagtgttacagatttggtgattctaaaagatgcgtagtagtatctcattgctgttttaatttgcactccctgatgatatgtgatacagaacatttttttctcatttttttttgccatccatatatcatctttgatgtgtttgttaaggtctttgggccactttttaatcagattgttttcttactgctgagttttaagagttctttgtgtgtgcgtgtgtgtgtgtgtgtatgcccttactgtgaaaaaaatatatatatatattccctttctgtgtatgtatatatatatatatatatatatatatatatatatatatgccctttctctgaatatatatatatgtttctttctttttcaaattttatattagattcagaaggtacctgtgcaggttcgttacctgggtatattatgcgatgctgaggtttggggtatgaatgatcccgtcgctcaggttctaagcacagtacccaacagtttttcaagaaggtgttttttctatgctcagtaggtaaacctaaagaaactgtgttcagcctggccagtcaccttttttcactcagaaggactttccatgctttacccagatatatagaggaaactgtcttttagccagtttcaaagatttttattttatctgtaattctgacagcaactggtatattgcagttcaattctgccactaaccacctggagttagcacggacctcacaggtgaagagcacagtcagtcccgagtgtatgtgtatgaatattcacatagacagccccctccagacagcagccacaagttcagtgggtcccaggccactcacacttttgaccaactggctagtaattcaagggtttccacaatcctgtcatgtttgatcattggctataacaatgcatagaactcaaggaagtgctacacttttgattatagctttacgataaagagaacagctcagggccacccagatgaagagatacagagggaaggcctgggaggatccccaacacagagcttccttgccctctctgtgaaaatagggtgtacctcccttctggcacacccacgtgttcatcaacaaaatcatccctgatgctcagtgtgtggagttttgacgggttcattacgtaggtatgattggccaccaggctgaactcagtctccagcttcccctaccttctctggagcttgggctgggtcaaagtcccaaccctagtatctcatggatggtctttcttctgtccagcccctattcctgaagctgtctaagggctcactgggagtcacctcattagcataaactcaagagtgagccaagaggctcatgaataacaaacgcagttctaccactcagaaaaatccaagagctttagaagccctgtgccaggaagtcagaacaaacaccagacaaatcccttattatagaaaacctttacagcttattcacaggtatatgatgagactcatattcacaaacagaaggatgtcagaatcttattttcctactcaagaataaatcaaataccatctactcctttgtatgacttcctcaaaatctgtccaagagaacaattaaaattgcaagatggcaacggatcatattttttcacttggaaaagataatattgctactgctacctctcctaccataatgactaataacaattgctgatcttgcttttggagcctatactgtacactacttaaaaggcaatgagtcaggtaaaggcaacaaatataagagaattaggcttcagaaaatcattgtaaaagtttgcctcttgaagctgatttccaccaaaagcaaacaacttataaacgctatacatgtacgtcagcttgaatcatgtgcacagagacatgaggaagtttggaacgccaggtttgcaaaacccttagggtcaggcttgagtgaaaatgcaagcctcagagtcaaaaccaatttacaatataagatgcagttggttggcataaagaattcagtaaggcttgaaaaaaaaatttaattaagaaaagtttgggggaaaaaaaagataaatgttgcctggagctttcatttaaattggaaacatcctaaaaagcccctggccagttctggccccatacagctaaaggacctggcaaaaccccagccttcagtaataattaacactcataaagtcacaatgaagttatcaaggggccattttggccatgcttaaaagactaaccacatctgccaaaacaatgacatttccaaactcttaatttttgcaacatgtatatatgtgttctcagttttcagtgtatgcattactgagaggaaaacagctagagagaaagaaaagtgctttttcattaatcaaaaggagactagactgctgtttctgcatactatgcacagcaagattcagagttaaacatcatcattcaaagagttgatgttgaacaaaaaataacagttgaacttattcctgctttacaccaaaaagtgttattaatttttaatttcctgggcatgcagtagtattttctgaattagattctgagagagtgattttgaccatgggatcactagtaaaatatcagctcacaatctacagttatcaacatccagacaaacaagctagtgttagggaatgccagcagaaactaaaacaaaacactcaagaaattttgattctgaaatagaatataaagtaacaatgtgtgaaataagaaataaaaggcagaggtagtaaaaacgtttatgaaagatcaatgagacagattatttttgaagttttttttaaaaaaaactttgtatgtgtatgtgtgtgtgtgtttgtccaaagtcttgcaagtttcatgagaaaaaagaggtagaatgggagcacattcaacttcgttcagtggataaatggataaactctgggttgagagacaaagtcaaaagttgaccttgcccggatgttttgaatccagggctgctgagttaaggaacaagataatggggttccactactaattaaaaacccctgatgcaaaggcccaggccttccccacaccctggttttcctcatccatctctcttcttgtatctcatatattttcctaggagaaaccacgtactttgcaaggattctaatacagtacttctgagttgtaactttcttttatttactcagtaaatatctaatgagtgactactaggtgccataacttcttagcactgggattcagcagaatttgtgctcctggaattatatcctagaaaagaggcaaaaataaacagaggaagtgtaaaaacaattacgatcattttaaatggtgataaatgctttgaacaaaacaggtaatccagtgtgactggtgatgagggtggctgcattaggtggaatggcactgagaagccagactgaagcatgattactgctgagatcctactgatgaggatcctggcatgccaagactggccaaagagaggatggatgcttcagggaaacaggcagaatttcaaacagagggtctataactgtgcgatgggaactgctgtctgtggaaagaatctagaaaatgtccctctggaccatgcatgcagcagtaggaaacagagtccaagaaacaggcaccaaccagattccgcaggcctgaggtgccaagataaggtatttgggttttgttctcagtgtgctgagaggtgcatttgagagtttgcaaccagggaggagtgtaatgtgatttatgttttcttaaaaagtctctttggctgttgtgtatctacatgtatctacaaccacatgtagatacttatgagaggtatcaagggcttctgacattacagggtttgaggtaccctgaagggctctctcactacaatatacatggtaggatcccaggaaagcaatgggaaattttcaagaaggagtgaggagaaagcctgaggtgaaacctgaacagagcaggtgtgcaaacacaaactctgaaggcaaattcttagaattgcactgcaaagaagtcaaactttggacccactgcaggattggagatctgaactcaagctcttaaagaagcagtgtggttgtagtctggtagtatccttgagctcccagcagaagcaacaaaaatgctctatattgcaaagtaacctattttaatcccaaggattttctcagattaagttcaaaaaaatatgagctcacaatctacagttatcaacatccagacaaacaagctaacattagggaatgccagcagaaactaaaacaaaacattcaagaaattgtaattataaaatagtatataaagtaacaatgtgtgaaatgtttgaagaaataaaaggcggatcttaaaaatcattatggaggctgggtctagtggctcacgcctttaatcccagcactttgggaggccaaggcgggtggatcacctgaggtcaggaggtcgagaccagcctggccaacatggcgaaacctcgtctctactaaaaatacaaaaattagctgggcgtagtggtgaacacctgtaatcccagctacttgggaggctgaggcaggagaatcactcgaacccgggaggcagaggttgcagtgagctgagatcaagacactgcactccagcctgagtgacagagcgagattccatctcaaaaaaaaaaataataataattatggagtaaaatactgtaaaaaattacaagacatatttgaaaatgatcaaatgacacattaaggaataaaaatgtaattattaaaattaaaatgttaatgataagctaactcgtggattaagcagagattgaggaattggtgaactgaaagatgggcctaaagaaattgaacaaagcctaatacagggataaggagataggaaatataaaagagaataaagacacagaggatagaataaaatatttaagttacatctatcaaagtcccagaaggagagaacagagagacaagaaaagaggtgatttttaggaatttccagagttagttgatttcatggtgcacagatgcaggaaacataacaaatacccaacgaaataaataaaaagcagtatatatgcagacagattttgcaatatggttgtagaatctcaagtcaaagagaagatcttgaaagcaaccaaagagaaaaatagagcaactacaaacaagcaatcattatcctgacagaggcttctcaacagtgagcatggaaaccagaagacaatgaagtcacatctgaccacaaaattattgccaacttagaatcgtaaaactatcaaaagtatctttcaaaaaaggtatctttcaaaaagaaaggcagcataaacacattttcatttgaataaaaacgtagttgcttttagacatcttctgatctaaaatattctaaaagatgcatttcattaaggaaattctaaaatatgtatttgtttcagtaggaagttcagaaaaagtatctagaataaaagcctgggatacttaaaggaattatgaccaaaagaacattgaagtaaataaaaacaaatattagcagtgttaaataaaaatgtctcacgtgggggttaaaaaaagaaagaagagagctagagtactagacatcaatggcatgtgaacgaggggggaggagatgataggaatttttttgtttgttctgttttgttttgctttgttttgagacagagactcactttggagtgcagtgccacgatctcagctcactgcaacctccgcctctcaggatcaagggattcttctgcctcagcctccggagtagctgggattacaggcacgtgccaccatgcctggctaatttttgtatttttagtagacacagggtttcaccatgttggccaggctggtctcaaactcctgacctcaagtaatccacctgcctcggcctcccaaagtgctgggattacaggcatgagccaccatgcctggcctatagataggagctttatgctctaaggttcatatacagataaagagataattaagatattaatcaactttagattctgttaaatcgtcacagtgacatttcaaaggtagttgctcaaagaggaaaatagatcaataacttccaaactattatacacggaaagtatggaataagacaaaattaaaaatataccaaactcaatctactcccctttcaaagaaagcaagacaaaagaaggataaaaggagcaagaaaaaaattaagttagataattgaagtaaatctaaaaacatcagtaataacaattactataaagtgactcaccttgctcttcaaaaaaaccagactgaatatttttaaaagtaataaaatactttttataagcaacatgcctaaaacaaaagaatggctggaagattaagaagaaatggttgaaaaaatataaaccaggcaaataatcaataaaaggctggttattacatcaaacagaagagtcaagtcttgaagcattattagagtaaacccagtaatcaaaaaagaataaaagaatcaattcaccagaaagcaaaataatgtataacttatatgcgtctaatgaaataagctaaaaacatataaagcaaaacttgatagaactataggaagaaacagcacgtctataattgcagtgggaaacgttaacacacttctctcaattatcaatgcatgaaacgatctgaacaactgtaaaatggtaaatacaagcagttattcaaatagctactaacaagtttgaactcataaaaatatatagaatccagccaggtacagtgggtctcgcctgtaatcccagcactttggaaggccaaggagggaggatcgcttgaccccaggaattcgagaccagcctcagcatggtgaaacccggtgttactaaaaaatacaaaaattagctgagcaaggtggcatgtatctgtagtcccagctacttaggaagctgaggtgggagaatagattgagcccaggaggtcaagactgcagtgagctataactgtaccactgcacttcagcctgggcaacagaacgagaccctgtctcaaaaaaatacacacacacgtatgtgtgtgtgtgtatatatacataaatacacacacacatatatatatacacatatatacacacacacatatacacacgtgtgtgtgtgtatatatacacatatatataaatatacatagttgtgtgtacatatgtgtgtacatatataagcatatagaatcctgtacatctcaaagaatatacattattagaataaacagaagatttgataaccacatactataaaataatgctccataaatttttttaaaatgtagggggttataaccaaaatttttctctaaaataaaccagattggaaaagaatagaaaatatcagagcacatcatactgaagaagaaaagtatcatttcgagaaaattgctttacatataaacatcctaatatatgtatatttgtgtgtgtgatgagtctcaatataaatgtatttcttatatagtcacagtaaaaaatgtttcaaaaccactacctaagaaacttttgtacataggcctctggagaaatgtacaaatatattcacagcaagattattcatatcggaaaccaataagttgttctctcttcctgggatggagcatggacaacactgcagagcagtaagaatgaaccatagatctacgcccagcaacatggatgagccataaaactaatgttgaatttttaaaaagcaagacagtatatatgaacctcaaaaacaaagttaaataacattttttagtgatatacaacatataaatatgtgttaaaaatatttaagtatcaggaaaatgataagttaatttcaggttggaagagagctattgctggggaaaaggcaggataacaggattggggaaaacacacaagtatgagatgaaatcatatgaaattgcctctattcaaaaattgtttaatcttcaaaaatgtcatttcacatggttcaacctaatagctccaagtgtactggtaacatcctgtcacttaagatgagttgtgagtttacaaatattaggtttacaattatgatgcctaatttgaatttgtttatgtattacattacatgtataaagtattacaacattaaaaaaaaaaaacttttcttaaaagagtgcaacaaggtccctggggtccatgtgagagagggttggacaaggttggaaaccagaaaaaggagagacgttaaagggtggaggatttattatagttagttgaaggcaaactcagtaaggctctctgatgtgctggttactgggaatgagggaaaggacagcaaatctatgtcaatttcctctgagctaaatgaaacaatataagatgatgctttcatttggggatgaggagttagggtttgatatgggtttgttttatggtataaaatataccaccatgaaagtgatagatgtttaggacagaaattttaggaaatgtaaaaaaaaataaaaaataaaataggttaccatccccaacccactcaggctaatggcagcagctaaggtactgaacactggttaaaaaaagaaaaagtgcatgagaaaaaaaaagtctatgaattgttaggtagttcacggaaagccctcttgtagtccaaggaccatattatagcaggaaatgcagctagaatcgcttggaaggaaaagctgcaatcacaaataaaatcatcagttgtataatatttttcagtcattacaggaagcaagtatcaaagctgctttcaccaaaaaatgtggggatatggctttcattgtgccccagtgtgaaattattccagttaaaggggtttgcagaatagcaacttgttgttttcttaaaagaaatcctggtgtcatcgacagatgtgagttttactcacctaacgtggagatgttttcaagggtgctgccagtaatgagaaacagtgaattgctgtgaaattttgctgtgctggacttggtaaaggccaaagtgaagtagctagcgtgagtcatgctgcacaggttatttttaaaatactggagaaatcctggttgccacagaactgtgtacaagttgacacgaagattgaatttggtgttgatgtaaccaccagagaagttgttgttgctgctgatgttactgataatgatacccagagactctggccatcgagagatcaaagcaaacagaaagacaaacagtcttgttgtgacctcaaagaagcaactctggaagggctccagatggtaaagaaaaactttgagtgggttgcagagattgtagaattgctttggaaatcagaaagtcagtgcaggggtgtaatatgcataggctcaatgtctgatctagaacactgtgaaaaaatcaagagggcctgtggaaattttgggtttgggtaacatctgcccataaaggactagatgaaactctgaggattaaagctgagtctgaaggggatggcattccttctgtatctgtggcagtggtaggcagaggccatggctagggaccagtgatgcctgggaacactgcataaccacgtagttatcagctgtcctcccctcacaccagacagtgacctcaggatgtgtgagcttccctttgacaggggtctcaggtagtggaccatactttctgcagaagactcagctcagtatgatgcccagatatttggattaagcgatcatttggcaggaggcaaactgtgaacaagcatattgaacacatggatttcattgaaaagaaaatcagagatataatttataagaaaaaatgccattcacaaggcagggatgccctctctcaccactcctattcaacatagtgttggaagttctggccagggcaatcacgcaagagaagaaataaagggtattcaattaggaaaacaggaagtcaaatagtccctgtttgcagatggcatgattgtgtatttagaaaaccccattgtctcagcccaaaatctcattaagctaataagcaacttcagcaaagtctcaggatacaaaatcaatgtgcaaaaatcacaagcattcctacacaccaataacagaaaaacacagagccaaatcatgagtaaactcccattcacaattgcttcaaagagaatataatacctaggaatccaacttacaagggatgcgaaggacctcttcaaggagaactacaaaccactgctcaatgaaataaaagaggacacaaacaaatggaagaacattccatgctcatggataggaagaatcaatatcgtgaaaagggccatactgcccaaggtaatttatagattcaatgccatcgccatcaagctaccaatgactttcttcacagaattggaaaacactactttaaagttcatatggaaccaaaaaagagcccgcattgtccagacaatcctaagccaaaagaacaaaactggaggcatcacattacctgacttcaaactatactacgagcctacagtaaccaaaacagcatggtactggtaccaaaacagagatatagaccaatggaacagaatagagcccccggaaataataccacacatctacaaccatctgatctttgacaaacctgacaaaaacaagaaatggggaaaggattccctatttaataaatggtgctgggaaaactggctagccatatgtagaaagctgaaactggatcccttccttacaccttataccaaaattaattcaagatggattaaagacttaaatgttagacctaaaaccataaaaaccctagaagaaaacctaggcaataccattcaggccataggaatgggcaaggacttcatgactaaaacaccaaaagcaacagcaaaaaaagccaaaattgacaaatgggatctaattaagctaaagagcttctgcacagaaaaagaaattaccatcagagtgaacaggcaacctacagaatgggagaaaatttttacaatctacccatctgataaagggctaatatccagaatctacaaagaacttaaaaaaaatttacaagaaaaaatcaaacaaccccatcagaaagtgggcgaaggatatgaacagacacttctcaaaagaagacatttatgcagccaacagacacatgaaaaaatgctcatcatcactggccatcagagaaatgcaaatcaaaaccacaatgagataccatctcacaccagttagaatggtgatcattaaaaagtcaggaaacaacaggtgctggaggggatgtggataaatacgaacactttcacactgttggtgggactgtaaactagttcaaccattgtggaagacagtgtggcgattcctcaaggatctagaactggaaataccatttgacccagccatcccattactgggcatatacccagaggattataaatcatgctgctataaagacatatgtccatgtttgtttattgcagcactattcacaatagcaaagatgtggaaccaacccaaatgtccatcaatgatagactagattaagcaaatgtggcacatatacaccatggaatactatgcagccataaaaaaggatgagttcatgtcctttgtaggaacatggatgaaactggaaaccatcattctcagcaaactatcgcaaggacagaaaacaccacatgttctcactcataggtgggaattgaaaaatgagaatacttggacgcagggtggggaacatcacacactggggcctgtcatggggtggggggagtggggagggatagcatgaggagatatacctaatgcaaatgacgagttaacgggtgcagcacactaacatggcacatgtataatatgtaacaaacctgcatgttgtgcacatgtaccacagaacttcaagtataattaaagaaaaaaaaaaaacctcaagcttctaccaggctctcaaaaaaaaagaaaaaaagaaaaaggaaaaaagaatgccattgcattttttaaggaaaacacttcaaatttctaatttagctgcaggaacaaaagcaagataaaaagatgattttatttatttatttattgaaatggagtctcactttgtcacccaggctggagtacaggggcgcaatcttggctcactgcaacctccacccactgggttcaagcgattctcctggctcagcctccagagtagctgggactacaggtgtgcaccaccatgtctggttaatttttgtatttttagtagagacgggctttcaccatgttggccaggctggtctcaaactactgacctcaagtgatctgctctcctcagccttccaaagtgctaggattacaggtgtaagccaccacacccagccaaaaagatgattttaaatcagagaagacaaattaaaggtactggtaaaaaaaaaaaaaaaaaaacagaaaccaaaaataaaataaattgaaaatcacttataattttaccattcagaaactgtcttttaaatgacattccaatagcaatgagcacatctagcaacccatcttggtttctaaatacctttctccactaaaaagaaccagaggccaggcgcaatggctcacgcctgtaatcccagcactttgtgaggccaaggcgggcagatcacctgcagtcaggagttcgagaccagcctggccaacatggtgaaaccccgtctctacaaaaatacaaaaattagcccggcatgatggcacgtgcccataatcccagctactcaggaggctgagacaggagaatcacttgaacccgggaggcagaggttgcagtgagttgagactgcaccactgcactccagcctggatgacagagtgagactccatctcaaaaaaaagaaaaagaactagggcttttgggagaaatagttgattctatggctagggcagaaaaaagaagatgaagctggaacatttagttacagagtgtaagaaaatgctcaagagtgatggagacttgacaaagggcatgaaaaagagatttgaaaaggcttttgccagctaaatctggaataacttgaatatcaaagtaaataatgacggtaaaggattataaaccttttaataaaacagggaaccatcagttcatacagatataaacacaaaaacaaatacaagtagagagaaaaggaagttttccttataatataacgctaataataaatgtataagtgaaaatgccaaacaacatggtaacaataaattcagccaagaaacatcaataggcgctaaatctggtaggttaatgagtacaagtttgaggagaaactggataatcatacaatttccacataactttccacaaaataccacttagaaagagaacaagaatagcatgaccgtgaagaagctggatgaccttaacccagtgacccaacttaacatcacctgtaatgggacaagctgacatcacaggccacctcacagaaggcaatgagacctcagcattatttctgtaattgcctgccaaaaatgcatcacctctgcccattatgaggaattatcagaaagaaacaaacaaatgagcatgcttcaaaatgtgtgacaaaaagtcagggtcttaactcttctagaatgaaggagattaaagaaacataacaactaaatgcaaagtggggtcctaggttggattttttggctataaaggacattactggtgaaactcaaagggggtctgaggatcggatggtagtattacgtcagtgttaatggttattctgagataacacagaagaaggtccttcagtatttatacaactataaatactgaagtatttgggggtgatgggaatcccagcaacaacttgccctcaaataattccgttaaaaaaaaaaagctctttgtacagtacttgcaacttttctggatgcttggatttcataataaaattactttgaaaaaaatatctacttgagatagtgccataaagaagcaagaacagagaaatctctactattctgttatacagcttggtgccctaccattaatgatccttaactttagatcttcaagcatatttaagtctctaggccttggatgaccatgcagggggttgtgcagcaataaggtcaaccttagtagctaagagagagagagaaaggcagatcatactaatcaagttaagcagtttacacaaaactacaatgtgagttgtcactatttccatttttcaggtgcaaaaattgaagctcagaaaggggaaggaagttggccaagatcacacagtaaacattccagctggaattaaagaccccaaggtctgtgcgctcgacagccctttagcagggtttatctttctcgtggtaaattaaaagccaaagggctacttacgggtagttgtctggtgaggaaagccaagggagtatatgcccaggataaataccatcaccaattgccctgttctgcagcggtaatcgaagatccacaccccttgctgccatccagtgcttcctgaagaccccagggaagtcctcagttgacagaatcttccttatcctgctctccacccttcacttctgatgttggctcttccaaggccttcctttggcacagccaaagcaatactcagtgacagatcaacacaaaatgatgtcctcagaatgctctgggcctctctgggaatgtcatcttaattagaaaacctttcatgacttttaatttgtattggtcatttaagaaggcattgaattagctgaggattcagcaacattgaatactgactcttaagaacctcatttaatttactttgttatttaccaagtacaggtattggaatgtgaatgatgagagtttatctttgcaaatgcatacaagagtttttaaacttacagtttaaaagagtgtctgaggatgtaccgcccagaccaaaaaatatatatatcaaatgctgtaagatctaatatttgtttcctccaaagaaaaagcaatcactgcttttgaaatggacattagctctttttttaagtacttagttcagtgcttgtcacaaagcagatatgcaataacaatttattgtatggataaatgagtgctgataccaagagccgagaaaattgccatcatctctcaaatggtcatgtaccagcttcgtcaaaatgaaagttctttataattaaatttaaaacacactattttatttaggaaagttcctaaattatgagtgccaatttgctaatcttattcaacagtgatatttaaatattttattgatattaaaagcacttttcactaagaaaggtattttgaagttgaaagtgtaaaactttcttcaacaacaaaggaaaagaatgcatagaaaatgttagatcaaattatagctttcaatgttatatttctatttcaaaatttttaattgtcttttttagaaatttttctgggttcatagtaggtgaacatatttatggggtacatgagatgtcttgatacaggcatgcaatgtgaaataagcacatcatgaagaatgaggtatccatcccaagggtagatttatccattgagtttcaaacaatccaattacagtctttaagttattttaaaatgtacagttattactgactatcgtcaccctgttgtgctatcaaatagtagatcttattcattatttctattttttaatactcatccccacctccctctcagcctctcactacatttcccagcctctggtaaccattcttctactctctatgcccatgagttcaatcattttgatttttagctcccacaaataaatgaggacatgcgatgtttgtctttctgtgcctgtcttatttcacttaacataatgatctccagttccatccatgttgttacaaatgactggatctcattcttttttatggctgagtagtactccattgtgtatatgtaccacattttctttatgcattcatctgttaatgggcacttagcctgcttccaaatcatagctattataaacataggagtttataaacaaacataggagtgcagatatctcttcaatatactgatttcctttcttgggggtatatacctagtgggtgagattgctgaatcatattgtagctcaatgtttcgttttctgaggaacctccaaactgttctccgtggtggttgtactaattgacattcctccaacagtgtacaagtgttccctttactccatattcccaccagcatttgttattgcctatcttttggataaaagccatttaaactggggtgagatgatatttcattgtagttttgatttgcatttctttgtttatttgtttttgtttgtttgtttgagacaaggtctcactcagttgcccaggctggagtgcagtggcgccatcttggctaactgcaacctccgcctcctaggttcaagagattctcctgcctcagcctctcaagtagctgggattacaggcacatgccaccacgcctggctaatttttgtattttaagtagagatgaggttttgccatgttgcccaggctggtcttgaactcctgacctcaagcgatccacccgcttcagcctcccaaagtgctgggattacaggtgtgagcctccgcgcccagcctgatttgcatttctctaatgatcagcaatgtcgagcaccttttttatatgcctgtttgccatttgtatgtcttttgagagatgtctattcagatcttttgcccatcttttgattggattattagattttttttcctatagggttatttgagctccttgtatattctggttattcatcccttgtcagatgggttaaattgtcttttgaacttttaaagtttaaattaaaattatttttgccctgtacactttggcattagaggccatgggctccagggctttgctggtgagcaggggacgcagcaggcacatgctctgcatctgcgccgactgttcggcatttgactcccaacccctaagtccactttccccgcttttctgccctgcccaggcctgggaggttcacctctgttttgcaccatccatgctccattgccttctagcttccaggtgaatcctgtgcactagcagcaaagtagctacaggagggagaagttggattatttatttttccttctcattcctcacctctccaactgtgtcaggaatccccaaaacccccaggcttgatgatttgctaggacgactcacaggactcagtgtatagtcttgtttgtgattataatttattccaatgaaaagatacaaaccaaaatcagaaaaggaaaacgtttggaggaaaccaggcacaatccatgtcctgtcctggtagagtcacacaagatgtgtttaattccctcaacaaggaactgtggcaacacttgtaaaatgttgcaaccccgggaaacacagtagaaactcagtgcccaggatttttactgggggctggtcatgtgacaccctatttttctatatcaaaatttcaaactcccaggctgggcatggcagctcatgcctgtaatcccagcactttgggaggcagaggcgggcaagttgcttgaagtcaggagtttgagaccagcctggccaactggtgaatccctgtctccactaaaaatacaaaatctagccaggtgtggtggcacgtgcctgtaatcccagctactcgggaggctgaggcacaagaattgcttgaacccaggaggtggaggttgcagtgagcttagatcatgtcactacactctaacctgggcaacagagagagacaatgtctcaaaaaaaaaatccaaactccgagaaggaaagcaagtgttagttaaaccatattatttgtaccattcagtcacagtgtagccactcttatcagtaaaggtagtaggaaccctccagaaatcttaagttcacagactccagcaaagggccacccttgtaagctggcctttcaaaggacagcggccaggtcttctatgctaacacttttctgcaccaaggttctggcagcggctattttcccggcagtcccagctcttcttaagtgtcctcttctgcagttacgtgctgccagattccaggaacttctccctcctccttattccttcaggttcagattggggtgaatctctgagagcatttcttgttgattgccttaactcaagccacccaactctgcacagagtctcatcattactatctgaaatgtttccagtgaagaaggaggaaaaggaaccagatttaccctccagactgaaatcaccctagaaaacagacaaaatacaggcatacctcattttattgtgcttcacagatactgcatgttgtaaactgaaggtctgtggcaaccccatgtccagtaagtatatcagtgctatttttccaactccacctgtttacttcgtatctctgtgtcacagtttgataattcttgcaatacttcaaaccttttcattatttttatatctgttataaagatcagtgatctttgatattcttattgtaattgtggactaatatgagtgtaagtggattttactaagaagagagaatagggatcacaaatatatctttgaaaaaaattaaaattttccaaatttggtatgaactgtaaacccacagatttaaaaagtcatgaaagcccaagcaaaagaaacataaagaaaaaccatacagaagtatgtcataattaaaatgctcaagaccggtgacagacagaaaatctcagaagccagtggagaacaaaagacacacaataaacaaacaaagataagccagtgtctcatgagaagctacgcaagcatgaggacagctttaaagtagtgaaagaataaatcctttagtttatctagaactctatactcactaaaaatatctttcaaatatgaagatgctttcagacacagaaaatccgaaagaatttatcacaagcaggcctgcataacaggaaatatttaacattcaaaattcaatgtaaaattcaccatattaacacactaaaagaagaaataaaaacatatgatgatctcaatagatacagaaaaggcatttgaaaatatccgacaactattcctgataaaaactcacagaaaactaagaatagaggtaaatttcgtcaacctgttacagggaatctctgaaaagcctgcagcttacacatacttaatgatgaatgattgattctttttccccaaacataagaaacaagattaaatgtttgctccaccaatcccattcaacttttactggagatttgagctctcagatttgagccagtgttataaggaacaaaagaaattttaaaaaagaggctgggcgcagtgccttacgcctgtaatcccagcactttgggaggctgaggtgggtggatcatgaggtcaggaattcaagaccagcctggccaacatagggaaaccctgtctctgctaaaaatacaaaaattagccaggcatggtggcacacacctgtagtcccagctactcaggagactgaggcaggagaattgcttgaaccctggaggcggaggttgcagtgagtcaagatcatgtcactgcactccagcttgggcaacagagtgagacttcatctcaaaaaaaagagaaagaaagaaagaaagaaagagagaaagaaagagagaaagaaagagagagagaaagagagagagaaagagagagagaaagagagagagaaagagagagagaaagaaagagagaaagaaagagagaaagaaagagagagagaaaggaaagaaagaaaaagaggaaggaaggaaggaaggaagaaagaaagaaagggaaagaaagggaaagaaagttattaccagcgaacaactggatatttgaatttttaacaactttattaagccgcatttcaaaaaccatacaattcacctatttaaagtgtacaattcaacaatatttagtatattcacagatacacacaaccatcaccatagaacatttttatcatctgaaaacaaaaccctgtctcccttagcaatcaacccaccctcccatccgccaccccaaacccctaagtaaccattaatctactgtctgtctcagtcaattttcttgttctggacattttatatgaatggaatcatataatatgtgatcttttgtgactgacttctttcacttagtataatgttttcaaggttcatctatgttgtaacatacatcattcctttttctggctgaataacatttcattgtatggatttaatacattttgtttacccaatcatcagtttatgtacatttgcattgtttccatctttggcttattgtgaacaatgctgctataaacattagtgtatgaatttttatatggatatatgccattttttctcctgggtttatacctaggaatagaattgctggttaccatatgacacaactatttaccatatgaaaactatgcttaatagagttattatgtaaagaattgccagactgttttccaaaacagcatcatcttacattcctatcagcagtttatgaaggctcagtttctccacatccctgctatctgatttttttattctagccatcttagtgggtatgaagtcatatcacattgtggttttggtttggtttggtttggtttccctgattactaattatggtgagcatcttttaatgttcttattatctatttgcataccttccttgaaaaaatgcctactcagatcctttgcccatttaaaattggtttatctctttatgattgagtagtaagagctcattatgtattctagatataagtaattagatatataatttgcaaacattttctattattatgtatatatcatattatctatctttttacttttgtgctgatgtactttgaagcacaaaattttttaatattttttcttttgttgcttatgtttggtattgcacctaagaatcctttgttaaatcaaaagtcatgaagatcaatccttgtgtttccttctaagagttttatagttttagcttttacatttcagttttttattcattttgagttagtgttttgtaacttatgccagtaccacagtcttgattattattgctttgtagtaagttttaaagttgagaagtacaagttctcctgctttgttctttttcatgattgttttgttttgctttgttttgctttgctttcagattttttgcatatccacatgcattttagaatcaacttgtcaacctctacaaataaatctgcttaggattctgataaggattgtgttaaatttatagatcagtatgaagagtattgccatattaacaatgttaagtattccaatccatgaacataggatgtttttctaattatttagatcatcttaatttttttcaacaatattttatagtttgtagagtataagttttatgcttcattattgatttaatgcttgtgtccctactaccctcaaattcatatgtttgaagtccgaatcactaacatgatggtatttgaaggtagtgcctttgaaagttaattatggccaggtgcggtggctcacgcctataatcccagcactttgggaggccaaggcgggaggatcacgaggtcaggagttcaagatcagcctggccaacatggtgaaacccatctctactgaaaatacaaaaattagctgggcatggtggcaccacctgtaatcccagctactcagaaggctgaggcaggagaattgcttgaacctgggaggcagaagttgcagtgagctgagatcacacactgcactctagcctgggtgacagagcaagactctgtctcaaaaaaaaaaaaaaagttaattacatttacatgaggtcatgagggtgaggcccccacgatggatatgctcttacaaaaagagaaacagacactggaactttctctctctctctccatgcacacactccaaggaaagaccatgtgaagatacagcaagaagacagccttctgcaaactaggaagaaggccctcaccagaacctgaacatgctgacatcctgatcttggacttcacagcctccataactgtgagaaatatatgtctattgtccaaaccacccagtcaatgatgctaatcttaaatacttaagattaaatataacaaaaaagtgctaagacacacttttgttaaatttaatcttatgtattttatgcttatcttaatttcattttcatattgttcattgccacaatatagaaatacaattgatttttgtacatagatcttgtaccccacaaccttgcttacctcatttattagttgtaataactttttagtgggtttcttagaactttctagatacaagatcatgtcatctacaaatacagatagttttacatcttccttcccagttgggatgccttttacttctttcccttgcctaattgccctgactagactctccagaacagcgttgaatagaagttgctggaacagacttatcttcatgatcttaggagaaaagcattaagtttttcactattaagtatgatattgtcagtggattttttgttgatgcattttatcaagttaaggaagttcatttgtattcataatttgttgagagttttttttttctcatggatgggtgttggattttatcaaatgctttccctgtgtctattgagatgggcatatgagttttgttttttattccattgataaaatgtattatgttaattgattttcagatgttaagccaaccttgctttataaatcacacttagtgtgatgtataattatttttatgtgttgctggatttggtttactacaattttgttgaggatttttgcatttgtattaataaaagatactggtttatagttttcctgagatgtttgggctcacaaaatgagtttggaacttttcccaactcttctattttttggaagagtttgtgggaaaatcgtattaattcttcactgaatgtttggtagagttagcagtgaagccatctgggcctggattttcctttgtgaatagatttttttatgattattaattcaatctcctcccttgctatagttctattcagattgccatttcttttttagtcagttttagtagcttgtgtttttctaaccatttgttcactttatctaagttatctaatttgttggtatacaattgttcatagctttcctttataatcctttttgtttatgttagactagtaataatgtctccttttttgtttcagtaagtttttgctccttttttttcttggccaatctagctaaagatttatcaaacctgttgatttttccaaagaacaaactctattgcttttttatttatgctttcactaatttcctctgtaatattttttatttcctctctttttttgctttggatttattttgctttttttcccagtgtcttaggtggaagtttaggtaattcatttgagctctttcttctttcttaatataggcatttatagctataaatttctctctaaacactactttaggtgcatctcatacatttttgtatgttatgtctttatattcattcatctcttagtattttccaatttcccttttgatttattgtttgacccattggctatttagaagtgtgttgtttatgttatatttatttttgagtttccaaatttttttctgttatttatttcaaattgcattttactgcagtcagaaaccatactttgtattctttatatattttcaaatttattgaggtttgttttacaggttagtatattgtctattatggagaatattcaatgtgcccctgagaggaatatatattctgtgttgttgggtggagttctataggtgtctgttagttctagttggtttatagtgtcattcaagtcttctatttccttgttgatctgtctagttattcttttcagtattgaaagtagggtactgaagtcttcagctgcttttcttgatttgtctttttttttttcatttctgtcagttttgcttcatgtattttagtgctctgttactagtgcttatgttggcataattgttataacttattgatgtgttgacccatttatctttataaaatatccctttttatctctagtaacttcttttgttacaaagtctactttgatataactataagattctctagctttcttggggtttctgtttgcataatgtatcttttttatctttgactttcaacatatttgtatatttgaatctaaaatgtgtctcctttagaaatcgtgccattgcactccagcctgggcaacagagcaagactccatctcaaataaataaataaataaataaataaaatgtgtctcctttaggtagcatatacttggataattttcagtcccaatctgacaatctccacctttgatgtggattgtttgtgtgtttagtcatgtttaaacttattattgatatagttgaatttatgtctgccattttattttttattttttatatgtcatgttatttttattcaatttcttgtttattgctttatttgaatttggcaaatatttttaatgctgcatattaatttatttaatgcatttttcactatattttgagggactttttagtggttactctagggattgctatatacatctcaaaatatacaaatcagcttcagattgataccagcttatttccagtgatacagagaaatgttagtctatacagctttattccttttccttatttttgtggtattattatggctatgcatattatttatcttaatgttataagcccaacaataagttattataattagtgctttaacatctgtgttgcgggaagtcagggaccccaaacggaggaaccggctgaagccatgacagaagaacgtggattgtgaagattttatggacatttattagttccccaaattaatacttttgtaatttcttatgcctgtctttactgcaatctctaaacataaattgtaaagatttcatggacacttatcacttccccagtcaatacccttgtgatttcctatgcctgtctttactttaatctcttaatcctgtcagcctagaaggatgtatatcgtctcaggaccctgtaataattgcgttaactacacaaattgtacagcatgtgtgtttgagcaatatgaaatgtgggcaccctgaaaaaagaacaggataacagcaattgttcagggaataagagagataaccttaaactctgaccgccggtgagccgggcagaacagagccatatttctcttctctcaaaagcaaatgggagaaatatcgctgaattccttttctcagcatggaacgtccctgagaaagagaatgcgcacctaggggtaggtctctgaactgccccccccaccccgggcatacctgtctcttatggtcgagattgcagaggtgaaataaactccagtctcccacagcgctcccaggcttattaggaagaggaaattcccgcctaataaactttggtcagaccggttgatctcaaaatcctgtctcctgataagatattatcaatgacaatggtgccaaaacttcattagcaattttaatttcacttcggtcctgtggtcctgtgatctcgccctgcctccacttaccttgtgatattccattaccctgttaagtacttgatgtctgtcacccacacgtattcgcacactccctccccttttgaaactccctaataaaaacttgctggtttttgtggcttgtagggcatcacggatcctaccaatgtgtgatgtctcccccggacgcccagctttaaaatttctctcttttgtactctgtccttttatttctcaagccagtcgacgcttaggaaaatagaaaagaacctacgtgagtatcggggcaggtcccccgatacatctgtagttatgtttttagttcaatcaactttgctcccaaacacctcctttgtgctgctattggcaagcatatgatgcatatgctgtatttctatatggtccaggcccaacaatacatcatataaatattatttacaccattgttatttaaatcagttaagagatgaaaggacaaaaatttgcatctatgctatttttttttttaaatcaatgttgaccaggttggcctcgaacatgcaacctcgcctccccgagtgccagagcaaccggcctgagccacagcggctccctatgctattttttataattacgtaattacctttactagtgttctttgtttgctcacgtgggcttgaatgacagtcctgaggcacttgatttcaatctgaaaaattttgctttagaatttcttgtaaagtgtaatctgctagcaataaattctttttgtttatcttgaagagtcttcaattttccctgatttctgaaagatgcatttctgaatataagattcttgtttgacaattttttttcctttaagaactttgaatatgttatcccactgtcttctgacctctgttgcttctgctgagaagtaagctgttagtcttactggggtttccttctaagtgacccgttatttctctctcactgctttccagattttcttcttgcctttgactttcagcacttttactatgatgtgtctgtggaactgtttgtagatttaacctgttggagttcattgagtttcctggatgtgtgggttattgtttttcagtaaatatggaaagtcttcagggattatttccttaaatatatgttctgttctttctctctcttttcactttcaggtagtcctattatgcctatcttgctgcatttactggtgtcccacaattttcttaggctctgttcatttttctttattctttgttcttttggctggcataatttttatcaatccgtctttaagcttgcttattctttcctatgctagctcaaatctactactgaacctgtccagtgagttttttattttggttattgtacttttcaattccaaaatttttatttttttataatacctatatctttactgatattttctatttaatgcaaaattgtcatcataccttcctttactcctttaattatggtttcatttagttttgtaaatatgtttataatgtctaccttgaagtctttgtctgataaatataatatctgattactgtcatgggtaatttctgctgcctgcttttgtttcaatatatgactcacacagtcttggatttgaacaccttgtaattttttattggatatgggatattttgtataatatattgtagcaactttgaatactagtgccctcccccaacccccaggcttattctaatttcctggtttatttgtttagtgattgactgtattattttaatgaagtctatgccaccacacacacccacttctgatgttgctcctctgggaggttcagctttagctttacaaacctggaatgacagtggttttggtagggctgtcttcctctgaccacacccagttgttaaaccccactaatttccagctgattaatccattattaacaattcccttaggcataaattgttctacaaactaacccaatcaaattctggctcctttgaagaaacagtttctgaagtcactgtttgatatgtgttctgacactatgagggcccttcccagatgtcttcttccccagttctctcctgcaaactagaaggcctacagtttagcctagatcttgacctgcctcccaatcatctttcaccacaattttcactgttcttgagagaatccttgagcttgaactcttttatcctcttttgcaaatgaagtaagttcctttaggaagagattaggagctgtctgttttatggcctgcttctgccttccagccagagctttgactctgggggctaggacaatggcaagcttctctcccagggacactttcatttcaggttctgaatgcccagtggaggcagggcagaagcctggggtcctcttggtccttacatctcctgatgtggaacaacttccagtcagctggagcaagggtgattatggcaccacccttctcagcatgccatgccaaggtagagtctccattccaaaagtaggggctgggtgaaagaatggagcccccattacctcatggcacttgctcagaacttggaaaggggtaacaggagaagattgcaaggggacaaaagaaaacctttgggtgattatgtcaattgtggtgatggtttaatagaggtatactaaaacttaacaaaaatcctatacatcaataaaactgccaaaattgcagaacataacttagggggagatatttctaatataataaagagttagtataagaaaagttcataccaaaggaagggagaaacaagatactaaaataggaataaattcagtcatgaactcaggtatcttccatctgtatctctagatagaaatcttggttgcagaggaggtagaataatggcagaatgcctggcagagagcttagcattcaccatgtacttgttaatgtttattgagtaaatgtttgttgagtttgttgcccttgggaagttactttcacacccatcactcccctagggtcagtttccctctaacaccaccatgataaacagcctttgatcacaacaggaagtcatattgcattagactcaagagtcattcagcacatcttccttacattgccttcgtcataataacgaagaatgccgacccattacatagacacaatatagcaataatatttagcgccttatctttttttaaatctgaccatctcaaaatggagatgataggttccatataccttccatgtatttccagttttaagaagctttaagaagtcgagaataatttttaaagaaattacattagttaataattttccatgacttggctcctactggagcctttcaattctacatgcgtcttttttctcagccaggctggtctctgtgttgctctaaccatgcctcattatagtaatagccgtcatttcacataatctaatgaacaccatgcacatcatacacacttcacatatgtcagcaaaaatcctcacatccaccctcaaaggcattaattattccccattttacaaatgtgaaaattggtgatcagagaaattaactaacttgcccaaactctctcagcaagtaaaaagtttctgtctgaccctccaaacgtataccattgggctctctctctgtctgatgttcagatttttgtctctgcctttttcctcctgccatttccttagtttggatcttcctttctctctttctttcaaggtcctgccttcagcacaaacccttctccaacagtccaggccccaggctcctccaagtacagcttgccaattccttgtctggcaagggaaaaggagggagagagagagagaaatgggggtcagaagtgaagccattagatgccaggcatagtggctcacacctataatcccagcactttgggaggctgaggtgggcagaaaatcacctgagataaggagttcgagaccaacctgggcaacatggcaaaaccccgtctctactaaaaatacaaaaattagccagtcatggtggtacatgccggtaatcccagctactagggtggctgaggcaggaaaattgcttgaacccaggaagtggaggttgcaatgatctgagatcatgccactgcaccccagcctgagtgacagagtgagactccaaaaaaaaaaaaaaaaaaagaagaagtaaggccattaagaaagccaggaggtgaggagtaggggatgaagagccaatctcaagaaaaggagatgaaactttgtctcctctgcctttcaaaatgctgtagcctgatcttgcttttgagagcaggtaaggaagatgggcaagcagaggaaggaaacgtgttgggtggaagattcttcttcacccagaaatggcttcagcactcaccaggaccagaacccaggctttgtagggcaggaatgaagggcgctagccaatttccttagcctctgcttcacacagctgtgggattactgatttctttgtccattttgttaattaaactaaaaataatttgccatcatccatcatgctttcaagagatagtctttagctatgagcatctgatttggagtagcagaggaaatgcacactctgttaatcaaatttcaaaaaccagaatccagtgggacctttgggccagcaaagtggggctaaagcatatatgccctgttgctgcacttaggtagtgaaccacttgaggaaaagaactgctttgaaaatctttatttcctgaatctgcagaggaggccaggagaactttctagggatgagggtgatgttctatatcttgatagaggtggtgtttacacagatatatagctgtcaagtcatcaaattgtacacttaagatctgtactttttactgcaggtaaattctaccttattatggctaatggaaagaaagaaggaaagtagaagggaaggaagagggagggagggaaggaaggaaggaaggaagaaaggaaggaaggaagaggagggagggaaaagaaaggaacagaaaggaagaggaggggaagggaagggagaggggaagggaggggaggggaagaaaggggaggggagagaaaaagaatcctcccacttctgtaaacgtaggtttgctgtattagaaatcctggttcccattgggcagtgcttctgtccaggagccaagtaaggattctgctgcacctgcagctgcaaatgccacatgggcactttgggctgctcttacctgtgagcccacacgtggtgaaaagactaactgcatgatggactaattgaccctgactgtcatgagaagatggtgctgccacaagtgtgaatgggaggagaagatctggaatgcagggagtcagtggacctctcttgaggcttctgtgtggcaaacaagaaattgcagccattctgagcttcaatgagagtaggtagaaaggggttgctgtgctggatagtgaaaagccaagatgaccatctgaaggtcagtcaaaggcttcttgtcaagaagcttccaggtttcctgatgagatgtagcttgagagtcacttcctttccaatggacaaagtgatggaacaagtgacctattgtagaattagtctgagggtttcacctacatttgccattatcctggcacaccctctccatctcagggctgcgccacctttttgtgtctgtctgatacaggctaattgctctctgtgtacataggcagaacaggttactgtaacaagtagagactgctatggagatttcattaaggttgacacattcatttcaactggccaggagcgtcagaccatatcccagaacactcaggcattctcaagtactaacaaataatccctgtaaatcactcacttccacaaaagtttaaaataaaaatagaggtagaggaatctttctccaactttttcctgatgctcttttctattctagtgtgatcctgctctatgttttccaatctcatcattcttgttcattgctggtccactcagtccttttaagtcaacagttataagtgtgcttacattctattagaatgagatctgatgacagggcttatctaaggctgaagtccctcaaggacttcccttccccaatctctctcacacatcaataagagccgcaggagtggctttattatgtgaatttattgtgccttctcttgaagaatatcatccaatgctgttttaaaattgtatctttcaaatgccatttgaaatggttataaggcatagaacaatataagctatggcatttgctaataagcattagcatggagccatatgctcccaaaatatattacactttccacaaagaagtcagagacagagtttatcaaggatagataccatacttctttattccctaatagctatagctatatccttagggttctatgctatttttattttgaaactcttaaatatgcagtctatttcatcccataaacatattaaagactaaatttaccacaggttgtcagactagaaaaagatgaatgagactctctaaaggcaggcaagctcactaaaaaaatattacccaaatgaaaactctgggcaacagaatagtaaagcaacactctttaatgttacttgatcatttggtcactaattccagaggatatttggtaaaatgttcaacagataatctgttaaatgagatgaaagcctgggtttgagaaataaaagtgctctctaaagttgtttgagtggaaactgtagggaaataatgagagagagagagagaagaagaagaagaaaagaagaagaagaaggagaaggagaaggagaagaagaagaagaagaagaagaagaagaagaagaagaagaagaagaagaagaagaagaagaagaagaaggagaaaaagaagaaaaagaggagaagaagaagaagtagcagaggaggggaggaggagaaggaagaggcagaggaggaagaggcggaggaggaggaagaggagggggaggaagaagaggagggggaggaagaggaggaggaggaggagaaagagattacatgcctgtaatcctagcactttgggaggccgaggcgggtggactgcctgagctcaggagtttgagaccagcctaggcaacacggtgaaaccccgtctctactaaaatacaaaaaaattagccgggcatggcggtgtgcacctgtaatcccagttacttgggaggctgaggcaggagaattgcttgaacccaggaagcggaggttgcagtaagccaagattgcgccattgcacttcagcctgggcaacagagcaagactccgtctcaaaaaaaaaaaaaaattgaatattttacctcgtcttaagagtttcatgtcaatctggcctttatccctttaaaaagggtctttctttttttttttttaacttctctctgggagtttccagaaacctcttttttcctttggtgctcataaatttaatgagcatgtatatcagttggggccatttctcattcactgcactcaggaatcagcatgccctttcaataggggattcatatcattcagccctgggaatttcctttaattttttaagaaatataattttgggccaggagtagcggcttatgcctgtaatcccaacactttgggaggtcgagataggtggatcacttgagggcaggagttcgagaccagcctggccaacatggcaaaacctgtctctactaaaaatacaaaaattagctgggcatggtggcaggtgcctgtgatcccagctactcaggaggctgagacaggagaatcccttgaacccaggaggcggaggttgcagtgagccaatatcacgccattgcactccagcctgggtgacaggagcaaaactccatctcaacaaaaaataaataaataaatataattttgttctcttaattttctctgttcactctttctgaaaagcctgatgaattggttttctatacttcctttgcttctctaatattttccttctttttgctctgactctaaggagctcattggattttccaggccttctattgaaattttttttaaatcctaatttttctttattaaagatctcagtttttttgtcacatttttgtaacatcttgctcttgttatctagatatgtttccaaaatctcttttaattcatcaattaaggggatttttaatgtcttcggattctcttcttcttttgctgtcagtttttctgttgcttgtcttggttttatgccttttatatcaaggcacataaaaggcataaaaccaagacaagcaacaaaaaaaggattgatcacagaagtttctccttatgtgccaattggtcttcagttgctcagttctagttaaatcaaaagaccagggtggctggtgtggtttcctctgctgttgagaacattagtctgttttccatcagtctcaccactgaatgggaattcttgctggatgctctgggcagggcagggcatgacagggcaaatagactggtgggctttctttgggtaagcagaaaaggaactggcattgacactgggctctccaagagtcaaaatgagaaagacatggtacacagactcccagactagaatacatattattttccaattatgttttagcataatttctttaaaacagagccctctgttctttggtgggagtagcatcctatccaattttattattgccattgaaaagaaatataattttaaataagtagttatcattgctattctaatttgtaggtaacacagtataatagaattagctatctaatttacaagttactgaataatatgatttttaaaaggaaacatatcaaaagatgtgaaagaaaagaaagaaaattttaaaataaagcaacataaacagaaaacataaaataagactgaataaatagataacacatatgagttatcataataattataaatgggttaaattcatctaacatgattcaaaacaattttagaattatccatcttgggttcaaaaccaaagtttgtcgacaagtattttacttaaatttactatactatctgttaggctactgtctcccagcttcaagcccatccttctaccttcagtatatgaggctggggcaggagctctgcaaacacatttatgctctatcaatagaaggcactaaagggatgactgaagcctggagtagaaagaaaaaaatgttttactttttcattctgagagtgtaatttgttccaccataagtagtttgttcctgaatgttctcccaacattccccaaaccagtctcactcccctgtaaaacacagacacagacacacacacacacacacacacacacacacacacacactttgaaatgccagcatttgttcttttgttttctgcatcaggtccctaaaatggcatttaaaagataagctgggcagacacctctcctcagaggtctaggccccagactcaaggggtcccctcctctgagattttaagttttaagaagtgcagcttctttcctttgttttccaggttctatgggtggtagctgcttccagcacttgttacttccatgatacttagagttctctttgtttcctttcaattacctgataaactttattcctacttaacaagacagtgctgtcttatcttctaaatgtcattgtagggacctgatgcagaaaaccaaagaacaaagactcaagtaacttccagcttcctatgtgtagaagtgaaagaggtgaataagtagactaatccagagatatgaatttgcaggctgggagcagggattgatcccagaagtttaacatgatagagagtattgatatgatacattatgtggcttgaacaggatagaaaagaagtaaatcaaagccaagaatcagctgacagactggagaaaacttcaggagtttagggtgatgaggtttgctgaatattaaattctggcatggtgaagtaagtaagaggaagaacagatagaaaggtgtttgcagcctatggacagttcagtgttgaagcggtccaggaaatgacaggatcaaagctgtggaattagagttgagatggaggcgaaggccagtaaagacaaggagattgttctacttaaaaatttagcggcttaaaatgacagtgatattttgcaattttgtgagtgaagaattcaaggattaaactgggcaattcctctggtctatgtgtcagtcacttgtttatattcaattagtggctagtctggcttagggagctcaagactgcttctctcacacacctggtgccttgtttgagacaactaggctcagctgagctccttttccatgccatatattatcagaatctccatgtatacactcttgtaaactagtcagacatggtagctcagcacttgcagagaccaaaacaaaagctttaaagactaaacctataattgcataacatcatttcctccatacttgattagtcaaaacagttatgggacagtccagattcaaggagaggagaaaaggatcccactcttatatggaaaggatgtcaaagaatttgtagtcaactttaacctgccacagaattcctactaagataggagttagctcatctagataaaagataacatgagttggacttatgagggagacaaaggaaatgttcccaataaatgtaggagagtagcccaaaggtgagtgacagctacgagatggggcagagaacagtgtactgggatgatattgcctctgtagttagctaacacagttactttcacctgtgagagagggtgggtgttatgggctgaattttgtcctcccaaattcctatgttgaaatcataacccctgatacttttgaatgggactatatttgaaaatagggtctttaaagaggtaattaaattaaaataatgtcactgggatggccctaatctttacaagaagaggaccttagtacccatacacacacaggaagaagaccatgtgtcttagttcaattggtgttgctataacagaataccaccaactgggtaatttataaagaacggaaatttattttgtcacagttctggaggctgggaagtccaaggtcacagtgctagcagatttggtgtctggagagggtccagtctctgctttcaaggtggcaccttgaacactacatcctccagaagggaggaacatttgtcctcatgtggctgaaggcagaagagcaagcaagcttagccctgcttgaagcctcttttatgagggccattaagctgaatcacaagggaggagacttcatggactaatcacttcttaaaggccccatctctcaatactttcactttggaattcacacctgaattttgaagggttacatttaaatcatagtattatgagaagacatagagaaaagatgccatctacatgacaaggagaaaggcctcagaaaaaaaaaccaatcctgccaacatcttgatctcagacttctggcctccagaacagtgacaaaatcaatttctgcctagaaaactaatgtgataggtgatttttgtggggtggggagagtgtccacagcacaagaggttgcagtggcaatgggagattggttacgtatggtggaattgaccaagcaaatgtattcaagacactgaaagccaagtttcccgctgtcagagaaggaaattaatacacagaaaaagaaaattagaatgaaccttccagttttgcattggaaattgagatattaggacaaatctatgattttcaatatataagtaggttgatagatagatacatacatacacagagtaggatacaggcatgtaaatgcttatatacaaatattccttagctctctcttcactgaaagagtctggaaggggcaataccttaaaagcgatgagcacatctagaagccagatcttggtatttaaataccattctctactaaaagaagacttggcttctttgagagatggccgattctagtactagggcagggaaagaataagaagagcctggaatgtcttgtgccatcaggaaagaataaagcaatcacagcacactgaaagcttaacaaaaggccacagaagccagcttgaaggggctcccattgatcaaatctaaaacaatttggttgtcaaaatacatgctgaaaataacagattataccccattgagtaaaagaggaaagcacaagtccatagtgatagaaataaataagtaaataaattaaaaattgaggacatttccatagttccaaagtagattcccccaaaatacttattaattacaaaataaaaaagagtaccttgatagtgaaggaggctggcagacaccagcttaatcaagagatcaaagtgaacattgtaaggaatggggcaaatcaagatcaggtgctacctgctagtgtattatgaggacatgacataatttctgtgggattcttgcccaaaatgcagaacctgaatcagattacaaaaaaaaaaaaaaaaaattcaggcaaatccaaactgaaggacattctgtaaaataacttgtgtgtaatcttcagaagtgtcaaggtcatgaaaatcaaagaaatacaaggaaaagggagttgttccagattaaccaagactacgagtcacgtgacacatgccctggcctggatccttttgctataagagacattatttgcacaactgatgaaatgtgaatgggtctgtggattacaagcttgtaggaaatcaatattaatttcctgcttctgatggatgtattgtgattatgcaggagaatgtccttgtttgtaggaaatacacactgaaggattcaggtgtcctgggggcatcaaatgagcaaaacacgctcagatggtttaggaaaataaaatagtgtatttgcattgcatttacaacttctttaatgtctgagatttttttacttaatgaaattaataacattgatattctttacccagaataataaatggtatctatttttagtatcagtcaaagtcaagtcaggggacagaaactaacatctacttaaatagagataatcgaatacaaacaactggcaaataagtaaaaagttattaactaggtaactgaaatggcaataaaagaactctgaggtaccacaaatgttgcatttgcaaaatgcagctaccattcctagggctagggaaataaaagaaaaagtttggaattattaaaacttagaaaccttgaggttgatccccatgggcctaggccccagacctctgaggaatctgagctcaaaagggagagtcagggacattgccatatagatgataagcatgtcaattctctatatctgtgtaaaaaagtccaacaaaacttaggctcttagaaatttatttttattatactcattgattctgtgggcactttagaaagaacacgataaggtggctctgtcaatcattttgggggcctcaattggaaggaccagaaagctgggggtgacttcgtgggtagggtcaggaatctcaagcacatgtggtttctccatgtggcttgggcttcctcacaacatggcagccttggatttcttacatgtcagtcagagcttcaagagaacctggaggtggaggctgtatcacctttcatgacctaacctcagaactcacatggattctcttgcctgcctggatttgagcacaggaaatacaggtactgctcagcatttagggaacggcaaggtcaccttgcagaagagcaggtgtgatgaggatgtagctgtctttggaaaatatagcctgcacataggtaaacttacaggtgtcatcatggaaaaagcagtctgcaaatctcagactgctatgacaggaggttaaaaccgaagcactaagacataatagaaacaaaattacaaattcagatcttcaaaagagatggctcagagccagtttgacaagtcttgagcccctctacctcagcaagggaggagcgctggagaaaagaagattttaggggaagggttttgaagagagcttggggaagaagtgggccctgtctctttcactcctgtctcctgaggggcttcagccaggggaagcatgagcatgagagtcttggggaacaccctggaggggagtctgattcctacccagggaagcctggatgacaggagagagcagtgttgaagcagtagcagagttgggggaaaggcaatctcctgccacgcttgggaggaaatgccccacattcaaccaggagaggggatgctgggtcctgggggcatgattctcaagacctggagcagaattcaaagttaaagtagtggttgggcactttgtcagttctgcctagaagaacctaccggaataggtcatgggccctaaaaattccaggctacgagaggggaacagcaggagaacgaggcctgggtgcgtggtggcctccaagggactccaagcaggggcctctgagcccccctcccagaagtttccatggagttcactcacagaagaaaggacctaagagttaagtaactcacccagggtcgcaagtagttagtggcagcactttaagcacctgccaggcctggaggatgcaaagacagattaagatccctctatctcaagtataactccctggtagccccctgctctgcctgcctgcaggaggcagccttggccactggtgaagcatgggttgtacaataaagagaggccgatggtgccttgtccactcccattgcttcccctcagtgtgcccggctgcagtgggcagagggtctgatcccatatccaggtcctggactttattcttgtctcagaaaggacatcccaattgccaagccaaggcaagagtgggtggaaaggtcacagggcctgcccatgttctccggggcagggcaagtttgcccctatgaaataaatcacaaagcagcagtggaacataaaagtcaaactgggacattcttgtggaacaggctgggcgcagcctcagggaattccatgtatgggtcacaggacaggccgcccagaggtgctagagggctgaaacagctggctagatgaaacgaaagaaagaaagaagtaagcagagaagaagtgacatccactaagaggaaggtgctcccagggccagcccctctcagacccgagcaagtatcacaaccctgtctgggaggaggaggcagaagaaggagcccagagaggcttgcaggcctttgcaattgtgcatcttagaccagagttcctcaggctccccatccaggttcagagccaacacggtggcagctgctcagggccgcctgttcaaacacagatcactgagtcccaaaatcattaagtctgggcttgacctgaaaatttgcatgtcatccccagatgaagctgaagcagttggaccagggaccagagtttgagaaggaacactgattatggtgtggtgtagcagcaaggggctcacctcgtgcctaggaatcacactagtttattttaaacactggcatggacagtgttaagtagtgtacagctttagtagaaattgaagattaatgaaaatactgcagaaaacacacaaatagatcatgtgctatatatgcaatcatcggcctgtaggccctaagcaaacactgctcctcctgggggcagcgcctgggagggaagtaacatggccccaagaagttcgacaggcctttgatgctatgcaggacagcacaaagctcgccagtttcctccatctaggtagagagccaagacgggagtggctgaagtaatgactgcctgctgaaatgagaattctttcatttggtaaatcaataattacaagcacactggggaaattaagcaaagaaaattacatcactctagtgttgcactagaatcatacatgcctacaaataacaaatcgggaattcccccagcagttataaataaaccacacacattgcacacttgcaaagggatgtgagtaagcagagtgtttgctcctcatcaatgataacacacatgtgagctggttgtaaatatgaaggttgtagcagctacaggaatcattgctttaaattttctgtagtgtgcgtatgtgtttgtgtgcatgtgtgtgaacgtatgtgtgaacgtgtgtgtgtgttttcctgtatgtgtgtgcatcaggcatttcccagagagaaagcactatctttctctccagggaaaaaaaaatcattgaatggaaagaaatggcaacaaaccacttggaaatctaaacatccaccttaaggatcagttcagagagctgaacagaaacgctccagcccacagaccccatcagtccacgtgtccacttccttccctcgtggttactctggtccttcattactttctgctgtgtaaactctagcccttcagactcactcacctatagccacgagccttagcaataaattgggtggggtgggggggtctctttcattttagggacatttcaggtacaagggaatataattattacatactcatgccaaaatttgtatatttttaagccatctgcatcttaatttctaaagttaatatcctaattttataggaaagaaaaagaggcaaagttggagaggtgagtgttgtccagaagttgacccagtggaggctgggggactgtggtggactcctgggctccagacgccagatgcacactggtcctgctgcctgtgctgcccatctcaggcagactcacctcttcttcctccatgctggtgcaccggatctgcccctcaacaccaccttcaaggccatcactgatggcatgaaggtttgcttagcatttctccagccacatctccataagcttctaaagtgtttgtgcacgtgtacactcatgtgaaagcacattgagtcctgagagtgggacttacatacatggcactttccagagtggagggacacagagggctaaaggcctggggaggagaggtaggcctcagcatgctcagcccagggccatttgcctggagcgttcaccctatccaatgctatctcccctcttcacctgccatcacctgccatctgatggactctaaccgccatgccggcagagccaggtcaagggatgggccagccagggatgtggacaggaccctgatctaacccagacataaacaccactctgggaagcgaggcacctccagaagagtaaggggtggaagagatggcattggccagaactttccccagatatgtggcttaagaggaaaacactgggaagccatccgggcagcaaagaagaccccaaagaacagagcttgaggaacgaagagaaatgaactcctttgaaagacatttcttctgagctggggccagaaatgaactgctcagggaaatagagatgggtgaggcagaggtgccatccgggacctcttttctcatgctccaaggagtactctgcctctccggatccacatcaagtgttactcaaagactcccagctggaaaggtaccatgtttgttctggccttgccttccacaagttttaggctggtaccaaatgaaagcctacggcttcctccctaatggcggaagatggcgcacctgctggccttgtctgcatcagcagagggcaccgactctccttctaagaggcactcacggagtcttgactctgccaatccaggctcactttccattttacgcctgcaggtttacctgattattaactgcaccctcactctgcctcccccaccaccatgcgagtattagcatcacctcccaaagacccc

SEQ ID NO: 80 - DNA, 11475 bp, Homo sapiens
  source 1..11475: mol_type = genomic DNA
ctcctttgtggagttttcagtgaagaactaatgagataatttgtgtcaaagtgacctacaaggtctgaggcactgttgaaatattagttatcagttatttaattatagctgtaatattggctctaatcattactttactctttcattcttatagctgatattcagaaatgaaaaatggtaaaaaattggagcctcaaggtcctggttttgccacttgttgtctgtgagcttggaaaatcccctgcatctctgtgcttcagtttccacatctctgaaatggggatgatatttttctctttgtctatcttgcagggcctccaaggagaactaatttggataattgacactgaagtgctttgaaaaacataaatgcttagcaacttgaagtaggtggatgtggactcttatctattgagtacctgtcatgatccccacttttgtagattaggtgttggcaaactattaactgcaggccaaatccagacttctgcctgttttgtatattccatgaattaagaatggtttttacattttttattgcctggaaaaaaattaaaaggtaataatattttgtgtgacatgtgaaaattctataatcttcaaaattcagtgtccataaatgaagttttattggaatgcactcacaacacactgagtaaatgggtggagggatggattggcttccatgcaagagttgtctatggctgttttgccagtgcaacagcaaagctgattacttgcaacaaagatcaggtagctggaaagctcaaaatatttactattgaggccttttcagaaagtttgttcacccctacttcagacatattgacttatttgattgttgcaaccctatgacattgggatttgttatttctctccgtttcacagatgatgaaactgaggctcagagaaattggctcattttcccaaagagatacagaataaaaactacttcaattccatgactactttattccaatgtctgttctctttttactgcaccatgatgctctcataagaggcaaattttcctcctttctgaggacccccaataatcatggcttcagtggctgtcctcctccagactacaaactgtgtgagggtagagattgagacaatcttgtttgtcactgtctatgcaatgtttagcatgtcgtttggcatgcagtaggtgctgaatagtaattctcgctgttttggacacatgtgctaggggtagccacttcattctatcacagtttcccccagcatttatgagcatcagtcttaaatttataaggtatactcattttctcctttcctttttggaagtgagtatcactctgccccctgaatgcagcaatttggagacattagcacaccttctgttcacacaaccactcagcgcccccgaaaaccatcttcaaatacccaaaacttcttctccaggccaaacccatcactcagacttcctgcaaagaggcaagagaatacctatggagggtattctatggagggtgatatgctgggagaaaacacagcctcggtttgtttaaggatgtagagtcagctagacctggatgttcatcctaactcccacaatgattggctgtgtgacatagggtaaggtcttttacctctctgagtttgtttctttgtgggtaaagtggggatgctaaaccccagctgtcagggttacagagaggactgaataggatgataggtggagaatttgcattccagcattgggttaatagtagatacccagtaagctctcctatggtttcttttttctgcaacatgcaaagcactgagctaggccattgcaggtgggtctctgcgagagggtgagggagagaaacaaccagataactccagtaccagcagggtaagagtgctgcagaggaagcccagagaaagagaaacaggatgtagctttcactgagcatcccttgggggccaaatattctgaacacatcactcacagaacctctgagtctttccaacactcctatgatataaggtgcatttttttcacctcatggataagagagctgaccagagaaatcacatgtctgggccaaggtcatacagctagtgtggcagaggctgtgatgctccggccaggttcccttcaagcggggactggtcccagatgctgcctgtgtcgctagcatgcagtctttagctgtcagcccttatggggactgcctcggcctcacctaaggtcctgcccctgctcggtatgacccacaaccatgactggttattgcaggagtatcaagatctaaatgtcttagcccagtttgagccaatgctgaagggcctctttagtcctgagctccctatggggttggctgaagttgtcattgagcctgtagggcagctgaacttcttctccctggtcctccttctgccctgtcccttccaaggtgtcaataccaaagccactccttaaaaaacattctgcttgttgaactcagattctgttttcttagcaaacccagtttgcaatgacagttactcagtgatgaaactaacaattgaaccacatctatttatttctccatttaacctctttctgtggataacttcattactattaatagataaagtcattcattcatttacttattcaaatatttcctgaatcttccaagaagtgtgatccctttcttaatccctgccttcaaggagtttagagtacaataagcttacattagttgtttctgatataattgtcgtcctacatttatgtgagtgctgacatttgagaactttaactgttcttgttattttaattggaagttgagagcagtataaattttaaaaaataataatggtctaatgcagacatcagtctaatcctcagttcttctgagatgcccccaccgtacctttgtatctgcatgtgcctgcatactcaaccccaccacttctgcttttgtctccattttcctcctcatttaattctgtgtcaatcctctttatctttgagagacgctgtgtgaaatgctgatacctctacaaaatacgtgctaatgacaaatttgaggactgaaacagcatgggctgaattagggtaattcagcccaagagggttccttctgagcagaggccaaattctacctgagagcatcatccgatatggcagagcagcctaatgaacctttccttgcagagaaagccctgttctccttctctctctgcattcatcaaccagacaccctgcagctgagtgcacagacagttcctggccccagagtcgggctaggcaaggtctccaggctattcaaaaccccttccccacagcaataccatctacctccaatctagctagctcagtactttccttaagccaccgcattagggacttgaagtgtaaactagtttgacctttcttaagggtatgtgatattgggtatcaacatttaaatatgcatatctcttgcccaagaggttttgcttctgggatttatcctaagaagacaagcagacaagtgtgcacagctgtatttacaaggatgcttactgcaacatagtttacgatagtcaaaagctggaaacaatctaaatatctatcaataggtgattgattaaatgaattataagtctaggtaatagaatactgtacaggcattaaaaaatacggctgatctttaaaaaatagaagggaaaaatctctagggggtattattaagtaaaaaaaaagacaagtgtacactgtaccatccttacatgtttctgtatataacatgtgactgaaagcacagagtgacacttggaaggaagtccactaaaatatgaaggtggtcaccagcatatggaacttcagagttttttaacctgttaatttttagaaatattgcttggattttctacagaaacatatgctaattttattgggggagggaataagcgttgtgtggccttgggcaaataattttctctttcaatactgagtgaaaagggggctactattacctgtcaatataactattaagtattaaaagaaaatgtatctaaggtgtttaaaagagagcctaaaacatggcaagcctccatttatggtcactggtaatagttattataaagatcccgggatagggcagacatcctatacaaatggcctaaaactatgacaaagagacgacaacccccactgggccaaacttgagccctcttacccccatgggtatacacgcacaaatacacacgtgcactgacacacacactcatctcacattcacaaaacaccagttacactcacatacacttaaccacacatggtcacatcacacacattcacactcatgcacacatatacaggcatacattcacatacatgccctcacacaattcacactcatacacacaaacacatacattcacactcacacataaacacacacattcatactcacacaaactcagtcacatcacacacacaagcacacacattcacagtaacatacacataaatgcacacacactcacatacacaaacacatgcattcatactaatcacatgcattcatactcatacacctaaacagtcacatcacacacaagcatacatatttacagtcagatacccgtaaatgcacccacattcgcactcacatacacaaatacacacattcacactcacacattcatagtcatacacttaaacagtcatatcacacacacaagctcacacattcagtcacatacacataaacgcacatacattcatattcatatacatctaaacacacacacattcatacacatatgcttgaacacacagtcacctcacacacaaacacatatcttcatactcacacataaacacacacattcacactcacatacacttaaacacacacattcatacttacacataaacacacacattcatacttatacacctaaacacagtaacatcacacacagaagcacacagattgatagtcacacaaacacacacattcacactcacacataaacacacacaatcatactcacatacttaaaacagttgcatcacacacacataaacacatacattcatgctcacatacagttatgcatacccagaaatacacatataagaacacacaatcctacatatacacacacacacacacacaggtgtgcatgtttagaagatggagagaatgaggcctgaagaattgactcaatgggaacccgccccttccctgcctgccaacctactcacaccctaggtaccctccacacaggctccagctgctttttgctggctcccagagcttatctccctatgagaggagggaggggtggcttgggagagacgagggtgattgttcaggtttaattaagcatgccacccagagacaggcttggcggatgcactgtaagacacattccgctgaactcagaacctctgttctctaggcgtatgcaggcctgacaaaacatttcaaagcagaggagaacattaggaacggagggagctgacagctcctaatagcacagtaacaaggagacactaataaagcgtgtggctgtgagctgagcagctccagagacagacggagactacaggccttcttcaaaggcatgttggccatgcatggaccttgcttttggtgacttctgtcctccacacatcacagaacagggatataacctcttggtgtactatgctcagaaccctcgtgagcaggggtccctgcagccagaactagcagatccatccttgctgagagccctcttaacaatgatggggaacagaggaatggagcaatgtggtaaatatctccagaaggaaggaaaacagggagggagagaaggaagaaagtcctccatttcctaatggcatatctatggtaaaaaagtactaattacttccataagcaacccatgcaactattcatagatctagttatcttttcaagacaaatgttactaaacacctactttgtgccaaactctatgcattgaagatgaaaacaaaacaaaacaaatcagaaaaataaaaaagaccttgtcttcaagcacttagcagtctagtagggaagtcatacaagtaaaaaagacaattagaatatattgtaaactcccaaatccaatgctctctctccactttcttgttaaattcttctttgaaaaagagttatgtcactgattccaatttctcaccactcatcctcactcaacccattcctatctgctttttgccatatttattccacatatcccaccttaccgtggttattgatgacctccaatttgccaaaactgctggtctccatctttctcttactcttaggtgacctctgagtagcctatgacacagaggaccaaactctccttaagaagcatgttctcctggagatcctgtgacttcccagcatctggtgtttctctgcctccctgacccgtcctccatcactggctgactttttgttttcttgtctccatttccaaataatctttctgagctctttttctacctacatttcccctagacaattgctatggtctgaatatttctgtccctgatgaattaatctgttgaaattctaatggccaagatcatggtattagaaggtgaggcctttgggaagtgattaaatcatgagggtggaaccctcctaaatgggtttagtgccctgagagacccgcttgcctcttccaccatttgaggatacagcaagaaggcactgtctgtgagctagaaagtgggctctcaacagacagcaaatctgccttgattttggacttcccaccctccaggactataagaaataaatttatgttgtttatagattatccagtttatgatattttgtatgggagcacaaatgaattaagaagacaatctcatctaaaatattttaaaatcatctatgctctggtgactactaaatgggtaagtttgggactcaactgtgaggtgtatttgcccatcaaatgaaattattatgaccagttggatataccttactttactataaagaaagacccaggctggagatacagatttcaaaaacaacatacatgggatgctctgaaagtctgtagcccagagaaagtgtgtggggagagaagacaaaaatactaagcctaaagccccaagaaggctgggaagtatctaaagaggcaaaagaaaaccagaagtgtactatacagagaagtcagggaatgagttttcaaatgagtaaacaatggtgctaaataaaagagttgggatgaactgaaaactgaatcacatctattggatataaccataaattggtgcacttttggccttgggagaagcagtgactgtgagtgatgagtgtagaaggcagactgtggtgggcgggagagtaagtgggaagtgaggaagtggagaccatttgcatagatttctctttctagaaggctggctgtgaatggaagacataaggtggtagctaaaggcaaatgaggaggggatgagtttggagagacaaacacttatgggctgaaggaaaagaacaggagagaggaagatacttaagtcaaaagaagaagttattaatgacattgtattccttaaaagattggagaggatggggtaagtattaggcaggagaagaaacacctgttcccctaaggcaggaagagatgcaagaatatatgtgtatgtggcacaaaagaagaaagtctgaaagttatgctctttcttgcctgatgatctcacttgtattttgtctttaaaatagtggatgaagctgggcacagtggctcatgcctataatcccaacacgttgcaaggtcgaggcaggagaatcacttcaggtcaggagttcaagaccatgctgggcaacatagcaagaccccatctgtacaaaattaaatatatatatatgggcatggtggtggggtgcctttaatttcagctacttgggaggctgaagaaggagtttgagtttggtgagtaataattgtgccactgcactccaacctgggaaacacagcaagaccttgtctaaattaattaattaataaatagtgaatgacataagaatactgaggttaaattgggggcataaacaagggctctgagagttaaaaaaaaaaaaaaaactaaaaagctaccgcaaggatagagaaaaggaggagatcaacaagagaacttccaactagtgtcaaagacccagccgatattggagaacatagatgggggttggtgcccatttgcactaggtgtggattatgccaactgcagatggctattcccaaggttgtaggaaagatagttgattttttttattcagatctaggggtctataccagaccagtcctttcctcacctacatcttctacaggacaatgattatagcaacagcagctaccagttgctgagtgcgggttatgtgccaggtgccttatatacaatatttttaattcttagaatagtgctgaaaaactatttccccttcatcctgagaaacccaggtcccagaaaggtgacatagttgatccaaggtttcatgagcctgtctgactccagatccctggctctttctctataccttgtcacaacctttgaggcttgacatcagctgtcatttcctttctgagcatttgcttctccaagataaacagttccaggctttgaacaccttcttatggaagcttctttccagtactctcctgttttccttcccaaattgttagtttcctgttcttgaacacacatgtatttacatatgtttttttcaaggtgatgagtaccctacggaaaagccaagactcctcaataaaaagttcttgagaaggactctcttgagggttttccccaagggcaccttcacatgttttaatctagtctcctacctaaaccaatgtgctaattaagatgctctctgaggagccaagaaagtagaacctgccattatatggagcttcaccacctctctggctccccttgcaaaaattgatcctgtgctccagaaagaccaaaccatttactgtcttatgtattttctgtcatgttttctgctttattcatctgctgatctctctgcctaaaatatccattcctttgtccttgcctaacaaccatttacccttcaagattcaactcagacatcatctcttagaaaccttctcaggtagtctggctacatcaggtactccttgcacttcatgcttcctctatcatcacacaggacttgtagggcacagtgattaagagaggaagctaatggactcaccagtcagactagacaagacctgctacagggcacttaatgattgtgtcactttacccctccatgttcccatttttcagctgtcagtggaggatagtgaatgtctatctcataggtttgttgtgaagaagaaataaggtgatccacataaagcacatggcacataatcaatggtagttattcttataacatgtatcaaatagtactacatttatgcttatctttctcccaccatcccataagtaccaagagggtaggaacagcatccaatttatggttctactcccagcacctcactcagaatctggcacatagtaggagctcatgaatgaatgaatgaatgaatgaatctaattcatctcagtgtgtactgtctttgggatcacattatctgaaattacctacttaatttccattatatttagagtgaagatgaagggtaagatatatctttttcaattaaagggcaagaggcctctccaagaatagcctgatgacatggagatttatggatcaagtgccaggctctcagcagtccatggacagttggccatgcccaactggaatatggtctctttcatttagaaattgtcaaggccaagaggccaggcagccaggagtgtaggcaggcaagagaacatctagggtacatggagggatgaggactctacatcagtgccaacattccactactactcatgcaaacaacctttcttgctgtttatgactggtggtcaatctgatagctccaggatccatcctgattgcctggcagccatgccattatatttacaaaatatattaaatattctctcttttaaacatcagaatcctaggttcccagcaggactgaaaaagttgataaggaacccaattagagaactgcaaatgcaaagactagatttcaggttgtgatatggtttggctgtgtccccacccaaatctcatcttgaattttagctcccataatccccacatgtcacgggagggacgtggtgggaggtaattgaattatgggggtgggtgtttcccatgctgttcttgtgatagtgagtaagtctcacgagatctgatggttttataatgggcagttcccctgcacacgctctcttgcctgccaccatgtaagacgtgcctttgcttctcctttgccttccaccatgattgtgaggcctccccagccatgtggaattgtgagttcattaaacctctttttctgtataaattacccagcctcaagtatgtatttaatagcagcatgagaacagagtaatactggtggtcagaagctaagatcaaggaggtggacttcaggtcaggtaaatgccaaccatgtagttgagtcagtgacttagaaatctgagcactgccatgtgaactattccttaaaagactctgtcagccagaggttcactatgggttacaatgatcactgagccccattcccaggacttccctcctcctcaactcccatctccctagctctcttctccttacaccagagccatgtaatttgggccagcagtctcatcttggctgcagtcatcaggacctgattccagtcaaaggaaatatatgaacctccgggtcagagctcagggggcttagctttaggctagcacttgattctcatgtctgttgaaaatacaccaaatggcatagtcattatttctttaggggtgtgtctttcctgctagcctgaggctttcctagaagcagtagaataaaagatggaagagaaaaagaaataaaggaatggaaagcgaagaaactgagctggctcctgcttttcctctctttctagaaaccagttttggacactggacctccatcctatttttttttttttttgaatacctgtcttgatagtctgcccagtgagccatgttcttttatccttgatatttttcttttaggacatagaactctaactctaaatttttgccccttttctggggccattagcctttagcacatgcttgattctcactgcaaagtcctggatcccaactctgagctaacatttacctgccctgcccaagggggtctgtatgaaccttcccaacctgatatcataaagctttttcctctctgaaagtctcttttcataaagtttatattcctgccaaggtcttgaccgagaggtctgtggattctaagaaggaaatgctgtagtcaggtggggaggtcatgagaaagatggggtcacagaaatggtggtagcttaataacaggaaaggcagatggaaccatgcctccttcataagggagaacctcacacaaa

SEQ ID NO: 81 - DNA, 51900 bp, Homo sapiens
  source 1..51900: mol_type = genomic DNA
ttcgaagttgatgttgcatcctacgaacataaagaacttaaacattctaacatgtctactaaatttttctaaatggagagcatatatttgctcagtttgggtattaggattatggaataagttaaaaaactatccttttttgtttctttctctggatcagtttatataagatagatgttatccattacttgataatttgataagtcttgcctataaaatcccctgggctcgatggcttcttttcagttgtagatatttagctcttatcatttatttccttattatctgcctatttagattttctatatcctcatgactcaaacttcgtaatttatattttctaacattataatgtattttatcaagactttcacatgtattggtgtaaagttctatgcagtgttctcattaaatttcttttatcttttatgtttctatagttaaggcactagctcattcgtaatgtgttcgtgttctttctttgctctctcctttgaataggctttttgtattttgtattttattggtgagctcccttttttcttttctatttaatttatttcagcttttatttaattccttcctgctgttttatctgactttgttttataattctttttatggctgcttaagtcaaatgcctcatttgtttattttcaatctttcttgcttcttaataaatgtcttgaagcttctgactgtggctttgcccacaccccataagtctgacgtgcagccctcatgctcctgctcatttctaatgaggtgaaaatttgagtttgattttttccatatccaagtgtcacttagaagatatttaaaaatataattccaaaatagataatttgtttgttcctctttttctaatattactgcatttttagactaacagtgtagtttgtataatttctatgttggtaaatttttgagattctaaggtagtcacaagttgagattttagagctaactaaacttgagttcaaatacaggttgtgccatctaccagttacatgaccttgatcaagtctgctaatttccgcaggctttggtgtcataatctattaaggaaaatgacaatccttatcatggggatgtgaaaattagagataacttatacaaaagatgaaactgtatctctcatatagtattcaagtaatgcatcagctattatgcttattattgttattgttgttgttacttagtccattaacccatttacatatcccaggaagtataaatttatttctattggttctcatatcctagttgctggcctctatctagatccagatttctgaaagttgacatagttgccattctttgattccttttttgtttttctgctgcttcacagtgtatgtttgagaacttcttatgttgcattcattggaaataaggtatacatataatttgtatatatttttacatgtggaattatcatatagaagttaaatatatgcattatttgtgtgtgtgtctctgagtgtgtgtgtgtacatacacacgtatttgcaaagctcagtcccacattcaggatcccaaagtttagtggaatgcttttgtatatatgacctggtttgctccttataacctgtaataggtagaataatggcctcctcaaaatgcccacatcctaatcccgaacacctgaggttatctgacatggcaaaggagactttgaagatgggattaagtaaagaattttgagctggaaagattatcctggattacttgggtgatctcaatgtcatcacatgtttcccataagagggagataagcgtgttagtcagaggaggaaatgcaacttagaagcagaggagaataagaggggagcagagtaacggaccatgagtcaatgaatgcagatgctccctagcagttggaaaaggcaaggaaatagatcttcccctaaggcctccagaaggaatgcagccctgccactgtcttgattttaagaatattgaccttgagaactgtaaaataaagtgtgttattttaggacactaagtttgtggtgattcattacagaagcaataggaaatgtgagacactcacagggaggtattgtctccactttcagatgagaaaattgaggtttacagaagttgagtgacttgcccatggaggtatgtctagtcaatagtggtgctgggaatcaaaacttaggagctcaagacgtgtgtgtgaatgtgagtgtgtgtgtacgactttaagcatatcacaactgtggatttacagtgatttttcttttccctgtgggtgggaaaagattgtggcttgcaggagagattcagggggaaaaaaattcccatccttgtaaaggaaaatgatcccctgagttttgaaacaggagcagttctcccccgccgagccacctaagggcataggaaggtttatgctaaggtctatttagttgttgggttttttttaaattttatttttgtactatgacacataattatatagcttctttagaacattctgtcatctgggagattttcctacagaaattctaaagagtgtaggctcacaggaaaccagccaagatctacatgaaactctatttatacatgtgccaaaatgaaaaatataaaataagtgcagagatacataccgggcattttagctgaaggcaatggatgtgttacccttaacacacccatcacattatagagaataccaaaactagatgggattttagagagtgcaccataaaaccttctatgtgtttagctcagagcatgttttatttaatcctcatagcaacattgtgagatgggtactttcattccaacattgtcacagaggatcctgaggcttgggacatctaagctcactaatcaaggtcacatgagcattttggaaaagccagaaccttgacttgggtcttcttactccaaatcctgtgctccttccagttaattacaaatgacctcttcctatctgtttgttgtttgaaggagaaaattgagactgacagacaaatggtattgtgtacaaactctcaaagcaaagtatttctttttctcatgtattttttccttatttattaatttattcttcaatggtttgtggaatcaacagaattatcaaaatacatatcctagaaactttttgaaaataaggaaggaatcaaatccttaaaaatattaagaataggccaagtgcgatggctcatgcctataatcccagcactttggggggctgagactggcggatcacctgaggtcaggagttcaagaccagcctggtcaacatggcgaaaccccatctctactaaaaatacaataaattagctgggtgtggtggtgagcgcctgtaatcccagctacctgcaaggctgaggcaggagaattgtttgaacccgggaggaggtggttgcggtgaactgagattgtgccattgcgctccagcctgggtgacagagcaagactctgtctcaagaaaaaaaaaaaaaaaagagagagagagaaaagtagttaagggtaagaatagctcaaggagctgcacaacaggtagacttggaccaacgttaggaataaatctaagtatcctattactaaggcaagaaaggaacaggttccttcccagctttcctagtgcagaaacctgtgaaaaccccaccctgggatcatcagggctagaaccagcacctaaggaactcaactgcattaacccttctaactgatatcatgggaatctttttcaccaacaccctcaggattgtcccaacattaaccaaacgaagatcagaggaggtgttctctgagcggtcttgggttgcaggttttattcaagggaaaatttagagtttctagaaaaagaaaagaaagaagtgaatagaaaatggaattccatgggaaactctggattaattatatagcagattttatctagtctaagacccctaataatggtaagaaacactctcagtttacataacactaagaaagaaacaaggaaaaaaaaaagactgccaaataaactctgtcaaatcattaaaactaagataccttcccacttcagaaatgttaaaatgtggaaaatatgggcactttagaatcaatgaaatatgtttctccactgcatgatttgggagagccttgactatccccaggcacactgggaacctgtaagaggcagttaggagtgcagatttttccacatgggaaactctgaacatttagtttgttgttgttgtttaatatttgaatgtctcatggaactaatgttccatacaatccacactggaaaatagctatccaaacaaatggatggatattacgtgtttccatcaattgtcggtgagcattttttacacctgagcttttacaaatgtttaaaaagaagagaaaacaaggttataatgtttgacaagaacctggcatgaaagtattctatgttaacgattagaagtaaaattcacgttctccaaccagaaatgaaaggggtaagggctcaggctttaacctaaaaggtggaaaccacaataaaacaagtgcctgaatgaattcccccatctcccaccaactcttccacttgttactgataatcaaaatgaaggccattgtctctgttctgtcgttcagtgttttctactgttagactagacttcagctttgacaatgaaaatacgtggcttccagttactatgcatattaaacatgtttatctcctttccctcttaaaattacataaagagaatattagacagagaggctattaaggactatttgaggctggatgtgttatttgagctaatgtgtttttagggcactttcatttaaattggaagcaagaaggttgggatatctcaagcttctatcccaattttacctcctaactggccgtgagtgcccccaccttgagggcctcagtttcctcctctaaatgatctgaaaaatactgaaacttaaaaaatgttaatgaggccgggcgcggtggctcacacctgtaatcccagcactttgggaggctgaggcgggtggatcacgaggtcaggagatcgagaccatcctggcaaacacggtgaaaccccatctctactaaaaatataaaaaattagtcgggcgcggtggtgggcacctgtagtcccaactacttggcaggctgaggcaggagaatggcctgaacctgggaggcggagcttgtagtgagtggagatcgccccactgcactccagcctgggcaacagagcgagactccgtctcaaaaaaaaaaaaaaaaaaaaaaaagttgatgaaatggctcactatctcttacataggaatatatgagaaataactctcttagcaaataacggcagaaaaaggtgtataactcctgaaaacaaaacaaaacaaaaaaactacaactttccttttctcatacaaggacaactatataatccactatgggtattttttctctttctctgtttactttggttgccaagaagcacacagccaaatttatctcatgttgagtgactctttcattttgagcttctgaaaccattttctctcccctccttaaaatggctctgatgattcctatctttatatgaatagccttttaaaaatatattgtctttatgtgagtaaaataagttctcttggaagtgtgcatggtagactctgtaaacacatacacacacacaaaacagacaaactttgttgctaggtaacttgccaaggtcttcacaggaggtgatgccctctcacctataagactggttctaaggatttattctacaggctttagcttagtgtccaatgaccttctcaatctatcttgaattcacctgcttctgtctaccattctggtacttgtgctctgtcaatatcaatcaggacccagtgaggcttaggcacctctttgcccctgctggagaagaactctactcaatgattatttgcacctaataaaagaccaggcacagagtagtcacaacaaatcttaggcggatgaattctttaattcaatcattatggttctaaataagtctttgggccaagcagtgggaatggcaatgaagacatgcagatgcctaggatgtagtccctgctcatgaggagttcacagtatgacagaaacagacaggaatgcaggtaaatcaaccaagctatgaggctatcacagggagagccatggggcctgtgcagccccagagaaaggatgatttactctgttttggagaacgtaaactgatgagagggcagccagccagaggtccagtctccaagagatgtcaagatttcactgggataaataagaatttgagacaaaatgtaaatattcctttcccttgtaggtagaaatgaaaataaataaataaataaataaatagacgagggaaaatgtcatttctatataggccctaaccccatgcaacattcagccaatatttaaatagtatccatttgaaaggatgaatattggccaggcacggtagctcacgcctgtaatcccagcactttgggaggatgaggtgggcagatcatgaggtcaggagatcgagaccattctagctaacacgctgaaaccccatctctactaaaaatacaaaaaattagctgggtgtggtggcacgcacctatagtcccgggtactagggaggctgaggcaggataatcgcttgaacccaggaggcggaggttgcagtgagctgagatctcaccgctacactccagcctgggtgacagagcgagactccatctcaaaaaaaaaaaaagaagaaagaaagaatgggtattaattatcttgttccaaggtaactgcataactcacacctgatgcctcttagggctcagagaaggcttgctgaaaaagtgatgcctgaattgaaacttggaggcgaaagctaaagggccagggacaaatgggagtcagtgggggtacaaaggagaaagagacaggagacagagggaacagtgttgtgaaaactccagaaactgaaaccaggaggcttaacttaggaagaggaacctagctggaaatgaaactggaaaagtcagactggaaacttctttagccatgttaatggaggaactttgcttaacaactattaattgaaaacctactatgtgccagtcactgttttagctcctggagacaaagtagtaaacaagagataaaatccagtaattacataattaaatgagatggttttatacttattagactaattataattatggtttactgagtgcttaactatgacagctcctgtgcatgtataatttcatttaatcttcacaatggtgctacaatcacttctaattctacatgaaagagcataggctcagagaaattgagtggcttgccaaagatcacatgactagatgtggccagaggtcagcaatgacatcagatctgtcttgactgagcctggaaccacaatacctaagtttcaatctcaacaacctcacttaccagatatgtgaccttggacagttactgagccactctgtgctttttttaaaaaaaaaaaacataaaatgggaatcataatagtaacatcgcttgtagaattgttatgagaattgaatgagctaatgtacccaaagcacttagaacagtcatggtacgtagaaagtcattagtaaatgttagctgctattattaacctggttgcaaacagatttattaaaccttctcctacccagaacactcttaggaaggtcatagagctttgagcaagttgggaaggtccccttgataatgagtttattttgttttccctgcttaattcaatagcatcccacttctctctggaccatctctctcacaagtatctgctaatagctttcattgtttacagtgcttctaacaagtgtggtaacttctcatttgcattcctaatagacagtttccaaatcctgttgaaactgcagttggttttaggatgcctgggttttgttttttgttttttttgtttttgtcctatttattaccatttggatgggttttaacagctcaccacacactctcacccattcaatcttctttaagacgctcacagtcctttcacaatatattaacagattagtcctgtctagtgcatcaggtcactagcaaatgttattagaatcacttaagttaatttatttaacaaacacatacagtgctaattctgtgcaggacattgttccaaagcatttcacaaatattaatgtaaatggtaatatatttagtccttataacatctctatagacagatattactattatccctgttttacagatgagaaaactgaggcacagagacataaattaacttgctgaaggttacacagcaaggagatgttgagccacatcactagtcatatgaccttgggcatgtttcttagccttcagagggtaacaaatatgaaatactttcctctcttcagaattatcattatattaaggtaggtattaaaattttactggtgagaaaatggaaggtcaggggtcctgaaaggcttgccttatggctaagggagagtggcagagctaggattacaattcgtgtcttttgaatccacggttccctgtaatgtgctgtggatggaaggtggtaatagtttctgatgtcaaaatccattattgctgctcctgctgctgttactgttattatttaccacagaagaacagcccccaccccaccccaaacacacagagagaaaaataacaatgacaagaacatggctgattctggatgcagcctgcagatctaaagccatgcataatttactcaacactgccctgcagtcacttaagctgaggagagatcgctataaattcaggtctgcataccctaatttatttcttatttattttgctgatacatatctagggcctccagtgagctgcttctacacctgcacaaaggcacctgcagccctaagtgcaactagggcaggaaaggagaccttgaaataagccctggaagaaaaactggactctacacactagaatcatacaagtttaattcatttttctggtaaactggaattaaacccatgcccacactcaccccctatttgtgaaacacaggactgaaaatgttgttacatgtcctgttctgcttttctatcttagtaaagacagcattaaatgtacttcttccatgagtacaagattatttttctgagtcacagaatgtcaaaagataagcaaatattctaatactaagacataatcagaaagggaatgaagagaagaaaaaagtctgttcttgtaagtgattactaaggaccaaatgctatatgcaaggtgctgtcaaaggcagaagtaatggccattgcagtctttaaatggaaagcaatgtaagttggaagaaatgtcagccatccttccccaaagatctcttttcacagatggtcaaactgtggcccagggagagaacatgacttgtcagaagtcactcagcaagttggtcccaacgtgttccccttttagcctcatacttatttcaaaagtcagtttgagtccttcaagagccagagctgtcctacaagcttcacctgtgttgtttcctttagccctcccctcctccagttaattgtccttacagatacggacattaggacacagaaaggctgaacagtgccctcacattgctacattcctgctgaaaccaagcttgaaggctggacttagcctgtgcttttatgcaccatacctgaagcctttgtgaaccttcaagacgtctgcttttgtctccaaactgcactgactaggcccatacaggtagattcagaagggcaggaggcttcagcaggaaaaagctcctggctctaggatgaggcctgggcatgggttatatttattacatttattaacccaatctttatttttctcatttttttcttttttaacccacccaacagaaggttatacttttggcttttggctcttggactaaaacaggaaaggcagaaaggccattttattgaaggtcaaggttcagccttgctgagctgtagtgtctgatcattttcccatgcatccctcacttctgtaaatggggcacctgggccttggggacagagactcacccgcagaacatgaagatggtgctcgaagtggcatcgtagggcaggggcagcgtctgctgcaggcacagctgctcacagccgccattaaagccatcagagcagtcaatgcctttggagtggtcgtagcagccagagccatccttcatgggtttcagctcctcagggcactgctcagagagagggcaacagggtagttatggcttgggaggttgtaggccccatcacaccctctcctccctcctggaagagacatgtgtcagggcctgacagaaaggtattcagtctccttttgtcagttaataactttgtgacaagttccacaagtccctttacttctctgaacctcagtgtgcccacctgtaaaatgggacttttgtgactatctgcttatagtgttgtgagaatgaagggtgataatgtcagcaaagtgttgagaacactggctcacacggcaacagcacagcaaatgtcagctgctgctaatattgatattgctgggatcatattcattattgtttctactgttattgccctatagggtctactgctagaagggtcacatagggaggctgccagatatatatttaaaagcctctaccagtatgagtgtaatttccagcttttcctcttctcactgtgtgacccgagaagttacttgccgtctctgagcctcaatgttctcatctaataaatgggcacaatacctgcaactacagatttgttgtgaagcttaagttggatcatgggggtgcataccttacttcggaatttggcacataatttggtactcataaaatgtgaattaccttccttcctgtcttgaattagtctcttcttctccaccattatccctggagccctaagtaagattcctgcatactcacatcaccatgaaaagggctcctagccagtctgctggactccagtcaggccttctcaaaaccatcctccaaatggccaacagagtgctatttctaaatagcatcactccccagcttaaataagtaaatgaatcttaaaacatgtgaagctgctataaactgataatcaaggtcctccctttatagacaacctagtcctctgcttggccatatgcacagccctccccatagccctctggtccctaagtaaactccaaggagttcaaccttcaatggcctcagctagaacgctcttgtcagtgggtctggcacctgctatgtgctccttcagtggaaaatcatatactgtggagacagatggctattgattaaatttagttttccatcatttgatgaggctgagctcatcttctccatcccagctgatggagaagtagttccaatactcctgctttcagaagagaaaatgaggtactgggtttttatttcagtcctcccgctggcatttcttgtccacaaagattaacacccagagcccagccttcctcatccatcaccggacatcactgattaaaatgccttcccaccatgagaccccaccggccaactccccgctccccttcccatgccatcgtcctaaacaacatcaataataaaacatactcacaaaaattaatttacaaaaaccacaataacaaaaaaaaaaaggtcagccctcttggaaattaaattttgcctgagaagaatttgtaattacaaatgcatgagagagttcttcaagacatttgagactggcgccaggaagagtgacggagaaagtaggttataaatggcctttgtcaagctgcagaaaggttataaaactgctgcattttgtgcttaaaaaatcaattttccatgtgagtgaagtgctgtacatattaatacaagctcagaggaagcccctgcttgtctctgaacattcactgtcagacaagagggcacctggtcacagggtcatttggagccgtttgtgagtactggggcctggcttcagtctgtttgcagactcgcggagcatgttgaaaagaatgactgattttctgaccaggtaacaggagacacctgggcagggtatggtctcagtccttcccatcccccaatgattctctaccacacttgtttttttaaacgtgttcactaagctccaggttttatctaagcgctttacccgttttaacttatttaatccctatagcaaatatatgaggtagagtggtaggctgataatggatcccaaagacatgtctctgtcctaagccctggaacttggaatctgtgaatgtgactttctatggtaaaggttatgcagatgtgattgtgtcaaaactcttgaggacaccctcctgggttttccagattggcgtaaatgccatcacaaatgttctcatgacagagaggcagaaagaaattacacacacagaggagaaggcgatgtgggggtggaacagagattggtgtgatgtggccacaaaccgatcgatgctgaggccaccacaacctgaaagaggtcaggcacagattctcctctagagcctccagaaggagcaccaccagaaatcaaatgccagcaccttgattttggatttctggcctccagcactaggagagaataaatttcttaataattatcttaagccactgagtgtgcagcaatttcttgcagcagacaaggtaggtaccgtcaggattcccactttgcagaggaggaagcggaggagagggtcacacagtttggtggtgacagaggcagagcttctcaggcttcccaactttgttgctattagctgcctaatgggcaagccacttcaccaccctgtcatttactgactgactgatctctagttttaagaagtcctgtcatttactgactgactgacatctagttgtaggaagtcctgttatttactggctgactgacatctagttttaggaagttagaataaggcagggcttagagctgatctaacctccttactttagaagtgacgcccagaaagttaaaggacatcaccccatattcctcagcacatgagcgaagaacgtgaagccaggcttcccttgccccagcttggtgttctctgtccactacactcacttcccttcaggttaaagcattttgcaaacttacatatcctatagtctctctccccaagatgatttgctgatgggaaactgaggatcagaaaggtgagggtacttgaccaacatcacacagcaaattaaaggcaagatttgatccacgcctgtgggaaaggcttcctaagtacatgaagtgggtttaccagttaccatcattccttcctctatcatggacttcaggtactgtgcctttgaggatgagtaggggcagatgagatctagccatcgtttgaaattacttgtatattattagtatttcaattagtttgttgcttactgtctgtctcctccaccaaaatgtaaatgttataatagtatggaccatgtggcttgtcctaagccatctggcacacagttggtacttgttatttgctgaacgaattggtggagtgctagaaatgacatttagtgtatctgtgtattaactttggatctgaatccacactacttcttataagttgtataaccttcaggcagtgacataaagtctcctatcttcacgtgattactgtgatgggtaaatagtacggtagccagcttcaaagatggtccccagtgattcctgccttctggtattaagactcatgtagtcccctcctacactgcaccagaattggtctatgtgaccaatagtatgtggcagaagaggaggtatgtggcttctaaaggtagatcataagagagatctttctctccctctgtctgtctctctctctctcatcacttgctctagtgaaagcaagctgccatgttttcagcagccctatggagagtcttatgtggcaaggaagtaacacctctggccaacagccagtaaggctggggcctgccagcaaaacatgagtgagcctgcaaatacactatccagccccaatcaagcctgttcagatattggcaaccccaggtgacattttgactgagactttgtagaggtaggccagaaccacacatagaagctgcttttgaatttctgacccttaaaaattgtgtgggataataaatactttttgttttaagtgacttgatttttgagataatttgttacacagcaatagctaactaatatagtgaaataaatgtatgcagtacttagcacagtgatcaacaaatagttctgctgttataggtatttgtaaagagcttagaatctggtttgagagataaatatacacatctatcagagaacgttagttatagaacaaacataaaaaagtatggtaaaatttgtttgggaaaataaaaactctgcaaactaggcaatattgaaacagggaggttttagtcttttctcctcctctaggaagggaatcctgtaggaaggaagttcctacaggaagagaaaagagacatctaatgtactagaagaggaagactagaattcattaccaggcactgtcacttgcttgcctcgtgaccttggacaagtccttgaaactatttgggactgttttctttctataaatagaggagccagtttggagacaagaatatgaggactaaagtcaggcctgaattccaaggaaagatttgtgacactgagcatataggcaggatgcttcacctcagagacagcctcaggttcctcatctgtagaatgcaaataatgtctctcttggaggcacttctgaagactgtatgagaaaacacttctaaagtatctggctttagacctggtacataatagacacctaataaatgaagaataattgaatagggatatataaacaagtaataaattaaccaaaaccccaaaagaaaaactagcctagttgggaggaatcacgatgtctgactagatgcaggtagtatgtccctcctccatggagaggaaccagaataataagtagatacacacattccaaacagattgtctagaagagaatgctaggattcaacaggggagaaatgagaagcaccagaagtaagtaagcagagactttgaggcagcttttccagtcagaaaccaactgagagctggaaggggctcccagatgtggggaaacagtaagagagaaacccccagggttccaaaatggggttttacaccttggctgtgagagaaactctcaacctactggggcctttggcctgacatacgaagtgcctaaagtttgcataaaaccattgccacagaatgagaacccaaataaaatcccacaggcatctgaacctggagtagacacagctgggcactattttgagagccaaaatactggggatctacagatatggctgctgctgccctgttctaaagagggagagggaagactgggtgctcccacacatccccaggaagctccttactgccctgctgcaggctgctattgagactgagacatggatagactgtacttcccacagcttcttgctcacctttcttgcctgagatggactctgccttctctggtatcaggcccaaagcaccgtttttgacagtttaatgctgagctgcaccctaccattggcatgagtttgggttgatgtggctgcagctgccacccagtcaaggagggacagggagaccaggctatcctatgcatatctaggacaatacccactgccctgcaaggggctgctgtgagaccaagactcaagtgggccacactcaccacagcttcttgccaatgtggctcacctgagaaggaccccatcctttctggtcacagcccacagctggcaccatgctgagcatttaatgctggactatgtcccaggcttggggccgagtttgaggtaacatggctgcagccaccaccctgctgggagagggacagagtacaccacactctcctaagcacactcaggacaatacccaccaccctgctatgggtggctgcgagactggggactagcccgcccaacccatcacagctcccagcaagaccaacacgggttgcttgagtcccagtgggttgctctaccaccatcattactgccatcagccacactacactagcttcccaggggccccaaaatctacccatacatcaggcccactgctcccactactagcttctaagcaagccaactaatggcccaagaatcagccctcaaaaacctactaacactgaagccagtgtaagctacttcggggcctaaaaccaggcacactcaccccactgctgccactatcaggtgtgaagactggctcactttgtattcaaggtcccagcttaacttcaccacaatctcaactaacaactgtgtgataatgaaaacacagtatctcaacatgtgtattatacagcaaaatcagtgctaagaggaaagtttatagcattaaatgcctacatcaaaaaattatcacaaattaacaacctaatatcacacctgaaagaactagaaatatggctgggagtggtggctcatgcttgtaatcccagcactttgggaggctgaggtgggcggatcacctaaggtcgggagttcgagaccagcctgagcaacatggagaaaacccgtctctattaaaaatacaaaattagccgggtgcggtggtgcatgcctgtaatctcagctacttgggaggctgaggcaagagaatctcttgaacccaggaggcggaggttgcaatgagccaggattgcgccactgcactccagcctgggcaacaagagcaaaactccatcccccccaaaaaaaaaaaaaaaaaaaagaactagaaatacaagaacaaaccacacccaaagtaagcaggagaaaagaaataacaaagatcagagcagaaataaatgaaatagacccaaaaagcaatgcaaaggatcaatgaaatgaaaaaataattttttgaaatgctaaacaaaattagtaagccactagcaagaaaagagagaagactcaaataaatacaaccagaaatataaaaacagacactacaactgatgccacggaaatacaaaagatcatcagagactattatgaagactattatgttcacaaaccagagaacttagaaaaaaatgaatatattcctgactacacaaaacctatggagattgaaccaggaagaaacagaactcctgaaccgaacaataatgactactgagattgaatcaataataaaaaatatctctcaataacaacagaaaaagccaaggactggatgaattcacagctgacttctaccaaacatccaaagaaaactaacaccaattttcctgaaacaatcccaaaaaaatgaggaagaggaaattctttctaactcattctatcaggccagtatcaccctgataccaaaaccatacaaggaaataacaacaacgaaaaagaaaactatacactaatatccctgatgaatatagatgttagtattttgcttaacaaaatactagcaaaaggccgggcacagtggctcacgcctgtaagcccagcactttgggaggctgaggcaggcagatcactaggtcaggagtttgagaccagcctggccagcatggtgaaaccctgtctctactaaaaatacaaaaaaattagctgggcatggtggcacacgcctataatcccagctattcgggaggctgaggcaggagaattgcttgaacccgggaggtggaggttgcagtgagccaagatcatgccactgcatgcactctagcctgggcaacagagcgagactccgtctcaaaaaaaaaaaaaaaaatactagcaagtcgaatccaacagcacatcagaaagatagtacaccatgacatcatcaggtggaatttatccctgtgatgtaatgaggattcaactatgcaaatcaataaacgtgatacatcacataaacagaattcaggaaaaaagccatacaataatctccatagatacagaaaaaaaagcattcaataaaattcaacatcctttgatgataaaaaaaatcctcaacagagtaatcattgaaaatacacacctcaacatagtaaaggccatgacccacagccattatcttactggggaaaaaaaagcatttcctctaagaactagaacaagacaaagacatcccctttcaacactcttattcaacatagcactggaagttctcaccaaagaagtcaggacacagaaaaattaaaagttatccaagctggaaaagaagaagtcaaattatccctgtttgctgatagtattgtcttatatctaaaaatccctaaagactctatcaagtttcaagataaaaaataagatgcagaaatcagtagcatttctatacaccaatctagctgagaaccaaattaagaaagcaatccatttacaatagccacaaaaataaaatatctaggaatatatttaacaaggaggtgaaagatctctataaaaataataacaaaacactgatgaaataaattgtagatgacataaatacacagagaaacatcccatgctcatgaattggataatcaatatgtttaaaaggattatattgcccaaagcaatctgcagattcaatccaatccctatccaattaccaacatcatttttcaaagcattagaaaaaaaatcctaaaattcatctgtaactagaacagaccccaaataaccaaagcaatctcaagcaaaatgaacgaagctagaaaatcacattatctgacttcaaattatagtacaaggcatagtaaccacaaaaccatggtattggtataaaaataggcaactagatcaatggaatagaatggagaacccagaaataaagccacatacctacaaccaaatgatctttgacaaagtcaacaaaagtacacactggtaaaatgatactccagttgtattagtccgttatcacactactataaagaaatacctgagactgggtaatttataaataaaagaggtttaattggcttatggtttcagaggctgtacaggaggcatggctggggaggtgtcaggaaacttataatcatgaagaggaaagaggcacgtcttcacattgctgggagcaggagaaagagagcaaaatgagaagtgttacacactttcaaacaaccagatctcatgagaactcactattgcaagaacagcaaggggaaaatctgcccccatgatacaatcacctcctaccaagcccctcctccaatactggggattacaattcaacatgaaatttgggtgggaacacaaatccaaatcatatcactggtcaataaatggtactgaaaaattggatagccatacacagaagaatgaaactggactcatatttctcgccacatattttttaaaaacctcaaaatggattaagacctgaaactataaaaatcctaaaagaaaacctagaaaacaccattttggaccttggccttgggaaagaatttgtgactaagtcctcagatccaattaaactaaagagctacacagcaaaagaaactatcaacagagtaaacagacaacctacagaatgggagaaaatattcacagattgtgcactcgacaaaggtcaaatatccagagaccataaggaacttaaataatgcaacaagcaaaaacaaataaccccattaaaaattgggcaaaagacataaacagacacttcttaaaagaagacataagagtgacccacaaacatatgaaaaaatgttcaacattactattcagcagagagatgcaaatcaaaaccacagtgagataccatctcacaccagtcagaatggctactattaaaaagtcaaaaaacaacagatgctggtgaggctgtggagaaaaaggaacacttatggaatgtaaatgagcacaacctttaaggaagacagtatgaaggtttttttttaaagaactaaaaacagaactaccattcaatccagcaatcccactattgggtataaacccaaagagaaaaaatcattaattacattaggtcggtcacggtggctcaagcctgtaatcccagcactttgggaggtctaggcaggtggatcactagaggccaggagtttgagaccagcctggccaacatggtgaaaccctgtctctactaaaagtacaaaaattagccaggcatggtggcaaatgcctatactcccagctactcaggaggttgaggtgggagaatcacttgaacccaggaggcggaggtcacagtgagccaagatcgcgccactgcactccagcctgggcaacagagtgagaccctatgtcaaaaaaaaaaaaaagaagaagaagaaaaaaagaaagataccagccctcatatgtttactgcaacaataataacatacgagtgctatttcataatagcaaaaatacggaattaacctgaatgtctatcaagagttgattgaataaagaaaatgtggtatacactcctacccctcccttctccccacccacccacagacacaccatggaatactactagggcataaaaaagaatgaaatcatgtcttttgcagcaacatggatagaactggaggcctttatcataagttaaataactcagaaacggaaagtcaaatatgacatgttctcacttgtaagtgggagctaaacaatcggtacacctgcacgtacagagtgcaatgacaaacactggagactacaaaaggtgggagaatggaagggtgggaagagtatgagggttgacaaagtactactgattgggtacaacgttcactattcaggtgatgggtataataaaagctcaaacttcactactacacaatgtatgcatgaaagagacctgcttataccccctaaatatataaaaataaaaatataaataaaggtaactgaaactattagctgattttttcttttccatatgtctaagtccttctttagaacatttaacaaatattcaccaaacacctacctactcagtgctaagcaaatgttttaggagctgaaaatgtagtagtaaacaagacagacaagacctttctctcatagaatttacattctagagaagagacaaataattaacaagtaaacaaacaaaatgattattttgtagagtaaaaaaatgaataaagataaaagtataatatgataaaaagttaacgaggatggggtgaaagcagcataaatttagcttaaaaatagggtagacagacttcttccactttagccttctttttcaaaagaagttttggccattatagttcctttgccgttcgtttaaattccagaaaaatcttgtctatacttataaaaatcatgccgaggttttgataggaattatattaaacctttatatcaattcgaggcatgtggacatctttattatcttgtgctatccaattcgtgaatacgtatatctttccttgtgattagatcttctttgatttctttcacgagtattttaaagttttactaaagctaaacgtggcccatgcatattttgtcagatttgcatctgagtatttcattactttttagggattgcaaatgatactgtattttttatatattttgtcagattcacatctgaatatttcattatttttcagaaattgcaaatgggattgtattttttatttcaaatgttcacatgttcattgctagtatataggaatacaattgatgttgtatatttttcttgtattctgagaccttgccaaacttactaattgcttctagaaatttattttgtagattccctgagattttctatgtaaaaaaatcatgtgatctgccaatgggtaagtcttatagtcttatttcttcctttcttatctgaatgccttcttccttttttgattttttttttccctgttattgcactggctaggacttcccacacgatgttgaataacagtgggcagagtgaatctgcttttcttgtctctgaccttttggagaaagtattcagtctttcaccataaatatgtcagctgtagctcttttattgatgttcttcgtcaagttgagtaagttctcttctattcttattttttttttgaaagttttaaaaatcattttcggtatggaattttgtcaaatgtttttcttgtatccattgatatgatgatgtgatttttcttcttctgcctgttattataatatactgatagattttcaaatagggaaccattcttgcatcactgtaataaaccccacttagttatgtgtatagttatcttttatgtattgttgaatcctatttgttaatattttgttaaggatttttacaactgtggtatatgcatgagggctattggtcttactttgtagttttctgtttttgaactatctttgtctgcttttagtatcaagataatgctaatgtcttaaaatgatttgggaagtattctctcttctttaattttctggaagattttttttgttttgttttatttatttatttatttattttttgggaattgacgtttattcttctttaaacatttggtatatttctccagtgaaactatccaggacagggatttggagctgaggggaggaggagtctaaagtgacaaaataaatttccttaatagttatagggctttcaaaattatctatttcatattggcgaattgtggtagtttgtgtttttaagaaattggtccatttcatctaattcatcaagtttatgtgtgtaaaattatttgtagcattcccttattatccttttgatttacacaaggtctgtggtgatatcacctgtttcagatagtggtaatttattttttctctcctctcttccttttcagtcttgcttgtgtttgtttagttttattgtcattttcaaataatcaattttttgtttcattaacttcgttgtttttctgttttctaccacattgatttccttccttcggcttcctttggatttattttgctctttttttttttttctaggttcttgaggtgggagcctagattattgatttgtaacttcctcttttctaatgtatgcatttagggctatacacatccttctcattgaatataaagacacagatatgttaaaagaaaaggatgaatcatgacttcagctgtgtcccccacacaacttgatacattgtatttttatttcatctagttcagtccattttttaatttcccttgagacttcttctttgacccattgattattcagaaatatgttgtttactttctaagtatttgaagatttttctgttatatctattatgggctgaagatttatgtccccacaaagatttgtatgttgaaatcctaacccacctgcaaagtgatgatattcgcagttgaagccttggggacgtgattaggtcacaagagttaagcccttataaatgtgattagtacctcacaagaagaggatgggagaccagagttccctccctctccaacacatgaggacacagaaagaaggcaagcaaggaaaagggaatttcaccaaaaaacgaattagccagcacctcaatcttagacttcagcctccagaactgttagaaataagtctgttgttcaaagcacccaatttatgttattttgctacagcagtccacagctgctgaaggcagctgttattgctctgttattgctttcttgtttgattctatcgtggtcagagaacacactccatacaatttgaatcttaaaatttgctgaggctttttttatggtccaggatatagtcttgtcttgatatgtgtcctgtaggcacttgaaaataatatatgttctatttttgttgggcataatgttctataaatgttaactagatcttttttgttgatggtgttattgagtccttctatattgttgctaaactcctgtctagttcttctatcggttttggaaaggggtattgaagtatccaaccatcattgtagaattgtctattttttctttcagttctgttagattttacctcacacattttgcagttctgttgtttgatgcataaacatttaggatttctatgtcttcatggtaaatgatattttataattatttggtgtccctctgtggtaattatttggaaggcctactttatctgttattaatatagctactctcacttttgtttgatttgcatgtgtctttttccatccatttactttcaatctgtctatatcattataagcaatgtgaatttcttgcagacagtatataattaggtcatgcttttaaacccactccactaatttatgccttttaattttggtatttaaactatttgcgactgggcacagtggcttatgcccgtaatcccagcacattgggaggctgaggcaggatggtcacttaaggccaggagtttgagactggcctgggcaacatagtgagatcctatcttttcaaaaaattgtaaaaattatccaagtattgtggtaagtgcctgtagtcccagctacttgggatgttgaggtgggaaggtcgcttgagcctaagaagtcgaggctgcagtgagctgtggttgtgctactatactccagacgacagagcaaaatgctgtttcacaaaaaataagaaaaaatttctaaaacagaaattatttacatttaatgtgacctgaacatttctggcattacattatattattatgtttcaactccaggtcttaattatattaatgaagaccaattctgatttttttcttgcccaaattactatctgaggggtctggggagtcatgccctacaaatcataaattctcatcagatgggtttatttaatcctatacattgtgacttactttccaatctggctctggcataacatgagacaaggaagaaaaggcaaaatactttatcccaaaacacgtttcttgacatattttgaaatggccctgcaaagctgttctttgtagggaaaattttgcatctgtaaagaatgtctattaacatagctacatctttttctttcagaccctcccaatcctaaagagattaactaaaatctgaataggaaacatttgttgtctatagtctctaagggcagccactaaaagacgtcaaaggaactttggtctccacaatctttatcttaaccagaacatccctatatccctatagtctggaaccaacaacccgctgcccccaaaagcatttgtaaaatgtataaaacaaagctgctccctgaccaccttgggtacatgttttcaggaccttctgagggctgtgtcacaggccgtggtcactcatatttggctcagaataaatcttttcaaatattttacagagtttggctcttctcattgacatgtatttatttattttagagagaggttctctctccgtcacccaggttggagtacagtggcacaatcatagctcactatagcctcaaactcctgggcttaagcaatcctctagcctcagcctcctgaatagctgggattacaggtgtgagccactgcacccagatagaccttcaaaccttctattttctctggcttctactgacactcatccagcaggggaaggtagtggccttgttactgacaagggaatgaagaagtcccagttccccatgtggccttctctgataccccaaaggcccctcttttcagctggatgaggtaggaattcacctccccactaggacttcacggatctcttcctggatgggagtggtaggtatgtctagtcactgttccccccttaatctccactaacaccacactgagtggaaggtggccccatgaatgctggtccgtggtgaatgtcctggctttctactagttcttccctgacaacaacccagcaggaagggggaaggtgcttcaatgtcatggattaggggtggaaggccatgctcttcactgatgctgaataggccaggggatgggggtgctcactatctatcattgagattaaagtcctggctccccacgccattcaaccgttgctcccatggggaggggtgtgttcattttaatttttttcattttctgtggtgtttggctggagtagagcacttattgtctagcatttttctgtcttgctaggttgtccttttcccggtattttggctagggagagcagttttgttttgttttgttttgttttgttttgttttgttttccttcacatgtacctactggcatttctgagctgcaggctcctttagctccaagaataggacacatgaggcaaagagagaatccagggaactgaccaccatgtctttccttgggtcccaaaggcttcagctggtctgcaatgctccacctttcagtcttatgcttgttttatataggacatccagggtttttggttgtatttagccagaaaaatagagaaaatgtgtctactcctccaaagcctgtttttgcacagccctagagctaagaatggcttttacattttttttttaaaagaacatgagacaaaaaaagaccacatgtgacctggaaagcctaaaatatttactatataatccttcatacaaaaaagttgaagacccgtgacttcagccatgttaaggcacctggagtttattctaagtgcaactggaaggcataggagggttgttggcagaggaataaagtgattttgtttgctactttgaagagattactgaagttagtgaatccagttatctctaagcaatttcctagagtccacaaaaggagtctggggaagcaggctctgtgcatctgggcaggggcttgagaaagggagtgagtcagcctaataaggactctagcatgtggaggcgtgcctctttgctgaggttttatagtaagtaggtgagaaagcggggagtctaacccaggtcagtgcagctccagagactcatatccctcattctgctctatttcaggggaggactcataggaagactctgagcccaagtctctgagccttgagattttgaagacctagcggggagggagaggaagatgcctggaggattcccataggttcctcccacaggctagccctgctgggctcccccgagcttcttcctccatactgtgaacctgctctttgctgcttcctagctcgacttttcatcatcaccaagccatttgtttctgtttgtaattatgcattttaatgttcattaattatggaatgcaaattgctctgagtacaaaatttgtaatgagctgttttaccaccccacccccaggtctagaaggtgggccagctgttctgagcagaaggaaaaacaaccaacttacaaaacagaacaatttgtcctagggcctgagtgaatcatatggtaaataagcctgggggacttcctgctgatgctggaggtggggccctgccccacctgggtcctgggtgacatcagtgtggcaatttcattctttgctacaaacttgggcctgaaaggcaggtggggtaaaggaacagcactagtcttagaaccagccttttactggctatgacaccttgagctagtcccttggcttgtctgagcctcagtttgtccttctggaaggtaaggattatgatgaaattatcctcaaagtaggggtggcaggcaaacactagcaggccctggataaatgcatgtgaatggctctccagattgctggattccagttctgcctggctgtgtttttttttgttttgttttgttttttgagacagagtcacgctctgtcacccaggctggagtgcagtggtgcaatctcggctcactacaagctctgcctcccaggttcacgcgattctcctgcccaagcctcctgagtagctgggattacaggcatgcaccaacacgcctggctaattctgtatttttagtagaggcgggggtttctccatgttggtcaggctggtctcgaattcctgacctcaggtgatccgcccgcctcagcactcccaaagtactgggattacagctgtgaggcaccgcacccagccaaaaatttccagttgctttcttttctttttgagatagagtttcactcttgttgcccagactggagtgcaatggcacgatctcgactcactgcaacctctgcctcctgggttcaagcaattctcctgtctcagcctcccaagtagctggaattacaggcgtgtgctaccatgcccagcaattttttttttttttttttcagtagagatggagtttcaccaggccaggctgatctcgaactcctgacctcaggtgatccacccgcctcagcctcccaaagtgataggattatgattacaggcgtgagccactgcgccctgcctgggctgtggtctttaactggctgagagccttcagatgagaacactctgagcctcagtctccttcaatggaggcactggacagcaggaagtcagagaagactttcagtgctaactgctcagtttttatcaaagcaactgtgaattgtagaaaggggaaaattagctctgaagtatttaagaggaaaatggggaattttcttggaattgattgaacatgttttaagacatcacaaggatgcctccaaacctgcttgactatgaacaatgacttgttctcctccaaggactaggtaagtatttgatttctttaagtctcatggccagagaaagcataataacagtatcacctcctactaatagtactcctctcaacaatagtatgcctcaaaaattatggtaaatattttttatttattgttattattttttacagacaaggtcttactctgtcacccaggctggagtgcaggcagtggtgcaatcatagctcactgcagtcttgaaatcctgggctcaagggatcctcttgcctcagcctctcgaatagctgggactacaggcatgtgccatcatgctcggctaattttatttttatttttattttttttaaaacaacagctttattgaagtataatctacatatcataaaatttactcatttaagtatatgattcagttattttaaatttgcagaattgtgcaaccagcaccgtgatccaatatttaagtttccatcatccccaaagatcgttcatgtactccttttgagacagagtctcgctctgtcacccaggatggagtgcagtggcacgatcttggctcactgcaacctctgcctcccaggtttaagcgattcttatgcgttggcctcccgagttgctggaattacagttgctggaattacagccccgtgtgtgccacaccggtctaatttttgtatatatatatttttttcctgagagggagtctcgctctgtcgcccaagctggactgcagtggcgtgatctcggcatactgcaacctccacctcctgggatcaagcaattctccttcctcagcctcctgagtagccgggaccacaggtgcccgccaccacacccagctgatttttttattttattttatttcattattattattattattattatttttttttttttaattgatcattcttgggtgtttctcgcagagggggatttggcagggtcacaggacaatagtggagggaaggtcagcagataaacaagtgaacaaaggtctctggttttcctaggcagaggaccctgcagccttccacagtgtttgtgtccctgggtacttgagattagggagtggtgatgactcttaaggagcatgctgccttcaagcatctgtttaacaaagcacatcttgcaccgcccttaatccattcaaccctgagtggatacagcacatgtttcagagagcacagggttgggggtaaggtcaccgatcaacaggatcccaaggcagaacaatttttcttagtacagaacaaaatgaaaagtctcccatgtctacctctttctacacagacacggcaaccatccgatttctcaatcttttcctcacctttcccccctttctattccacaaagccgcgattgtcatcctggcctgttctcaatgagctgttgggtacacctcccagacggggtggtggccaggcagaggggctcctcacttcccagtaggcgcggccgggcagaggcgcccctcacctcccggacggggcggctggccggacggggggctgaccccccccacctccctcctggacggggcggctggccgggtggggggctgacccccccacctccctcccggacgaggtggctgccgggcggagacgctcctcacttctcagacggggcggctgccgggcggaggggctcctcacttctcagacggggcggttgccaggcagagggtctcctcacttctcagacggggcgtccgggcagagacgctcctcacatcccggacggggcggcagggcagaggtgctccccacatctcagacgatgggcggcagggcagagacgctcctcacttcccagatgtgatggtggccgggaagaggcgctcctcacttcctagatgggatggcggccgggtagagacgctcctcactttccagactgggcagccaggcagaggggctcctcacatcccagacgataggcggccaggcggagaagctcctcacttcccagacggggtggcggccgggcagaggctgcaatctcggcactttgggaggccaaggcaggctgctgggaggtggaggttgcacgagccaagatcacgccactgcactccagcctgggcaccattgagcactgaatgaacgagactccgtctgcaatcccggcacctcgggaggccgaggctgtcggatcactcgcggttaggagctggagaccagcccggccaacacagcgaatcccagtctccaccaagaaaatacgaaaaccagtcaggcgtggcggcgtgcacctgcaatcgcaggcactcggcaagctgaggcaggagaatcaggcagggaggttgcagtgagccgagatggcagcagtaccgtccagcttcggctcggcatgagagggagaccgtggaaagagagggagagggagagggagaggagactgactctaattttatttttattttttgtagatatggagtcttatgctgaccaggctggtcttgaactcctgacctccagtgatcctccatctcagcctcccaaagccctggaattacaggtatgagccaccatgcccagcagtagtaaagatgaaatgagaggtgaaaataacgagactaaacacataatgaaagccagaatacactgtcagtcacaaagaatagacacaactgtgaatgaagtctgactgagccacttcctcaatgtgtgccctggctgttctgagtctcagtttccacaatttatacattggagaaaataactccttcctcactaggcttgtgagaggatcccaggaggtcatttacctgatatgtgcctgatgcctgacaggtgctcactaaatgctaactgctattgtagttaccttgttactttctccaaataggacacattcagggagaaatgtaagggaaccatatacagggaaatggttaggcatttcttccatgcctacttttccaatgaggaaactaaaactcagaggtcaggtgagctgccttgggtcatacagcaagcaagagtctgactgagcccaccactgaaggccccctgactatggggccaaatgaggttctcttttccctgaaccacatggaggtggcttgtctgtggtgttacaagtggttcagactggctagtgtaacacagagattctgagaaccttgtgggaagggccctgtaatgagttatcggaggactttggtgctttagggacagagaggttgcttgtggcatagtcttggatgtacagattaggtacagcatcttgggaagaagagatagggaaagatgcaaggaaggaaatgaaatgcatatttattatgcacctaccataagctggatgtttcccaatatgctatcttttttaatccccacaaaactcagaggacctctaagatacaatatactcattttacaggcaaggttattgaagatcacacaggctgaagaagggctgctgaattcttcaatatgaaccatccctttgataagaaactgagtgggcctggttcttctcatcccaggagagctctggtgtgcttcctggcatataagtgagtgggaaaggctctgccagtccccagtcccccacccctcttgccactcagcctcaatctgtcaaccaggccagctagcccgtctattaatgctgacattgatttggatcaatcaagatcccataattactgggagttttaatcaactcatgccaattcagctgccgctcaatttgtgctggacttcggtgctcacaaggagggaagcggcgagggtggggtggggcggggggagggcatgcaaaaaggattacagggatcaatagtccttggtaatgaaggacagcagctgcaggcaccaccagggggcctgagacttcagagtggaggagacagagcctgcccccatcccccaggagagctccctggcagagaatgaaaaccacgcccctgcttcacctctgcctacacctggatctggaaaccacttaggcactaccaggcagcacctgttctctgcagggtccaaccctcagtatctctctccacattttgccctcagccaggcctggcctcctcttcctgaagaatcttatgtatccttcagagccagcaatcccattactgggtatacatccaaaagaaaataaatcgttctaccaaaaagacacacgcaaccgtgtgttcattgttgccctattcacaatagcaaagacatggactcaacctgtgcccatcaactggtggattggatttaaaaaaatgtggtgtgtatacacttgaaatactatgcagccataaaaaaatcatgtcctttgcagcaatatggatgcagctggaggccattatcctaagctaattaacacaggaagagaaaactaaataccgcatgttctcacttataagtgggagctaggacgggcgtggtggctcatgcctgtaatcccagtgctttgggaggccaaggtggatagatcacctcaggtcaggagtttgagatcagcctggccaacatggtgaaaccccatctctactaaaaatacaacaaattagccaggggtggtggcgggcacctgtaatctcaggtactcgggagggtgatgggggagaattgcttgaactcgggaggcagatgttgcagtgagccaagatcgtaccattgcattccagcctgggcaacatgagcaaaactctgtctcaaaaaaaaaaaaaaaaagtgggagctatatattgggtacttatggacattaaaatggcaataatagacactggggactaccagatgggggaaggaggcagggaggtgaaagggaagaaacaggtgcaaggattaaaaaactacttattgggcactacgcttagtacctgagtgatgggatcaattgtactgcaaacctcagaatcacacaatatatccaggtaacaaacctgcacatgtaccctctgaagctaaaataaatgttgaaattattttttaatcaaattttaaaaaactctgtaaattatttctcagcagtctctgtggttatgttcctgagttcaaaaagcagaagaatgctgaggagacaaaaaaataaaaataagattaatccagatactgtcatttcctagctgtgtgacttcaggcaagtcactgcacttttctggtcctgtttttcctgttctaaaatagactcaataataaataaccgcctcctgggattgctgggaacattgagtgctgtcacgaatgaaaaatccttgtgtggaagttccttcttccttttgatgtcccacatcagaaagaatcagttttctttttctcccatgttcattattcttctcctagcacaagctttattctgccaggtgggacggtttctgggtcacagtctgtttccctacgagtccacagctatttggggacagggactgtaatacacacagcttccttttctcagtccagcacgtgggagggagacaagccagtatgcaaggcaaatgtggcctttggggtcaagcaagcttgggcttgaatcccacctgtctttgccacttactaaccatgtaatgttagccagtcacttcgttaacatttgaacctcaacttcctcaaagtaaaatgagcctaattacacctactcagaattgctacggaggaaaaaaaaaaaaacaaaaagttagacatttaatgtccctaacatagtatctagcacaatggtaagatcctgattgttataaaagttgctattatgattattatcactcttaatattcagtgctcagtaaatatttttggaatgtaataaaatgtctggttgtattgcttagttttggcttgagttccaatgaaataccaacaggccattatccccacatgccagccatctgtgcagccttcaacacacacttactgaagacaccagaaaggaaattcaaatgctttcaggacacactgtgggccaggcactataggaagtgttttccttatactgctttgctgaaggcccacacttctatgagattgctgttattgctgttattagcttgatgtctgcagaagagaaaactgaggctttgtggctggatatgtctttccttgtagttctagcagaaccagggtgcaaacatgggggcgtttgactccaggcccctgctctctccactgtaccataccattctttcttttttttgagacggagtctcactgtgttgcccaggctggagtgtggtggtgcgatctcggctcaatgcaagctccacctcccgggttcacgccattctcccgcctcagcctcccgagtagctgggactacaggcgcctgccaccatgcctggctaattttgtttctcttatttttagtagagacggggtttcaccgtgttaaccaggatggtctcggtctcctgacctcgtgatccgcccgcctcggcctcccaaacgtaccattcctttcttgtggaggcaccaagaagtagaaaatgtgagagttcccgacttcaggaagaatctagaccaatggtagagatcaggtaaattcccagagggagaaaagtcatagttcaaaatggcttatgataaaaaatgtgccaaacaacaaaaaacaacctgattaaaacatgggcaaaagacttgaatagacatttctctaaaaatgatatacaaacagccaattggcacatgaaaagatgaccaaaatgattagtgaatcattagcgaaatgcaaatcgaaactacctcaccctcattaggatggctgttaccaaaaattcagaaaataatgagtgttggtgaagatgtggagaaattggagcccttgcacactcttgataggattgtaaaatggtgcagctgctatgaaaaacagtatggaggttcctcaagaaattaaaaatagaactaccatatgatctagcaattgcacttctggatatatatccaaaagccctgaaaataaaatcctaaagagatatttatacacccttattcatagcattgtcattcataatagcctaaaaggtaggaacaaccaatgttcattgacagatacatatacacacacaatggaatattattcagccttagaaaggaaggcaattctgacacacgctgcagcatggatgaaccctgaggacattatgctaagtgaaataagccagtcacaaaaagacaaatactatatgactctatttatatgaggtgcttatagcagtcaaattcacagagatggaaagcagaatggtggttgccaggggctgggggaagggagaatgaggaattatttaatgggtatagagtttcagttttgagagataagtgctgtagattgggtgtacaacaatgtgaatttgcatcacgctaccaaactgttcacttcaaatgcttaaggagataaattttatgttatgcatatcttatcacaattaaaacaattttaaaaatgtattttaataaaagggaagcagagagtgaaaggcataatggttcctaacttcaaagaaaatctagaccaactggagggaccggatcaaccccaagagagagataagccatgtttcaggatggtttctgatcaagagcagtgctgcaatgacagcatgctactgcgtggctgggtttgctcacacacactgatcacagctaattatctgaatatatgctggctacttttcccattagaggagtcccacgtaattaggggacacaggttaccatccttgctttgggcacatccctgcccttctctggccgtcaatcttcctaactgtccagtgagaaaagtggtagctggtccgtaaggggtctcccatcttggacattctatggttctctgccagtggtcaataggaattccaagggaggtaggttctcgcagtaggcagcacctgctctagtgcaagtggcttgggaacatgcttgaagctttcccctacagcctcttaaaatggctggtcaaccttttggtggcagtcgcgaagccttctgcacacagcaagggttcagttcaacaaatgcctattcagaacctgctgtcttccaggaattataaagccttagcttcattctcaaaaaaaaaaaaaaaaaaacaaaaaacaaaaaacaaaaaacaaaaaaaaacatatattctaatggggggagaaaagtaagtaagcacattcttatagttctcaaggttttgttttgttttgttttttgagatggagtcttgctctgtcaccagactggagtgcagtggcacaatctcggctcactgcaacctctgcctccctggttcaagtgattctcctgcctcagcctcccaagtagctgggactacaggcacacaccaccatgcccagctaatttttgtatttttagtagagacggcgtttcactatgttggccaggatggtctcaatctcttgaccttgtgatctacccgcctttgcctcccaaagtgctgggattacaggcatgagccaccgtgcccagctgaggatttttataagcaccaagggctgaggcaagggaggccagggaacactttcctaggaaaatctgccaagactcctgaggaatgtctattcaatacctatctggtgatgataataaatagcctttgtgtagctcattaataataataatagctaacacttaatggcacttatcatgtgccaggcactgtttcgatgtgttttgaatattaactcattatgtgcacagcctgatggtataggaactactagtctactcattttacagagagggaaactatggcacagacagctttaggaacttgtcccaaggaaacaaggcaagtgagtggcacagccaggatctgaagccacactacgctgccttttacaatgtgttaagctttctaagttacttcctcatctgttatatttttctagcctcatggagagaggtgctgacgccatttggaagaataatatcctgaggtgcagagatgtaagagaacttcccaagatcatacagtgattagatgtggggcgggacagaggctccactcaggtctgcactgctacaaagctgtaccctctgggctgatggcatggctcagtgaaggagctctctctgttcccaaggcagaggctctaactgtcttcacctgggttcaaggcgctgggaggaaaatgaacatctgttgtgtaccccccatacaccagacacactgctaggctatgctaatttatgaaatcttcccaacaacccagaaaagaatgcaccattattttcaccactcacagatggaaaacaggcttggagagggaagatgacttgcttcaggtcctcaccatagatgcttggatgtctttctgttttcagaagcctcatgtcctattacttctctgagtagcacagagccgagggaattttgctacagatcaagtgcagggaggtatttggggaaaatagcttattgtgacattgcctgagcacttgactatgaaaccaggtctcctcctaagagcattgaatgtgcattaactcattccctcctcaaagcaaacctatgtggcaaacaccaaacaccaatatcatgcccacttaacagatggagaatctgaagcgcagcacgaagaggtgtattaacttgatgaaggtcacacggccagtaagtggtggagccaggaagcctggcacctgagtctcttttcttagcccttccgcaatacttcctcatacaacaaccatgtaaggtagtgtgacataggaaaaacaaactcagtttctcctgtgataccctctcaccacacaatcaacacagaacacttctgtgacctctggtcaccaagaagtgtgtggcaatttctctctggcagcaaccagttctctgggagatctttcagcagacaccagctgggtgtcctctaattcagttcaattttgacactatctaactggagatggtgtcagatcccacaggttgagtactcagtcccataagactgcctccaatttccactgccaattccaagccccaggttattaaacctgtgcttctgatgaccagctataaatcagggttcccacaatcccttccttgggtttcatgaacttgctacagcagctcacagaactcagggaaatacttatgttccctggtttattataaaggatataccaattatcaccagatggaaaagttgcacagggcaaataatgtgggaagaggcacggagtttccatgccctgtctgagcacatcgtcctccaggaacccccatgtgttctactctctggaaactcttgaacctagtccttttggatttttatgcacacttcaatacttagacagcattgattaaatcattggccactggtgatcaacttaacctttaagcccttctccccagttcagaggttgggggtggggctaaaagtcccaaccctctaatcttgtcttggcctttcctgtgaccagccctcaccctgaagctacctaagggtggatagccatcagtcaactcattagtatacaaaagacacttatcactttaatgataacaagaattttagaagttatatgcccagaaacagggataaacaccaatatatattaatttgcaggtactattatttcaccctttttttgaatactgggagattaagacttaaagaggtttaaagcaacttgtctcattacagaggaagggatcgagacaggatttgaacctgtacagcttgataccaaataacttgtgcctagcagtgagttacttattcaggggtcagggccaggccttcattagggcaggctggacatacggacttttccatgctgctaggtttaacaggctggtatcgcttccccatctcttgtcactaaaaactcaattagcagcttgaggctgtgtcctcacatcacaccttctcattgatcactcagactgtgagtgagaaagattttaaagctggttggctttgcaaagcatagagcagcaaccattgagcatatgcttctgtgggtatatatttattcagcttatgttgagtataattttggatggtatgcatattttattttttgttgcagagagcaatttaaaagaagaaaaaaaatccttctctgaatggagacagatgccatatatgttggaccctcaggggattgaaaaggatgaggttcccaagtccagtgttctggggacggacgtgggtggaaggaaactcacaagtgatgggaatccaggatcaactgcaacacccacagcaaggccagcaaggcactaaccacccagtccagggcagggcccttcaaggttttattcccaaggcctccccagtagcctgtctgactgttctctacatgctatttactgagtactaaatattgagtgatgggtgaagtgcacatcatcccccttaactttccccacaactccatgttgagatgctgttgtacatatgagaacacagatactacattgcccaatgtcatcaactagaacagcaggaatctgtgtgctgggaagccagaccccagaaccagtgctctcaaatccccaccaatgtcatctagtggttactggagtccttattttggagtcctgatatccatgctaccaattcctatctgagtgacaatgaacatgtcacttccctttctgagttggcttccacactcacaggatggagactgagataccattttgctagggtgttatcaagattcagagatccaaagttacacttaaaagtcatttgagacatttgttctttttttctaccccaccccctgcctaaaaggttctcctcttacccaggatgaactcaagatgtaacattttaaaatgagccttaggaaaaaacctgcaagggttggtaccagctggagaaaaataaatacgctcatgtgggtgccaaagattcaaaagagagaagcagcagcccaaaccagagtctacaccagagggaatcattatggaaggagaaagttcatcctatcattgtgcagaaaggaaggatccatgtgtgactctagggagtaggatccaaagcatcattttctagctctgtaaatagactatggactctttgctagttaggacacagtatctttctaatgttagggcccagaagagggtcttacacagcagtacttagttgttgagctctgaatgcagctaaaattcaactgtgggttgtctaataaccagtttttgcttcaaccaaaggcaagtttgatctagtttgataagatgtgctagatgctggagaatccattaccaacagtcaagaatcacataaaagagctgctctatgcatacctaagtgggaaaactgtaaaaaaaacatgattagcataaaagacagggtcttggccacttccagaagggaggacagggttacaattggaaatggaggcatggtgggtgtgttgggggagggcttatggaatgcaggcaatattctatttcttgacatgggtgatggtttaggtgagaattgcttaattcgtatcaaaactgtaaataatgttttacatatttttctatatattatattgcacagtaaaattgctaaacatctatctatctatctatctatctatctatctatctatctatctagttatctatctatcttatagtaaatctactaaaaggacatgtcaaaatgttagtagtagctatttggaggtgacatgactatgggtgatattgttctttattttttctctatatgtcctaaatattcttgtatgtgcatataataatttcataattaaaaaaaaacacgttttagttgaattgcttcattacctaaataaggcaacaacaaaaacgtgaaggtcagttccaccacttctgcctgaaattcctccaatggagaacctcatcttctccctaaggttcaatgtgcatgaaagaacagctctgcagagtaagttgaggggtgccaaatcccactggctcttatataggcctatctgcagtgtcttccccctctggaaccaagtacatctttgacttaggtactgtggcgggaaagggagatgccccagagagaatcaagtttaactctgaatttgtaggaaggacaggagcatagctgaggattcacagtaaacagagtcatgttgagaaacagggtcccttcatcacctcggactgtattatccccatgatcatgggcctgaaaaatcacctttccctttcagtgatgatgaagaaaatttctgaaaaccaaggaaagccagaaaaggctactaagtttcctagctcaacaagctcctctctacacaataggacctgatcttaggaagggaggccatggccctgggttttgctcatgcctggctactttcactgggtccggccaacaatattgtaaggtgcagggatcattcccattttatggatcagattagaggggctcagatacattcagcaatttgtccaaagtcacacagcttcccagttacagggatgggatttgaatccaactctgaattatggacaagtctattctttttactggactggaattctgattaactagcccatctctctctaggaacgtctgtcactcagttcgggtagaattttctcaatgaggagaaaggctattgagtgtttgatgaaaccttctcactgtttgctccctcaagggaaagggatttcaaaatacctgggctagtgggtcaagacttcttaaagcagggatcagagagaagctggagaatacaggcaaaaggatacctttattatttgtaaaatttaataacaataataataatgtcatttgtcatccatttatcctcaagacctatgataaaagacaaaagaatgatgataaaaataaaagcatgttatcctgggtggaagagagtcctacactggaatttcagacacctgggttctatccaagcatagctcttgtgctctttagcctcaatttgatcatctttatttattacccaaggggaaaatacacacacacacacacacacacacacacacacacacacacggttaagatcaagctaggaagtcagttgtcctaaaaagaaaaaaaaattggaaaagctctaggaaaagcagaatgtgtagttctgacttagaaaattgtcccgaagaaacacaactgtatgctttttatgcttccatttttaaaattacatatataaattcttatttatatttgcatatgcatagggaagaagtgtatggaaggatatgtatctatctatatatacaccaaaccgtggcacatttatctaaagtgggtgagtagttaagaaagggggccttgagtttttttctttatacatttcaacactgtacaaatttattttattttataatgagaatgagctacttttagaaaaccaaaaaaaatttttaaaggaagattgatgatcagatggagaaaataccttatgaatgcaaaaattctattattataattaagatgaacacaattattccagcttttcgtttcagagctaaggagaaggtgtctgatgatcagcattctgatgcctcaggagacactcactggtgcttggcacaaccactaaaagttctgtagtcatggcttctgacctcctcaaaccctcaaggagacagcagacccacggcctcatttactctcctctgcattgcctcttgtatctggaccctctctcacagacacagtgcacacctcactggactccactcccacatgtactacatttattttatcactctcctgatcagagaccctttaggccaaataccctagcccgcccttgggctgcactctgaaagaaaagcagcacctaaaacagtgtggagcaccagatgctctattgctccttttgaaaaaatccatcccacaccttcacccaaatcatgaaacactaatacaatttgaaaactgtccttacagacttctgggaatctcttctaaagaaacagctcaaaacacagaaggtggcttctgcccaaaggtgctcagagcagcacggtttataatagactaaatctggaagcaatcaacatgtccaaccagaagacaaagcaaatgctgggatgttccccttcatgaaatattaggcaatattagtgatatatatgaatttgtcctggttaagggttttgttatcaacctgctttggcccaatttggcccgaattccctgctctagaactgagtagctttgtggtcctgagcaaattacctaagttttctctggctcagttttcccatctgtaagaaaagggataataatgagatccacctcagaagccttgaatcatagcaagcattcaaacaattttagctctcatcattgccaccaccaccatactcaaccctgcatgagatatcagataataataatagcaaccatgttttgtgcctgcttagggccatgttctagcccattgcgtatgcattctcagttagtcctaacagcagctttggcaggcataagtagtattatccccattttactcaacaggaacccaaggctaagaggctttaagtaacttttcccaaagtcacatggctagtgaatgacaaggtaagattttggcccaggtttctctgatgctaaaaactgtgtacttaagcactatagtgtcttcccaaaagtaggggatggtagtgggagatggtagtgggagcagtgatttatgcagggcttgcagacaacagttgggaaaactaggagtgcagcttccatttcctgcctccaatttggggcttccttctctctttttttttttttttttttgagacaagtctccctctgtcccccaggctggagtgcagtggcaccatcttggctcactgcaagctccgcctcccgggttcacgccattctcctgcctcagcctcctgagtagctgggactataggagcctgccaccacgctctgctaatttttttgtatttttagtagagacagggtttcaccatgttggccaggatggtctcgaactcctgaccttgtgatccgcctacctcggcctcccaaagtgctaggattacaggtttgagccaccgcgcccggcctcccttctcattattccccccccaccattatttcaggaatcaaagggtaaaacccatcactttggaaaaaggggggctgcttcctgactttaacagataatgacttccacacaataaaaccagcttaccagaaataccatcagacccagcaaatccaagtcccaacgaaataaaataaggggaaaaatagagaaggcttcaaatgtcatgagaagaaaaaaatatttaatgtcataaaagggtgcataggctttatgagaatgccacacacaataatcttggaaaccctattaccccacctacccacccagcctgctccaaattcataaaggaaagatgcaaatgcactgattggaaagatgcaaatgctcctgattgaggagctactccctccttttcatttcccaaactttgagtcctgtgtgcaggcattgaatcagtggacacagtacagttccaattcccttctttactggctattcttatgtccttttccaatacagttccaatttccttctttactgactattcctatgtccttttccaatacttagcctctttagcttcctctggatctcttggatgcagtggaggagaaataaatactggacattgatagagggtaaagagaagaaagtgcccctctcttcatgcttcctgacattggggacattcgccttatccctagggaactattctcagccttgggagggtgtcttctgatgaattaagagaatgagctttggagtttgacagagtttggagtttcctctgcctttacctggctggttggatttgggcaagtttctcatactttctgactctatttcctcatggataaaatgggagtaataataatgctttccttataaggtagctgtgaggatttccagggccaggcacataattagtactgaaatgttctctctatatatccgtatcagtaatactaggcctgatattatttatagcatttattcatttattttttagtagctttaataatattaggcctagtattactgatcaaggtattcaatacatatagagaattctctgtctgtgaacctatttgactagaggatactttgatgaagacaccatgggggcgatatgtcatcctgtaaatcctgttttgcaacccaagagcctgaagttattcccataaagacacctgcctgctgcctttgcatctttctaataatttttaaaaagaaaaatagggcaaccatcagtcctctcattttggattttggcaaaatctgtctcagttgtcttctgaatctatcataccccatgtggctgatctacagggataaatttagctttgaaagtccatttctggaaaggaaaaacaagtctccaagggctagatcccatggaggctcagcccagctgcaccgtgtaggagggttacatgcccaggcaggcagggctgggctttccctggtcagcagtgcctgggctgtgctccaaggtgatttctcactctgctgactcttcttgctagtcttccccacccctcttgagttttgttcctttaattacactgcaattgagtcattaagagggggaaaggatgaggaatggagaaaagccggtctctctcccctactgaaccagattccagcttttgcctccctctgagcagtgctataaggttcctggcctatactaaatggaaatccatatgtttattcatcttgacttttagaaaggcagctcttgttgttgtctctcagcacctgtgcaatcagggatcctatgatctttcctaatatctggcaggccagatggttttttagatcaaaatgaaaaaagaaaaagatggggcagaggcggcagaaatgtgactgggtgatttgtagggttgaggagtgtgggattggtttgagattgttctagaattcagagccagggctaagaactgaccacagaggctcctcctgaaagacaccatcactctaagacccagcgagtatgcaaatccttccacttcccttagtcctttctatgaaggccttgactattcgatgttgcccctcctttctatcctttcccattatttttctccacatatcccagtttcctaccagatagtttcatttttctcatgtgtgaagtgaaggtaataataatatctggctcatattattactgtgagcataaggttggttaaaagaagcaaagcacttagaaccgtgcttggaacagtctttgtatggatagttgcttttatattactagcttttcttttttgtaaaatggacatgatagttccgggtaggtgataattataggcattaattgccatgaacataggcaaaataacacatagtaggtgcccagtgagtgccagttctctcgtatgaccactcttttctctgcaatattcacaccaatcctcttagagaattttcacacagagaaacaaagtggtttgttcaagattatgctgcaatcctgctgaagtctgtcttgtcttctgaaggggcttataaaacaaggcttaactcttgtggtgttttgctcctggtccattcacagtgctggatacaggaatgttgcgaaataaataattatactatatagtgacaaagctgatgctatggggccattaggtgttggaatgtgaaactggaagggagtcttggaattaaatctaggttgtattactacctccctacatgaacttgagcaatttccgtatctttctaggcctttgtttttctgtttgtataatgggagagggtcctttctggctctggtagcccttgtctgtctccatgcaatgggtaaatgggtagattaaagatgatcacacattctttgctactcttcgcattgacaggtgaaatctagctctttcccccttgaatctgggctgaccttattgacctgcttgaccaatagaatgtggtagaaatgatgttctgagacttctgaggctggggactaagaagccttgcagcttctgcctaggcacttagaacgctggatcttgggatggtcccttggtaagcccaggttccatgatgtgagaagcccaagccaaatggggagcccaagaaaaaatcctctatccagttgacagccccagctcaggtccagcatagccagtgtcaaccaccaatggtgccagtcctagccccagacaggtaataaaggaacccttctgcaaatgactccccagtcccagatgccccatctgtctttgatcagagacaaaccagctgcaccctccacatagtcctgattcacaaatctatagacaaaacaagagtgtgtgaagctactgagttttggggtagtttgttataaaacaatagaaagctggaaccaggaaagtgagctatgaactgatacttcaaaaagggttaaggaggacgcattgtgtttaccagattgtctggtgttgggttaatcaaaaggcttcctgtgctgggaaaaccagaaaaacataaaagaatggcattagtgaagtgcgtcagggggcagcagttacttagagatggtggtggaagtgtcctccatacgatgctgtgattaagtgcttacagttttctttgtttttattctctatcttgattaaaattttgcagtgtttatactgccacacagaataaatggacccatagcttacatttcaaactgtgccttgctgacatcattatgtttgtcagatttataacatttctaatatacaacaatttttcactcttggaacactgaaggggaacacaggctccctctcttttctgatgtttcattcactgttacttcctctatcactggtcaagggatatggtctccttggaaataactgaaaacaaaaataatagcataattatttatatattatttactgtatcaccctcctcatatgatcttttacctgttatcagtattttattgctattgtagcaaattactatgcaattggtggtttaaagtaacgcaaatttattatctcacagttctacaatttaaaagtctaacttgggtctcaatgggctaaaatttaggtgttggcagggttgcattcctttctggaggttccagaggtaagtctttctctttgcttttccagcttctaaacaccacttctcttccttagcatgtaactctcttcctccaacttcacagctggcaacgctgcctctctctaccccactcctctgctttcctgagcacactctgataattcaagatattctcgctcttttaaggtcagctaattagtcatcttaattccttacgcaaatttaaatcctggttctgtcatgaaaggtaacataccagtcacaggttctgggaattaggatgtggacatctttgcaggggccattattttgcctactacacatcttatggccatcctccaattggccaattacctatatgagaaacatattatccaaagggaaggttaccacagcagaaccagaaagctgagcaaaaatatgtcagattttttaaatcttgtgtttcaaaagttgaggtctagaaggtagagctattttagaaggtaaaataataatcatcattataatgacaataataaagcaatagaagcatctgtgatctgttagagaattaccttcccttgtatccacaaagaagtaaaggtcatctgagctggtggaagacaggaatgttggaagtcaaacaaagtaatctagaaaatgctaatgagtgttctaaaaggggtcccatcctctatccttaccaggctacgcccatgagtgtatgaaggggatgagggggtgcagaatatcaggtgggtttgagggctatgaaggcaaaggggttctgggcgtcacttgctatatagcacaggttgacagcaagcatggtgagtgatcctccccactgtgaaaacagccaactacagatcctttcctggcatgtctagatcaaaagagctctagacagctttcctcagatcctccaggtggaactgttggacatttctcaggccctctggaggctggaaaaactagctgacgcacagagccagctggccttaaatgaccttgtggtggaataaagtggatgaggcagcagctgtactacacacctgtgagtcaggtgggaatggagaggaaggagagtgatggacaagggccaagtgatgcagcaggtaccagattaaaaagtgatggcccagcatcaaacatgcccttagctcctaggccttacaggtacattggccctttgagctaaaatgttcagttaagaggtgggaggcagaaaaaaaactgaaattgactagagttaagtttccactaacaatggaacagaaatgaaatgaaattcagttacagaaacgtaatagaacattagatacgctgtgctcctaaatttgtgtggccccaaatatatccactacatacaaatatcagtaatgtggtctccttatctcactcataaatggtactttgtaaatcccaaatcattgccagttatattctttgagctctttcagttttttgtttttgtttttagaaaaatctgtaagtactgttgcttccttttgaaagattaagaaactgatgctaatgaagtcaacatagactccaaagctatggtcattctaatgcctaaatccaggctttagcccaattcactcagcccagcctcctttccatgattcttcaacgagaactcatctcagctcccagtgtgggaaagcaagccaaagtggccctggcagaaggactgatagtgagacatggtcttggtcctccaccctgccacctggtggtaagaccttggaaagtcactctgcttcctgagcctgtttccacattcctgagggaatctactgcccaggtttgttgtgaggatgagctcttagcttgtagacatgctttgagaatgctaaagtattctaaaaatataaggaattatcatgtaatacctgaaggaatgtcttagaaggtgagctatgagaagaagtttctctttacagacatgatggagagtctacagagaaatgaaagggatttaaaatctcagcataaacgtggtatttccctgtctattctgaagcacagagaggagcttgccttacatccattgaaccttgaagtagtggttttaaaattacatcctcaatctagagaggagggtctttgacaacttcatcagaccgttgaatcttctcttatcccctagggaatgaatgttctttctctttctctctcttttaatttttccagtttatatgaataaaagacaaagagagacaagcccaagctacacacacacacacacacacacacacacacacacacacacacacacactcctctgtatttgaggtttcattcctatgggatatctatcctaaaagagaaggagcttaattaatttgagaaaagagaactaatggaaaagaggaaagaggcagacaacttaatcctttgaaaaaggtcagccttacattctggacacaacacagaacatccttttgagctgtttgtccactggctgggtttcagacttcagcaaatcctcctctccccaactagcacttttccaatgtgctatatgaagggttaggtttcaatggtctgaggcagacagctgttgatgtatatcaatctagcatctacaactcctgttgccagcaccccagtttttcttgagagtctatgccttcccccatctcagggccatgcatttcaggtgtagctgcctcctggtgcaagctccaagcatggctgtctctgggatgagcccagttaatccccctgaccagcaattggtgcagggataaatgggcatgagaaccaagttggcacaatgagaaggaatctggtgacagtagttggaggtactaggaaagaagtgtttttgtcctgtaggacttgcatccagcctgcagctggcccaagaatggcacagtgctaaggaaagcagagctaagataaggagggggattccaatgacattgcttgagtccttcaatccaattttctccagacttccacttaagccaatgcatttccttcttctttttttttttttttttgcctatactagtttgagtttagtttctatcacttgtaatcctgagaattctaatcactaaaatttctaattgcccattcacatctgaagagctattaatctttgagtctcagatatagtttcattgcattatttcattctagaagcttcttcgtattgatctcctgacctttgtctgtttctcagctggtgtgtagctgcactaagggccaagtgtgtgttctgtctcccttgggtcttgttcagagagcctagtccagagcaggattcctatccctggttctatccttcccttcttctttcttttttctttatttactgagatgggtacttctggggtgttgagccgaatcaacagattccctgggttctccctcagttttttaagaaacataaactgaaaaaccagtctgtgctataacgtgtcacaggtgacttaataaagctaagtacagcatacagtaaagatactgtatggaaaagagggtcacctgcggggaggga

SEQ ID NO: 82 - DNA, 12232 bp, Homo sapiens
  source 1..12232: mol_type = genomic DNA
ccactgatacaaaatttttttcattctaactcctttccagtctttctagcaaatacttcctcttctttcatctttcatatttgcctttctaggtagttttgaaatattttttctttcctgcttcccccttctccatactctactctgttttaaaaatcccttgtatttatgccacctgactgaggcatcctaatgtagttgaaaaagccagaggcccaagaggctggttgattttcgtttagaaatcatctttgctatttctctatggagtcaagtcactttatagttcctactaggtcttttcttttctcatttgtgaaatggggaaagtagtacccacttctcaggatcactgtgtgaattaaatgagatgatgtgtatgaaactgtctagcacatatgaggctctcttgaatgttgtaagtaaatccaatcatcttacggatctcacccactgttttccactccagcctcatgtcccataatccccaccaccaccacttgattccaaccatattgatctcttttctgttcccgaaatacttcaagctcttgttgccccagcatcttcaaacggactctttcttctgcctggagagacctccctccgtcttcactagctatcttttgctagtctataagttttgctaatcaaagcactttccctaacgtgaccacccacccagcctaagttagcctcttgctgtactttctgttacatcctttcatatttctttataaccattttaattgtactcattccatatttcaataattgtccatttattagagcattttcttggtgcgtatgttccttactagattgggagctgccagatatcaaagaccaactatgtcttgcttaccgcagtgtgcacaccagctagtacagtaacctacatagggtagagatgcaaaataagtattttgccaatgaaccatcacatatttattgaatttttactgagacaggcactgttttcgcattagctgcactttcacagagaatataatttaaattttacaacaaaaaccttcccccatcctccgtctgtcaattcttccttcccttcttcctttcctttccttctttccttccatcctcccttctcagcttcccatgattcaagtaattctttttaacagtctttcttcttaagcctccagatgatctctagaacataaataaactctaattgaggaaaagagagtgccatcttctgctccatctctgctctatctaagctcaatcttccatcaatccttttcctgtccacgaatctccaccatttgttttctcttgttcaatcactgccttctccgtaactcatattgtccttttaatcgtgctttgctctctgcagcatgttgactccatttatcactcagcgtatcccatttctcttcattcccttcagtcaccttgctctagacactctcttgacctgagttctgccaacctcttagcatcttgacctatgccgaactcagcaccgtcatctagtttggcatcagtgacaaaactaaggtcaatcctgaagcttttatttttattgttgcaggatccaaaatacactgctgtaaatatggttatcactgttatttaattctttgaaaccttctggtgagttaagttcaagttattttctctaccacttactagtttgctgatttttaatgagactcataacctcttttagacttaatttcctcacctataaatggaggtaatgggaaggctgaatgagccagcaggtgtaaatgaaagtatctagtgctgaccaggtgcagtgactcacgcctctaatcccagcactttgagaggcagaggtgggcggattacttgaggccaggagtttgagaacagcctggccaacatgatcaaaccccgtctctactaaaaatacaaaaaaaaattagctgggtgtggtggcatgcctgtaatcccagctactcggggggctgaagcaggagaattgtgtgaacgcaggaggcagaggttacagtcagccgagatcgggccaccgcactccagcctgggcgacagagctagactccatctcaaaaaaaaagaaaagaaaaaaaagaaaagaaaaagaaaaagaaaaaagagaaaaaaagtgtctggtgctgtctggcacatagtaggtcatcagtactagtagctactttccacctccaaatgtctatttatttggtccttctgtgacctctgtctctttgcattcatctctccacttctcatttccattttcagaacatttccactatgtctcatttagagcaaacttttaccattgtctctaacttctctttcgtgaaaaatgaaagaatattttaatcaccattgtcgttcttcatttccacttgcatctgtttgactgatttctgcttcaacccagcacttctctgactctttcccttaacaattctcaaatttattatcttttttctccagctcatacctttcactacctcccactttgtctgtccccggtcctctaaatcaaccccttcttgttctgtgatttactgccttcatttcatatccttttatagtcaaaatcctcacaatactcctaaaagtctctttcctcactcattcttttgcattttctttctcaagtccactcaagtttaattcatcttcatcattcatttgcttgtacccaaatctctgtacctttttgcctacttaatcatttaacctattcgagtttccttttgcttctgttacactgtcatctttcatctttaacacatattaatgagcaatgtttctttggactttttcttcatacaaattctaatgctggtgtattttcaggatcctcttcctgggtcccactaactttaattcttttctggaatcttttctctgggaatctgctttagttagaaaaaaaagaaaaaaaaaggcctgcaggatctgctctgtatttattcaagctatgctgctatcgtggtggattcaaatgtatattactggtgaaaagtgtaagctttattctcttctatagagtactaggtcattctcctttctgcagcacactatttttattattattattacattttgaactggtcaaggcgatatcagcctagattcactgtttccataacatttactgaacacctactgtgtgttaaacacaagctattttttttttcttatttaatgtttgcaagcctgtgaatttgggatttttaattcttgttttacatgtgaagcatagagaacacatagagaatgcacggcctgcaatatgttggcaatttatatctaataaagtccttttaacttttttgagtgagacagtaaagtgtaagagttaagagttgcatactttataacagggatagtgacaaccactttggaggagtgttatttaatatttgtcttccctcctaaattatagtttccagaagggcagaaattctatcattcttgttctctgctctcttgtatatattaggccatcaatgattattgttgaataaagaagtagataaatgaatgtatgctaaaagtacaattttttgcataagacaacactggctttgaatttcagctttgccatgtaacaaatttgtgaccttgaacatactagggagaaagcagatatcttgtaacagtctgcatctttaaactttgttgatatatgtcgtcctatacatgttgtttttaatttttatgcaatattttttagcaatactcagagccaggaaagccaaggttcaaatcccagttctcccacttcctagctttaatgccttaggcaagttatctatctcttcaagtatcacttcttcatctataaaatggaaatgatactacctctctactatactcatgggcaggtgccagtgtagttgatgatctggaatgaacacacgagaatgcctgatttcaagtactctgtactttttactacacaagaattctcgttgccctgacttccagctttaaagactgctctccttgtttctcccactatcttaagagctttatataaacttaactcccaggactatgcctggatgtttctcaaggaagcagaggccatctcccactcctgacccagataccaagctctatttgatgactattgtatgataatccacagactcagcaaagctggggctctgcaggttccctgtgactcctgaagcttcagcctcactccatctaattctaagaggctttcagagaaatctgtggaaagttatgggaagtccctctgttcctcctcccagatctagggcatttattttttaaaactaaggctgtggtctacagagaaaaaaaaatctaaattcaaaagagcactctctcttttctcactccttccctccctctcattttttcatcctctcttcttcatggaatattggggaatactattttccaggcatgtggataacaatgatgaacaagactgaaaatgatccctgcactcatgaagcttacagtctaatcaagagatagacaaatacaaatatcaaaaataaatatatgattagaagtttttaaatacgttatgctgaaaaggtatatggttctataaaacagaataatgagagaggtcttcatttatattttggggctaggtaatgtatctctgaaaaagtcacaatttattagaaacaaagacagatgaataggaattgttatggcaaaggaggattcccacgggaattcaaggcagagggagctgcaggcgtgaaaggctgttagagaaaatgtggcaagttctaggaaccaaacatttaaagtcagtatgtcgggacagttgagagggaagactagaaaagaatgaagtgagtcttagaaagttagtttggctgaagctattcaggcttatgtaggccatgataaggagtttggatgtaattctaatttaagtggaaagctatggacaattttaagaaagagaatgacataatcagaactacattttttaagcgttactttggatctatgtagaggatggattggtttagtgtgagagaggatcaaggagtctaacgtggagcctatcacagctgtccagatgtgaacacatccaggaggcagacttacccattacaacctctcccaccatggggtcctgtagcttgctcaccctaacagtggagaattcattatctccactgaaaactggttccacttgtggttgaccttgaccaagagaatgtactgatttatatcttctttattggatgtaccatgtattgattcaaattccatattctggggaagccacatggagcaaactttatgaaaattctccaagtctctgaaggcatctatctttttgtccctttcaaggaatgactgtcctcgtcagctgcctctactattctctgcctgggttttagaagcaacaacaatgagaaacaataattaacaataacttccatttaaatggagtgcttctacattcatcatcatgacatttgatttccacaaaaccttgtgaatccaacagaacaggaaattttagcatcaacttacaaatcacaaaaagaacattcaaagatgtaatttacctgagatagggcagataataattggcagaatcgagtcctgaatcaagtcttccaactcttacttctatcttcttttcatggtagagtgagcatggagcacagatggaagataagctcataggttttggcattagattgattgtctaagtttaaattctgactctgatatttgctgtgtgaccttaggaaaagcacttaacttctctgaactttggtttcttaatctgagaacaagagtatctacctcatgcagttggatgaggattaaatgaactagtagattaaaagtatgaagcacagtgtctcacctatattaataatcaataaatgttcactattatcaacagcttcaatcatcttggtcaaaagccacagtagcaaaagaaaagttgctgcagatttgctataaggtggcttagcttagaatagtaactctgctgcagtatcatgaataaaatgtttaatcaatgacttagttcttcatctgtaaaatggaaataatcatatctagctcacaaagttgctgaaaaaataagtaacaagagaaattgcctagccccaagaattacatattcaataaatgttaccttcctttctctctgctttaacactatttcccctagcaagacttctctgatgccctagactgggttaggtactcttcctctctttgctcttagcactttgcacttacctggagcagaatgtagatcatgctacaattaatgtatctactcatctgtctccactttgagactggagctgctccatgtgcctgttaactattctaagcactttgaaaataacaacccagttaatcctcatatgaactctgtgaaggagttcatgatcatcccccttcataccaattaaaaaataaggcaaggagagattaaatcacgtgtctcaggttgcatgtctggcatacagggggtgttcacttattccttcttgttggatcattccagatgccatcgccttaaaggggactcttgtggctcttttctccaaataactcacttattcaccataatatccacattgacattttctccatcatagctgattcactgattgattggtggacagacatctctcaccaaaataaaagctttaagaggaaagatattttacctgtcttgttcattgttgtggtacccagctgttaggataggccctgacacataggaggtgttcaatgagtatttgctgagtaaatgaacacatgcatgcatttcttaattgcttcacttatactgtaacttaaaaacaatggcctatgtcaaagcgtatgtctatacattcttgtgaaagtttgtagcattttaaattggagatgggttagggatgaggaagactgtagagacaggtaaagagtactcccttctgctctgcactgtctcctggactctaaatagcatcacttgtctcccagcagctggccagcaggtggggagagaccctccgctcagaaggcaggaggagtttctgctcaaggtgacaggagcaaagcaggaggaagctgcacagggaagagatatactgcagtcatggcattaaacctgaggtttgcgatgcccactaagattcactgggaaaaaataatactgaaaaaagtgtaatgtctagtatttatcacctcagtctactggtagttcattctccctgacatctatggagattcttaggaactaatatattgtctaacacctaccctgccaccaatgcactatgtactttttttttggttagctttcattctcatctgttattctctaattaatttttgttgctttaggtcttatgtaacccattagcatggcattcaagttcccaaacaacctttctgatctgctttcttgttgtttttgttcctataacccatgctctcatcaaaataaatgtccttactgttctctgtacacattccaatttccctgttacctcagtctaaattatttccctctgaatagcactctgcgtgcacatacagcagccatccttcaggggcatttttgattctcatcatactctgtatatgtaatagttttttccccttatatgtgattattcatcacataacttatttattacatttaataatttctatcacatatgatactgtagtcaaggctgtgatgaggataactatgattaagaagactgaaaatggtccctgcactcatgaagcttacagaaaatattcactctctctcctgtcacttccccagagcccactgatgttgatcttggccatgcgacatgaatcggctggtgagatactggcagtcatgatgtgaaccgaggcttgcatagtggggcttcctctttgtgtttttgcattgccgtgagaggaacatgctctgccttgcttgctggtccgagtagggtaacagacataagagcagacctggacctaacctgaagtttgaagacaagcctcgccaagacagtgtaaatcagcagatccccccagcctgctttcagatgtttgaatgagaataaaggattgccactttaatccactgtttcaaggtggctttatcacacagcattattgtggtaacaaatagctggtgcaaagtcttcacttccatcctatactctgaatttcttgaaactagagaccatctgattcttttttttttaactcatgcaaagttccaaggcacaatcctaatgcatatttattgaacaaatgaacaaatgaataaatgaatgattaaagagctctagagtgagagagagactcaagatctaggagactaatgtacttgtaagttcaacaagaatttatctaatacttattttgtgtcaggtattgtgctataggaagggtacttagtagtaaacaaacaggacttggcttctagttgccacttagtggtacaggaaagcttgagacctggagattcataatgcagtcaatttgcaaattctgattatccttgaattgcatgcaagggcaccacaataatcagagaagtgataatggatagaaaagagcagaaagatccctctgtcactgctgattcccattatctcaggttaagagcaaattctagacagatgggaggcatttgcatccttttgaagaaaatgagttagtaaaagctggcccatgggataaaataaaaatctctggggaaaggtattggttggtcattttctgattgctgaatgacacctctgtcactttctactattatcgacaggctatcagcatgctgagtctaaatgtcgttaccatctgtgaatcaaaaacctggatccatgacgaccaatctgacagtgtggtctcagtgaacaccagggactctgtctgaaccttgataaaaattactatgtgtctctttcctgagagcttttcctgattgttaagcattactgtcacactctcctgcctaccctacccactcactccaaaggtgttgtcaaggtagcttgtggcagatgccttccattttccaacagaagaagctctaggaaccacaggcatattgctgaaattcttaaataatggaaggcatcaacagagccaagaattaagtccaacttcccttgccctggacactagccactggggagcaaaattcatccaacatgtgctttgatgtcacccaaaatattttttttctgtttgtgtctatcttttgaaagaggaagtggctaggacagatggactattagagagaaaaggcaacttttgcagggctcaaaggatggcactccagaagaaatgcatggctgtctccacaactagcacctttcagcttgaaagaataagttgggccattttaccttcttccatatatgagcaaatcctaatgaggactgcagccataaagaaataaacttttagcttaggtagacaaacattgacagagatctattttcaaatcactatgcaacttaaatgtgataatgtacctgcagcatttagtatacaatttggcctatggcaacaataataataataataatgataataataccatttattgagtacctgcaatataccaagcagtatgctaaatgctgtcgaagtaccatctcagttagctccttcaacaactttaagagctgggaactttaagtatcttcattttacatatgaagaagctaaagctcagaaagacaaaattccttatccagagtcacatagctagtgatggggccaggatttaatctcatgctgtcccactccagagctcctggttacagacactactccacattttctctcataattgagaagaaacaaacattattatcatcgtcatcattttcaatcataatcataattaacaagtgtcataacaagaaaagtcactgaatgagggtagttttctagaatattataactaaaagaaactgttgattgaaatgaagatgcaaatttaagtgtgatctttggggcaaaattgttggagatgtgtgaaaaggaacggaaagttcttttacagtgcaaaatacttggctttgacttcacgcagtagcctaggcaaggtactcccaagtcaattgaaaaatggaatgcagtagattatgttatagccccgattcttcacctctcccctgtctgcaaactctgccctgtgattttgcagtttctcttactaaagaggcacagtctattcccccaccctttaaatcagagcttgaccatgtgacttgttttgaccaatagaatgaggtaaaatccatcgtgggccagttttgagccttgtgtgtttctgcttactattttatgcttctgcactcaccaggtgcaaatgcttgggccagtctacccgccccagaaggaggatgagaaatacatgcaacagagatttcccaggaagggggcctcagctaagcccagcctagaactgaatcccagctgacttgcagacccattgatgagcccaaccctgatcaacagacccccaaccaacccgctgacaagtaaactatgattataaataatcattgtgttaagcctatgcactctggggtaatttgtaatgcagtaacaggtaactggcacagagaataatcatacatattcatgcccaatgcgtggcatatagtagctgttggaaaaaaagaatagtcccctttcataccttttcaaccaatcagaaaagtcccagctcatcccagtgaaagttgcaaaattatgttaagatcattagtcacaaagatggaggaagcaagttcaggaataccatttatcaatgcttctactttggctccttgctgagaggagagaagcaaagcaacggctggaacatggacctcctgcactgggggcatgcagctccaccatcgacacgcaggtggcctgacagcctcagagcaggttttcctggaataattattcccattgccatgattggttatttctatgtcaaagtcacttccccttttcactcctgatttttcatttttgtaaaaatgacagtgcttgatttagctcttggaagaggatagggaatttggggaggtgtagagacatggagcagaaagttgaggaagggaacaaaattagtcatcaaaatgggctttacaaatataaagtgctaatgaaatttgaaataacaacaataattatgcttccaaggccgaagcctcacatttctcaccatgaatattcattccctgttatctttctaaggaatgaaaattgagtgaaatagcaacatgcatgtagggtgttgttgttgtgtgtgttttctcttcttctatttttacctggaccaaggccagcccctggcttgagactgtatttcagtatttttgtagctatgatttgtttcactgggtgtccatgtgcagacatcttaagtggaagatgcttcaaaagtcaataaaatgtaagttaaaaagaagtgtgtgggtgggggagctgaaacaactctttgtagctgctaaatggtcacaggtggaatatcactttgacttagagcttggcagccagaaatctggacgaggggatccaatgcatcttttaacaactggcatggaagattaggaggctattgctaagttatcaatagacggtgcagtttgctgctggaagtggtcttcaattgacttctaagtgcagaagttacatttgtacaacaacagtcagtataaccaactgtaaatgtatatacaatggattagtctgttcaggttgtcataacaaaatcccacaagctgggtggtttaaacaacagaattttattctctcacagtcctggaggctcgaggtccaagatcaaggtgccatctgggttagtgtctagtgagggctctctccctggtttgtaggtggcactttgtgtcttcacatagcctttccttggcacatgtgctcaaaaagggggggagagaaagggagaggggggagagagaaaaggagggaagtgaagagagagtgaacaagagagagaaaatgagagaaagagagataagagaaagatatcttctacttataaggtcaccagccccatcagattagggtcccattctcatgaccttattgacttttaccttctaaaagccctatctccaaatacagtcaataagcttcaacatacaaattttgaggaggcataattcagttaatagcatacaatatagtcaactgtctctgccagctcttgtgaaggcggcatggttcccgttgtcaccaagaagaaaataaaagg

SEQ ID NO: 83 - DNA, 171745 bp, Homo sapiens
  source 1..171745: mol_type = genomic DNA
aaaatgcacccataagatatgtttacctgtctcgctattttcaggcagagagtcatattctgagggacccagagcgagagcgttcatgtctgctgggtccgactcctgcgggtctggcaatgcggcattctcatggccctggtcaccatcaccattggcatccgatcctacaattaggagtttaccccaaaaaggcagggttagaagcataactttctcttaaaacaaagcttacacttgcagtgactcaacttctttagactgtaaaagacctctgggctctcaagcactgccacataccatgacacagttatgaatgaacaacatcttaaagacagattaaaatggcaacaaaagcacaggcctgaaagcagggggctgcacaccacggccatgctcaacttaccctgcgggccacggtctgcgtggtggccagccacctcctcccatgcagcactcacaccgtcagcagcactgcttgcttccagatgtaacacaggagccccccacacttctgcattagggttcagctctgaaaccttagttgctggtacctaggaagaaatgtaagatagacatttgtatccaaatgtcaaccaaatacaattttactcattaatgcagagttaagagacatcagatataggctccaaaggctcagcctatgtatttatacacacctttggaatgaaatcaggttcaaaattaaaaaaaaaaaaaaagcagtcagaattccattaaattccccccaagttttaagttcctcctcccaagaccaaggcttgcagagatggggaaggacacgcctgccaccaaaagattcagtgtttcacaaactatacctgaggaatagctggtgacttcctagactcctaataaaatcacaattcagggttttacaaacttgaatacaaggcagatgaataaaattctaattagaaagcttaaacaagtcagcagggcgcggcggctcacacctgtaatcccagcactttgggaggccaaggcgggcggatcacctgaggccaggagttcatgaccagcttggccaacatggagaaaccttgtctctactaaaaatacaaaattagccgggcgtggtggcgcatgcctgtaatcccagctactcgagaggctgaggcaggagaatcacttgaacccaggaggcgggggttgcagtaagctgagatcgcaccactgcacccaacctgggggacagagcagaactccatctctaaaacaaaagaaagaaagaaagcttcaaaaagtcacataaacaaaaggtgtagaagatgaaaattgctcctaagaatgaaggtgttctaacaggtctgtcagggatactacaggataagaaagctcaggcatcctttgaggaagaagataaaatatctcatatttttcacagaactacctgttcccattcccaatagagcttcagtatcaccttgaaagaaaatccacaggtgaccatgaagctgctagtccagtgttctggacaacggactctcagatcactggggctgaggccaaagctgccatggacagctgtggaacatgggctaaacctcacctggaagacagcacaacaacatgatgcctggcacataccaagctcatcggccatcatgacagtcacgcatgctcagttagtcccacagggcagtcctctactcaaaaccctcccgcatcagcttggctcatttggagtaaaagacgaagttcccactgcagccacagcgccctcctgtgctcactgctccctggccttgtccatttccaggcacactgacctccttgctgtctctgggcacactggcacttttgctcttcccgtccgtctgtccagaacatcctgcccagagactggggactggtggtccttcctgacacagcgaataaacccacaaaagtcccccaccatgtggatactccctactcccctgatttttctgatacaagcctttcttatgcttacacaagcactccccaaagcctaaagaaaagtcaaatgtccaaacacacaatccttcaacaaacttacacatgatttgccttttcaaatgtgccacccaccttcacaccacagtgcaggaagtcaaagcttctggaggaagggacaggtccctggtccccggtgccccttggaatcaggctgcaagctgggagcagttacactgcactaccccagcatgcagcatagacacaccagtttctgcggcccagaacacaggagaagggctggaaaggaccaccatgagccgtcaaataaacgatgggtgcattaacaatttttaaaagacagaataaatccacattggctcaggtgatggggctggtagtaaaaaacatgaaactatttctgaaactgagagaaggcagctgatgtggtttgttcgttcctgctcccccagtcactggagcaccaatgagcaccatgcccataaaaccaggtgtttaaatgagtatctatctggaattctttttagtttttgttttaagtactggtgatagggcaaattattgggttccttcaagaatattataatcaagaagcaccaattcttcaattttccttcttgcattgcatctaaacttcatttttggcctctgcttctgcatagtgttacttgccctcttctctctcatccacccatctgtccaacaagtgcctctgacatgttcaccagcatgcttgtgccaggcacggcactgagctggcaggtgtgatggtgaaggaagcagacaggagctcatggagctacatgagggggcaggagacagccacaggtcacccacaacactgcctctggcagcgtttacgccgctccacctgatctgttgtctttgtaaattcatttctctattctctttcccactctaatacttccatacatcacctttcctaattagacccagtctgttttcaccaccaccacacaatccagttttccagcctcggttccattccatccacttagctggctcccctcagctcatgcacatactacacgtgctttaaattcccaacactaactaacagtaaccttctctattattagtaccttttgcagttgactgtcctatagtaccaaaatacattttgtggtttattaatacagaccaacagcactttgaaagcagtgacagcatggctgttggggctcccgtggccctcgtgttcctcctattccagggtggcagtcaccatgggcattttcctcactgtagtactgctgatagccagcacagtcctgaattcagtagggaggtgctcaagatatatgaggaatgaatcaatgtttaataaataacataaatttatattttccactatttgacaacttctgcaaggttttatgccacaaatgactaggactctacccttaaccaatgactacctcttagtgaagaagtccaaatcaagtgtatgcagttaggaaatgttcaatcaatgctgtgactgaagagatgtcaccaggaatgaaagaatgaagatgtcttttaaggcttaatgacattcaaggatctaccacgtgctgagcacattctacgcacttccttgtactgaatcagaacaagtcttggaggtcgttattcactggactcatttcacaaatgaaaaaaccaaggcagagaaaggtagagtaacttccccataaaaacgatggtaattagaaagttagattctaagcaattgcgttcagcaaaattcaacactcatcaagagttcattaacttataatttatgagaaatagtttgtattaaacaaagatctgaatctcctactatttctataaaatatggttattctcttgcagtaatatggaactctaaatggttatcaagaactccagcgtcggccgggtgtggtggcttatgcctgcgatcccagcatgttgggaggccaagatgggcagatcacttgtggtcaggagttcaagtccagcctggccaacatggtgaaaccccgtctctactgaaaatacaaaagttagctgggtgtggtggcacacacctgtaatcccagctacttgggaggctgaggcaggagaatcatttgaactcaggaggcggaggttgcagtgagctgagatagtaccactgccctccagcctgggtgacagagcaagactccatccttgaaaaaaaaaaaaaaaaaaaaaaaactccagtgtcgtctgcttgactataagtcttatttttccattaaaaatgtatggctaagcaatggttattaaaaccacaggcaagctgaccttaacagccacattccaaagtgaacatgcctgagttctgatgctttaaataaacccttccaccccaccccatcctgtgcgaaacaatatgctccactttgaaaaataacgtatcaattaataagcttgtataactaccgatacgagacagaacagtctctctgacaagttactgactaggaactggagtaattaatgctggagaagggggactggccggtgaggtacagaaagcaggtgagaaataggggaaagaaacattccatgcaagcaccaaccactcctacagatgcactaaaaagcttagtaattcagggcaatttgctgacttcagaaccatacaaggctctacctccagttctttgtgaaatggagtaatagctgctatattaagatttgcttaaaaaaaaaaaaaaaaaaagacacctgtaacagcactttgaaaattgaagctctgaaaggcaaggcaccatcgttaaacgtggtaacgcttcgtatgagaatactgtttgggaatacctcataatggaaaagctaatttaaaactggaagcacacctctcacttaggcatcatttatgctctttgttgatgtctgaggcagtgacactggtaactaactgaaaattatgtcacttctgtaaaagattaactgcagattatcttaaagatgtagttttatactgttttgcctccacaactatttaaggagcaaaactaatgaatttgaacataactctctccagaaaaactcccagtgtgggcacggaaataaaagaggttgatggatcattccttacactacagaaggggatttctacttgtttatttccatatagtaagtgttgacatttgagccatctctacctccttaatatcaatacttttccttgcttcattgcccacaaaaatcatgaataaaccactggttgaataatgagatcttgctactctgagtatgtgctttcaatcacactgcttcgataaatgtctgttttgtggaagaaaactaatttcctgttgttgaatgatgttgacatttattacagaatttctggaaagatgctcaaattagctgcccatagagtcatttgctaagcttcttccaaaccagagggacagccttatctcggggttctgaaaaagaaagagctccacagtaattctaactgcaagaagacagaaccaagatttcataggcagttaaaagcagcaaattctacctgcctcagacacatacaaagatataaggaagcacagatttttaggtaagtttgtcttctgcagtgtgacttataccttcaatgggctcacatgcttatcgaatcaactacactgcccacgagataagatgccctcaaagggctctgacaacactgcggccaggaagacagaagagctggcaaaattcacagacagaaaaaagtcaacacagagctcagggcatgctttagtgctaacaagagtttgcacacaacctctggcttaagtacaccaaacaagaattcatattctccaatttggaaatcattaatgttatagtaattcacagccatatataagcattcaaataactacccactgtttagagtaaatctttattaattttaagttaaaaacaattaaaattggccagcccggtggctcatgcctgcaatgccagcactttgggaggctgaggcgggtggatctcctgaggtcaggagttcaaaaccggcctggccaacatggcgaaatcccatctctaaaaatacaaaaattagccaggtgtagtggcacatgcctgtaatcccaattactcgggaggctgagtcacgagaattacttgaacccggcaatcacttgaacttgggaggtggaggttgcagtgagctgagatcacgccactgcaacttgggtgacaaaagtgagactctgtctcaaaaaataaataataataataataataataataataataataataataataataaattaaaatgtatagcccagcataccgcagcacaatagtaaacacacagaaaacatacttacgaactgtccgtctctatcatgccatccccaaacaacaccgtcctctgacaccggtagctgaggagtgttttctgaaaacaaagcaatttccaaggcctgtggcttatggtgcagatcctcactaaatattgtttcaccttctagagcaccttttgtgactgtattagtccagagatagcccatttgatatccaccacaaccactggccagtctttcagaaaatgctgggtttcctaaccctcccatcgggtaataggaaaattcactcaaaaaacgggagactccttctgggaaactctgccaatccacttttgagggatgttcacatctatttaggacaccttctgtgagtgataaaatgtggccactacttggtacaatcgtgtctttgctgtccacggggacagcgggaatcccctgcgctgcatcgcagggggcacctgtgtatctgtccgctagggtgggatcaacaccaaccagaaagaaattgccactgggagtgtcacgtgactctattttctcaaaactcaccttagcatttcccataaaacccatttcaccatttaaagtcgactgtgtaagagtggacttggcgtttccttctttgaaatggtgtgcacgttcactcgtcccacatggacccaggcagtcagtaattctggggtcaatactatctttctccaaataaagtctctcttcctcttctttacatgttagttttggtttactcaaccctgatgtattattaccaaagataccagaagcttcttcaattgattcagaggaaattcccttccattttgggcttttaccaccactaacagaattctctactatttctgacttctgtataactggattaacacttggactgaaatgtggtaacacactaagaacattatatttgcagtcgtatactcggtgtgtttcataacttttttctatttgattagtttcaaaatcagcgttctctgttgcactagaactaacacaggagagtacatcctgacttggcactgcctcatgtctttgtgtacctgtttcccactcataggttgttttagaatctgacttgacagtctctatgtcatcttcacttgtctcactatactttgcttgcagtgattctttttcactaccttctaacctttgagggtcactcagctggtctcgtgacacactgactgaactcttcacacatatttcaccctctgttttgtcacctgggcttgtttccctctcttcttcctctgtgcaggtgaaaataaatgcggaggaaacacagttactgtgaagagatctggagtgactgggagacttgccatcggggggcactccttgtgccatgctaagctttaggccatctgtcctctgcaccgtcccctgcgtgtccaccacacgctccacacaagtttggtcacaggtctgtgttgcagcctcatctgcttgacaccaagattttgactcaaaagcccttacaccatgaccctcagccttccaaacgccaattctgtcctcttcttggtaaaaggcactattttcagattgcagagacacctcacctctgtctggcagcaggggacttctggcctccaggctgcagtcccctctgcgctgtgccttcctgacttgtctggggacaggttccggctcccagcagtcatcaagctggcttggggctgcttctcttgaattagcgtgacctgagagacacccacttccaaatcttactgcagtgataggcctcttaggacttaaatcaattctatctagaccaacaggaaggatactatctgctttgttaacgtccaagtagaaatcatcgttgtctcttagtggtgtgatagagttattttctctctcctttttagaatgtaaactctggtcgacaacaactgttaccacctccgggtcatcactccctgcaacacatgcagtgtcagtacaaaagctaccaggtgaatgtgcagtgtcagtacggaagccaccaggtggatgatccatctcacttcctactcctgagttacagctctcactttctcccaggacacacgcatgacttagtgagtcactgtccatgttgttatttaattcagggagtaggtcaataccatgtagtgcactactttctgcgtaatttttagggaattcagtgcaagcttctgcctgtaaagcctccatctgcacgttatcagtgtttgcttcacaaggtgcatggctgaacgccacaggctcagggcaaggcttggctttcccactgcattcccctgtcctttcacctggacccagcgtgtcccaaggcgagagttcttcctgccgtggctctggctcgcccgcccctgacatggcacgcgaggctgaaggcactgaagagcaacactctcctcttgcagctactgtgtctacccaggtgcccagctcctctgccacgcttgggcaggcagagtcggcaacacaaatgctgtgaaacttgcactctcctgaatcctgacattgctgatcatcaataccaacagggtttccatctttcctctccctatcggataggtctaaagacttactctcatcaccactgctgaggtgaacgctgaccaccatttctttctctactaaagagtttttacaagtagctgggtaacagtgcagatggccactcacaaaggcttcctcctgcaggcctcggtcagaaggcaccagcacacatgagaaaagctcctcatcttcccaacaaccttgtcggctgccgttacccacacacagtagatcacagaccccctcagaattctgctcattaacaacaatatctgaattcttgtcattctcacccaagttttcataccttgttgagaatgtatatataaaagaggaaagagggttcaatgactgcttgggtctatgaccctgtttgtgcccagaccctgcgaaaatccttgtccgcgcgctaacgccagctacactgctggctccactgccagtacggtgaacctcctcacctttgacggtatcaaataatgaagacaaagttttacttatcttgttttctggttccttttcctccacagatttttgtaacaggccagttttttcactgtcattgtcactacttagttctctgctgaagcagcagcccatgtttgagagctcacaagcacacgacaggcgtgctggtcccaagcctccacagacgcacctcacagtaacttgctataatttctgaggagaagccaacacccagagaccaaaaataaccccttgcacagcggtcacatgttcctgccactcaaacccaaatcctaatgacaacagagcccgactgacagccagcatactccgtgtgcccaattccaaacaggaccaggatccaaaagctcagaacagcagcaagaatgctgcgctgtattttttcttactctcataaactcaataaaacataacttaaaatattatcccagccagaaagatttcaggcttctggtttttctacagtgttccagtatttcccaaattatatttcatgggatggtggtaactaaataaaatagttcataaattcccccaaaggaaaacagtatcagaattttgttccgtaaaatatatagctactcacagttgtatctaattttctagctttacgaaatgatgtctgaaataaatagcaatttaaaaagagacgaaaaaatcaaaggagagcaaaaaaataaatagcaataaaaaatagtatctgtaggtatcaagaaattattactaattgtgtcaggtgtgaaaatggaatgatgtcagttagagatgcatgctgaagtatctgggataaagtgacacattatctacaatttgctttaaaatgccctagcaaatatagtaaatatatacacacatatataaaagttaaaacagtcatgtgcatacagggaggaaaagatttaaagacagtagtccaggccggacgtggtggctcatgcctgtaatcccagcactttgggaggccgaggtgggtggatcaccagaggtcaggagtttcaagaccagcctggccaacatggtgaaaacccgtctctactaaaaatacaaaaaattagctgagcatgggagtgtgtgcctgtagttccagctactcggaaggctgaggcaggagaatcacttgaacccaggtggcagaggttgcagtgagccaagattgcgccactgcactccagcctgggtgacaagagtgagactccatctcaaacaaaacaaaacaaaacaaaacagtagtcgaatgtggcgatgggtaatgttcaagttaatgatgctgcatttggttcatggtattattcgctccacttctgcagatgtctgagcactccaattaagaaaaaggaaggaacaagaaaaaaaagggaaaatagatctacaagctctggtaccagaactagaaagtctcttgaaagtacttgatgcaggaacgcacagcctgccatctggtgaaaaacaggcgttgtccacaactaaacaagttgctcatgtactatgtggtccagtccctaactgtggactcacataatgggtcttgtcttacattgacatctgtgatgttttgcttttagtataagtaattctttttcttattatggttctgacaggctatgtgaaaaacaaaataattcttttagttcctctgcaagagagattttgttgtttctttaacctatgagttatgactggtgtcctattaatgttttactttttaaaaatattaacatttttatgataaaaagtttaggaattacacttaaacataaaggtaacaagaacacttatgaatatactaaaattcaagtactgaaatcatcataatgattatgatgataatggtagtcaacactttatatagcactatgtttcacaaaatattaattacatctatgcatccattttgtcacacgtcttaatttgcacccttaacaacccccaaggtagatactactaattcactgtacagataagggaaatgaggcaccaagaactttagtagcagcttcgaatgacaaaacaaaactcagaccatacattgaccatactgttatgctactcaaagagaattaaacatctacatggcaaaaacgttctgcactaaagacacaaacgattcataccagctgtaaaatgaaaggacatagtaaagcagagaagctcacgagatcacctgcctggctttgagtctcagctccatttttacatgtgtcatctctggcaaattatttaacctctttgtctcagttttctcatttgtaaaatggagccaacaccgacatctatttcaaagagctgttaggcagactttaagtagttggaatagaatctcagagtcccacttcaaagtcccccataatctggccccagcctacctctatgatctcggcttctaagataccattcccccgacctcttctatctcatactaaccaatgccagcacactgcctcaatgttgtttctttctccagtctcctccccacacttttcaagccttgaagtcctttgtgaaaccattctgtgctgctctaacagaatacctgagatggggcaatttataaagaacagagattatttcacacaattctggaggctgagagtctcaagtcgagaggctgcttctggagaggcctttgtgctgcaccatcacacatgtgaggaaatgcagtcactcccaccacaatggcactcatccactcctccacttgtgagggcagagcctggtgtccttatcaccccttagaaggccctacctcccaatgctgctgcacggcggactgattttccaacacatgaactttgggggacacatgaaaaacacagcattccattccagctcccacaattcatgtccttcttataatgcaaaaaatactcattccatcccaatacctccaatagtcttaactcatttcagcatcaacttaaaagtccagagtctcatctgaatcagatagggtgagactcaaggcacaattcaccccaagatcaattcctctccagccctgagtgttgaaagtaacaagttatgtgtttccaaaatacaatggtgggacaggcacacacacaaaaaaattcccgaccaggtgcgatggctcacgcctgtaatcccaacacttagggaggccaaagcaggcggatcacctgagatcaaaagttcgagaccagcctgaccaacatggagaaaccccgtctctactaatacaaaaaattagccgggtgtggtggtgcatgcctgtaatcccagctacttgagaggctgaggcaggagaatcgcttgaacccagcgggtcagaggctgcagtgagcagatatcacaccatcgcactccagcctgggcaacaagagcaaaactccgtctcagaaaaaagaaaagaaaaaaaaatctatttccaaaagggagaaataggcaagaagaagcaagaggtcccaagttcaagacccaacagggcagacaatattaaatattaagcctctctggagaatcatctcctttgactccatgtcccaaccctctgggcacagtggaacagggttggctccccagggcctcaagcagccccacccgatggctttgctgggctcagtccacccagcagctgtcaggggttggagtctcctgcccacagctctcccaggctgatgctgcaagctggcagctccacagtttaaggctcccaggccactcccatgactctactaggcaatgccctggtgggggcttctctgcagcaggttcaactccaaatttctgcttgccattgcccgagtacaggctctctgcagtggctctgctcctgtgacaagtctctgcctgggcccccaggctgtccatgacatctcttgaaatctaggtggaggctgccccacagctctagcattcttcttgcctgaaaaatcagcaccacatggatgccaccaaggtttatgacttgtaccttctggagccgcagctcaagccaccactgggcccactcaagcagcagctgaggtgactaaggagcaatgcacaggatgtggggagcagaggtccgaggcggctctgggcagcaagcctgtggagggcccccagtgctcatctaccaaaacccttctgccctcctagagggcaaatgtgatgggcctgtgatgggggaacagccttaaagatatctgaaatagcctcgccaacacagcaagaccccatctctacaaataaaaattaaaagttagctgggtgtgggggcgcgtgtctgtagtaccagctacttgggaggctgaggtaggaggataacttgagtccaaaagttcaaggctgcagtgagctattactgttctactgcactccagcctgggtgacagagcaagaccctgtctctaaaaaaacaaacaattctgaaaagcctttcagatggctgaaagagctgagtgttttaaattatttccttctggtttctctttttaaatgaaataacggtgccaaatacaaagtatttcctcttgagtttggactctgaagccagattgcctgggttcaaatcctggttctaccactttttagtccagtaatcttggggataaattacttaaacctctttgtgtctcagtttcctcatttgtaaaatggggataacagtacctaggggtaagacaggtgtagggctaacaggaatttatgagtaaacggaagtgttaggagagtgcacagtaagagccatgagagtctgcagtgattaccaccatatgtgatatattcttttacactggagacatttatggagcacctacctgtcaggaagacactggaatacatcagtaaacaaaactaaaccccagatttgatggagcttgcattctagtccagggagacaaacactaaatctaacaaatacctaacattgttagaaggtgctaactgctacacgtaaagggtctgaggcaagccagaagtgaggagacggatgcggatagatggggctcgctgagaaggtgaggccgagactgagaaaggtaagagcataagcctcaaagacttctgggaaaggggcacaccagaaccaattgaggcagagagccctgcggtaaggtgatgctggaatggtcaagggtcaagagcccactggggctggagcagcgtgccagaggagagccagtgggcagcagagtcagagaggacaggtgccagactacgaaggctagggacctgccagaactcaggctaactgtgatgttgagcacaggagtggcaggttctgacttggccttctcgaagggatcctctggccactgtgttagaaaggaagggtgggttggggacaccagtgaggagtgactgcagctgtccaggtgagaagcactggctccatgagatgagaagtccaaacaaaaaatgaagcagcctgaccatctcagaaactctgacacccctgcgtgactcatgtatctcatctacacaagttccctgatttgaagatacacgtttctcctactttcacaatttctataattgtgacatgtcttcgaattgctgccaaaactgaaaattgctgtttcaggatctggcagtggattacctacgtgtgtttattttgcagaaatacactgagttgtacttttacgatctgtgcacatagctgtatgtgttgtatttccacacacatgtaaggacaccggggcctaggaaggcagccagttgccaggcagcggactccgacacatctgtcgcttcctcccagtgatgtgactattctctcagtacaactgtttgcatggtactgccacacaaagttgatttataaatctactattgaacaaaatgccttaatagcaattaaactgaatcctaaaatgaaaaagagtttgcaaaaaaactatttgtcatattctaaatgatgcaaatactaagcaataaaattactaatttttttaaagaaattacaaaatgttctaagttgagagatgtttttactgatcccagtgccttgaaagactactattacatctgtcacacttccacaacaagagaagttttagcagcatgtaaatcatttacacaaggatacaactaagaatagtaagccaaacagagaatgaagaaatccctctatttttaaatatgccttggagctgaaaagatcacgggtatgtgttatagaaggcattccttctgtcagtggccaaaatgctacaatcaaaatgttacaatactatgtcatcaaaaagaaatatcctacattaaaaaggatctactccgtctcagcacgaatacattctaagaggaaaagagggcatctggtcagagtatcccccatcctggggcaagttctccgaagtaccaggagaccaagaaccgtgcatacactctgggggtaaatggattgttttgtcactaaatcatgctgaggtaaaggcagctttacacttcctgacatagtaacaaacatatttctaagacaggaaactgtatcaacatccttaaggaaagttcttaggtcttttgtttttatttttttagagacagggtctccctctgtcacccaggctggagtgcagtggtgcaatcacagctcactgcagcctcgacctgctgggctcaagcaatcctcccccatcagccacctgagtagctgagacagcaggcacacaccaccatgcctgttcttttttgctttgtagatatggggtcttgaactgggctcaagaaatcctcccgccttggcctcccaaagtgctgggatttataggtgtgagccactacatccggccaagtcttttcttttcttttttttgagacagagtttcgctcttgttgcccaggctggagtgcaatggcactatctcggctcaatgcaacctccgcctcccgggttcaagcgattctcctgtctcagcctcctgagtagctgggattacaggcgtgcaccaccacacccagctaatttttgtatttttagtagagacggggtttcatcatattggtcaggctggtctcgaactcctgacctcaggtgatccgcccgcctcagcctcccaaagtgctgggattacagacatgagccaccgcacctggcccaagtctgttcttaaaacagactgacaaggtggtaacaacctgccaaaaggtctaacctgcaagattaacataccaagagcagccacgtgtcacttgcgtacaaatacaggagttggatattttcatagaaattcaagctttctgattgctaagcctactcttattcaaaatataggcctgcaataattaatctgaattgctaattaatagttattcattcagaagctgtgtcatcaaaaggcaaaggtggttttttgaaaactgataaaggaagggactaaagttttttggtattaccatctgtaaaggagtttaaaaaaaaaaattctgggccgggtgcagtggctcaagcctgtaatcccaacaccttgggaggccaaggcgggcagatcacttgaggccagagttcgagaccagcttgggcaacatggcgaaaccccatctctacgaaaaatacaaaaattagccaagcatggtggtgcatgcctgtaattccagctactcagaaggctgaggcacaagaatagcttgaacccgggaggcagaggctgcagtgagcagagatcgcactactgcactatagccagcctgagtaacagagtgaggctgactcaaaaaaaaaaaaatcattctgatatagatgttttgctgaattgtacatagagtttagtatgaggatgagttagatttccaatttcagatttccagtttcacactatgattagaaaagacttgctgtgactttgcatctttcttctgaggaggtaatttaacataaacacttctacctaatattacctgtcccttaaacatcatcattcactcacattcctctctcaaacctgctgttgatttatgataaaacacaagaggatcatttcaacagaaaatggtttccaggctgatgtagtgtctccaagggaaaagcaggtacttggctggtcgcacacaggagtaagaactggagtccctgagtgggcttcaggaggggcaaaaagccgctgagaatgatgtttgctatagatgaagtttgtggcgctaacagggaaggtaaagaacctttaaccaaacgacactgttgctgaataccagtggtcagatattttttcttcctcaagaaggagaacccatcgctgtggcccactgccagtggtcactcttcatcataaacaccctcaaaaccctttcaatcccctctcgccttctatcaccttaccttcaaagccaagatcttaggaggaatgtcaccgtctaagttgtgtctaccactcctgtctctcacccactgcaatctggcttttgctcctatcagtcctgggaaatactcttgctaaggtcacaactgacccctcgctttgttaccttactacacttcacttgagtcagcctccctgcctctatctccaccccacactgtcctctggttttcctcccatccctctgaccactccgcgtcctagattccttcctgtttctgatatattgagggaatcgagagtttcatcactgtccctgcctggaactcaggtaaacttaatgcaaagtactgtaatcataactattggtacgatatacttcaaaatcagtagatccttatgacctcaaggtgagaacattcaaaatgaccttgcttgactaggggcaagataaagagtgcttcttctagactcacctacgtctcagtgcctcccacctccaggtgtacgctcatcttgtacctaaggctcacacacaatgtgatcatgcaatcttgcatgctgtgttagggctcctcgaagacgtgtatctcacgctcatctgaacaacctctccatagaaaatgtcttagccatcatgatcacttgcactcagttttgatgaatggatggatactcaaattttatgcaggcagtactagctgcttgcctaccagacacaatgcattgagctggccacagaagggaacagaatgtggagacacagagcatgtttgtgcctgcccaaggatgctcccatccttagagacagggcctaactataagtgggcctgggggtgggctgggggtttaatggggtaatgtaaaagttctaagactacattatggtgatgattacacaactcagtaaatctactaaaaataattcaattgcatactttaaatgggtgagttttacagaatgtaaattatactttaataaagtttttttttttaatgaacagaacacagtaccagaagtttacagtttagtggagaaaacatgtacacaaatttgagtaattctgacaatcatgtcactcattataatatattgttctcatactaaatagggaaaccatttttttttttttctgagacagagtttcactctgctgcctaggctggagtgtggtggcacaatctcggctcactacaagctctgcctcccaggttaacgccattctcctgcctcagcctcccgagtagctgggactacaggcgtgtgccaccacacctggctaattttttgtatttttagtagggacggggtttcaccgtgttagccaggatggtctcgatctcagggaaaccatattcttacagtctaatagagatcacttttttgtgttctttggctaaccctgtaaatagttactagctcagtaagctttttggagagggcaggaagctgtctaataaatacaactaaatagtaccagtggataaatgcaaatctgctcctgaattattcatgtatttctttgggtatctctattgcacgtctcctcctactcaactctgacagaatggctaaactgtaaatagcctggttcctcaaccctgactgctaaatgtattcacttgcccatcataacaactggctgagcactgccacctaatcactaaaccaatgcaaactcctggtcaactatgaagcatgtaactctccacacctttaggtgcactatgaacaatgctaattagaaaacattcatagcaatgcctacaataggtttctaaagatgtctgaatattatgttggactgaaagtcaaccacggagagaacaggaacttgttgaagcaaacaaactcccttaaagatttatactcaagggatatctactttatgtcttatataattttcttcttagactaccaagcgtcttatatttggatatttttaaaaaatcaatgtgcaccgggcacggtggctcatgcctgtaatcccagcactttgggaggccgaggcaggcagatcacctgaggtcacaagttcaagaccagcctgaccgacatggtgaaaccatgtctctactgaaaacacaaaattatccaggtgtgatggcgcatgcctgtaatcccagctactcgggaggctgaggcaggagaatcccttgaacccaggaggcggaggttgcggtgaccaagatcgcaccattgcacaccagcctgggcaacaagagggaaactctgtttcaaaaaaataataataaaaaaataaattaaaaatcaatgtaaaacagaatacataaaaattttacataaataatatatttataaaatataataatttagaaggtgtcttttgtttttttaaaattcttctttgttacaagctggccaggcatggtggctcacgcctgtaatcctagccctttgggaggccaaggcgggaggatcactttgagttcagaagctcgagactagcctgggcaacacagtgagacctcgtctctatttgaaaaaaaaaacaattggattaacaatccaactcctcaattcctacgtgaactgcttataatggggggggaatagatgagatttatggtaatttttattttttacataaaatatttttactttttaaattttatgcaatttataagatcctttgatcaaactgaatttccagtagtagctctctgaagcactttatatatgcatatgcaaatgatgaaaggtaggatttaaaaaccaatgaattctacttccttattctttcattaatcacagctaaaatgtgaaacaaattttctgagtaaaagcttactattcaatttgtgtggtttaaggaacacaagctaccaaaatgtaaagctactcatccgcatataacagattatcaatgatacaataaaaattttgtaatatttgaaaataaattaatctaaatggtatgctgctgttggcagaactgcacacaaaacagacacgcacagaagctagaaaggacatacagtattgacagttaccatacccaggggttgtggtgatgaatggatcccctaccacaactttttgagaaatatctacattttctaatttttgttacaataaacatttttcttaaggaagtatctctgagccttgactgtgattaaaaaatctgtgattaatctcaaaattgaattacctgactcaaaggtgggatggaacttgtctgagaagtggtttgagatataggaccattcatctgtaaaattgaaaacaaagacaacatcagtacaatgtttaaaaagaaacaacatattttcaaaccacagtaattaggcaaaactaaacccaccaagaaatgcacatttcacatgacaaattcatgaattcataagatattcagaatgtaggaggcttaaaatttttaaattctgaatgaacatcatagataaagttctttgtagattcaatggggaaaactaagaaaagctactttgctcaaagccactttggaactttaaatattactgcttgacataaaatgtttaaatgaacaaaagtagtcaaaaaaatgtatattaaaatcctaactctttaaatacatcctactatagtgactataatgttattaaactatttacaaatcactacatatccttgatttaaaaaataaatggatttgagtatctagagctataacaattttgtttttgttatcatctactacttatagtttcctctactaagctacctctacatttttcagactgatggggctcaggactttctccccaaaaaatatggcacattgacatttgaggaaacagcagaatcaggccatggaaactagaaagaattctccttgccccttctcccttgaagcaggccataaaacacagctgacattcccctgaagacccttccagaggggccctgctctgtaccaggagcagtaacacacagggatgtcaagaaaaacctgaacacaacagccttgctaagcttctccagtttattagctctaggtcacatcccttttgtccaatcatgcttctccacaactgtcaacatctgcattagacttcgcaaaaaaaaaatacagttttccctgtttctttggttcttcctttgtggaggctcccatgtcacatacaacttattactaaataaatgtgtatgcttttctcttgttcatctgtcttttgttgcaggggtctcagccatgatcctcagatgggtaagaaatcttttctcccctacgagactctaatatctgtatgcagatcctaagatgtgccagtgttcctgtttagaactccttactaactccaatatagagtcctttatcaaaaaaagcaatggactccccaccaccccattcgacagcacccaccagatgagcgctgtccttgccctcctggactctctgcgtctgcggttcagccacaaccttagcgtcctgatcagaagtcatgggctccactgggagaagtgtaatgctaacctcaggatgctgtaaaatggcaaagacattaaacaggtcatttgaagggcacagtatgattatttaaataaaattaaaatcctcaagttttccaggacacacgtttatccctctgaattcaaaaaagtttaaagaagtcttcccatatgcataccttactcaccaagaagtgatacttaattttttaaataagtaagtttcttcttcacaccattttggtgaagatggccacactctaaaacttggaaactcatgtgctgacacaaataaacccatttgtgcctggaaactcaagtcttttaaaaaacagaaaattgaaggcttaatatccaagatatataaggaactcacaccactcgatagcaaaataaataaataaataaataacctggttaaaaaatgatcaaaggcatgaacaggcatttttcccaagacaacagaaaaatggcaatagaaatacgaaaaggtgctcggcatcactaattattggggaaatgcagaacaaaaccacaatgatatttcacctcacaactgtcagaatgactattatcagtcagacaagagataacagggcgtggaagaaacagaacctttgcacactgttggtgggaatgtaaattggtgcggccattatgaaaacagtatggaagttgctcaaaaatttgaaaatagaactaccatattatcctttctgagtatttatccaaaggcaatgaaatcaccacctcataagaatatctgcactcccatgtggattgcagcattattcacaatagtcaagacatagaaaccacatagttgtccatcaatggacaaacggatatagaaattgggatgtgtgtatctgtctgtctatgctatggaattatgtattattcagcctttaaaaagaaggaaaccccgtcgtatgctataacatgggtgaacctgaaggatattatgccaagtgaaacacaccagcacaaaaacacaaatactgcatgatctcactcatatgtgaaagttactatcttaaaaagtcaaatacatagaaacagagaataaaatggtgactaccgccgggcacagtggctcaagcctataatcccagcagtttgggaggccaaagcaggcagatcacctgaggtcaggagttcgagacctgtctgaccaacatggagaaatccagtctctactaaaaatacaaaattagctgggtgtggtggtgcatgcctgtaatcccagctactataggctgaggcacaagaatcgcttgaacccgggaagcaggggttgcagtgagctgagatagtgccattgcactccagactgggcaacaagagtgaaactccacctcactcacacacacacacacacacaaaatggtgactaccagggggctagcaggtagggaggaaatgaagagatcaatgtcaaagggtaccaagttacagatattttggatgagtaagtctagagatctgatgtacaacatgaggcctatagttgtaatattgtattgtacactcgaaacttgctgagagtatattttaggtgctcttactaacacaaaagaagggtaaaactatatgaaatgatggctatattaatgggctggactccagtaaccatttcactatgtatatcaaaacatcatgctatataccttatgtatacacaattaaaaaaaaaaaaaaggtcagatgtggtggctcatacctataaatcccagcactttgggaggccgaggcggatggatcacctgaggtaaggcgttcgagaccagcctggccaacatggtgaaacctcatctctctaaaaaatttaaaaactagccaggaacggtggcgggcacctgtagtcccagctacttgggaggctgaggcaggagaatcacttcaacctgggaggcagaggttgcagtgagccaagatcatgccactgcactacagcctgggcaacagagtgagactccatcaaaacaataaaaaatacaaaataacagaaaactggcagggtgcagtggctcacacctataattccagcactctgggaggccgaggagggcagatcacttgaggccaggagttcgagaccagcctggccaacactgtgaaaccccaatctactaaaaatacaaaaattagccaggcatggtggcacatgcctgtataatcccagctactcaggaggctgagacactagaatcgcgtgaaccaggaggtggaggttgcagttagctgagatctcgccactgcactcccacctcggcgacagagcaaaactctgtcttaaaaacaaataacaggccaggtgcagtggctcacgcctgtaataccagcactttgggaggccaaggcaggtggatcacctgaggccaggagttcgagaccagcctggccaacatggcgaaaccccatctctactgaaaatacaaaaatgagctgggcctggtggcacatgcctggagtcccagctattcaggaggctgagacactagaattgtttgaacttgagagagacagaggttgcagtgagctgagatcacaccacggcactccagcctgggtgacagagcaagactgtctcaaaaacaaacaaacaaacaaaaaaaaaaaaacacacacacacacacaaacaaaaacccagaaaattacaaagttaataggactccagaaataaaaacagttgttgatgaatgctaaattcagatatatttaagtgtcctcacttaacatcatcaacaggttcttggaaactgacttcaagcgaaaggacgtgaagcaaaatcaattgtaccacaggcacaaacaagtgttaagctcctacagcatatttccagtcacaaaaatatcaccaaacttctaattaaagacccaaaactccttctaatatttaaaatggcaataaatatgagccacacacatttttaaaagattaacaagaaagacaattacgtacctaattttgggtgagtcagaaagtgacagtggtcatagtggtggtataaccaccactggatttaaccaatcaaggaataaatgtttgcaaagtgaaaactgtaagaatattacggcagggcgcagtggctcgcgcctataatcccgcactttgggaggctaaggcaagcagaatgcttgagcccaagagttggagaccagcatggacaacatggcgacactcatctctacacaaaatacaaaaattagccgggtgtggtggcacgtgcctgtagtcccagctccttcggaggctgggataggaggaccacctgagcccaggaggtggaggtttcagtaagccgagatcgcaccactgcactccatcctagggaacagaataagatcctgtctcaaaaaataaaaacaaaaataaaaaaagaatattcctaccaccaagtagttaaaaaacaaactatgataaccaatagggcaggctcactgagcactatttgttgtgcatttatattattatagtagactttatgaatttttgtttcacaacaatttatattgattcattcatttctcaacctgcttattccagttcagggtaacaggtggccacagcctatcccagcagctcaaggagcaaggtgggaaccatccccgagaggacaccatcccatcacagggccgctcacacacacacccacactcactcactcagactgggaccaggaagacatgcaaatccaccgaacatgcacacctttgggatgtgggaagaaactggaatacccgtaagaaaacacgcagacatggagagaacgtgccaactccacacagacagtggtcctggccaggaactgacttctttctcatcatgttgaaatgacattgaaagaaatgatgtttttcaaagtggttcttcatgaagcatttactcaatccaatgtctagacactaaacttcacatgtaacatctcactcaattttcccaaacaacgtaagaagtaactggctcaccaacactttgggaggctgaggcgggcggatcacctgaggtcaggagttcaagaccagaccggccaaagtggtgaaaccccatctctactaaaaattagccaggtgtggtggcgggtgcctgtaatcccagctactcaggaggctgaggcaggagaatcacttgaacccatgaggcagaggttgcagtgagccgagatcgcccctaaacatactctagcctaagcgacagagtgaaactctctcaaaaggatcagaagggataactgtaacaatcccgtatcctgaggattcctagacatccaggtctgacttcaaggcatttctttttactgcaagctacactgcttcccaaacaagataaatattgttatttaacccaggtatctttttaggtacatctgaaaacatacatcagactgtcagaaaaaatacctttaaaagtgtaactatttttgtcttactaggtagccatacaggtttttcatggtatagtggagctccctattcgcaataatctgcttgtgataaattctcaaaaaccttgttaatgaaataatctgatgatcaaaggcaatctcatccaattgtgtaaactgtatcatcaatcacaaaaacatctaaatgctatcaaaaagagctggaaataaatgtaagctagcagagaaaaaatgcttgaaataaatacgggatgtatgacaaatgttacactttaacagatatatttcattttaatgtatatgtatcttctttttatgtctgtgtagtaccaacgtcttcttattaaacaaagaaaagagtgaatcaatttaaataaatatattaagtactagtataaatgctatcgggactcaaaaagatcttgaaaacagaatgtgagtaactaacttgtagaagacacagatttcgggaacatctggactgagattctaggtccttggttctcaggcctcggatgcaatgaagaatccctggagcaaattgtgattttgcaattttgtagtttggacttttttattattattattattatttttaactatgtagatgattctgaaaaacctgagcaaatacttccaggtgatgttgaagtaacacacgaggggagtagctcccactccctgagggggttttctacgagagaacagatggattccattgtaaaagaaacctacatgtcattaaacatcaattcccacacaaccacgaaatccagaaactaaagacatattaatagtttagcaatcaaatgggcaagtcatagaaggcgctgtggatgcttttgccaacattaatttccagatttttaagattcttatgatagccaaagggaaaaataaaaatcaactaaaataacactttatttaatacctgtatttttttagacaattggaatttatatacctcctgacggaaataccaacaataccatatatgaagtggtcttgcaaaaaaaaaaaagataacaaaaaccaacatgtgatcatgaccctaaatcttattacgaactaaccgcaaatacaagagccaggggaccaccaagggattccacacagtggaaagtttcggaactggcttcttcaacacaaaaggagacgtaagacacacgctggtcagtcagactatggctttacttggataaaggaaacaaaccaactactaaaaaagaaaaacgataatcagagaaacaacagtaaaaggacaactgataatactaaaaaatgattctagtttctcagatgtgataacgatgtggttatgtttaataaaaaggaaaccctatcttttagagatgtatattgaaatatttacagggaaaataatacaatgtgtgaaatcttcctcaaagtactatgtggggcagagaccctgaggttcatcgttattcttccacctgagagaaggaagttcactatactattctgtctacctttgtacatttgaaattttctataataaaaggttaaaaaagtaaccatgccacagtctcagcacaacacagtgatcccgatttgaacactctgcatcctacctattaaaaaaagtaacctttacaccaatatatctcttaattactaatctgacagtttttcaaaaaaggcttataaagttttccaacagaagggattactgatagtcacctcatttaaacagttaataacgtatcattttaatgcttttttaacttacctaatgtgtgaatctaaaatgagatttaaagaatgatacaagtattgacagctgtttcaataaataacaaatattttgttactggttcaagagacctaaaatattttgagatttaaaatatatcaactattgcctcccggcatggcctaaaagcagatctctagattgtaaagggaaatattcaatgggagaaaagaatcctccagccaaagcaaagtacttccacacagccgaccaaggagttgaaggcgggctccgcactcgccagtgccttacaccactcgcaggccttactgaattggacaggaggattttatttaatgtctctttatgtaaaaagcagagaggataagtccaagtgttctcccttcctatctgtggcctctatgctagtaacacatttttaacctcatctgtcaaagctacagtctaaaaaagaagttttatcaaccttgttcaacacttgggagaccataactctcttaaatcagtttctaaaaatttcttttcatgtacaccagaaatgtttattgcatgattaaacagttattatggtctttctagacacacaagacaatcttaaaaatacaacaccatctcaaataaacaactatatgtcaggttggtgacataatgatttagagaaaaattatcgttaatttttttttttttgagatagagtatcgctctgttgcgcaggctggagtgcagtggcgcgatctcagctcactgcaagctccacctcccaggttcatgccattctcctgcctcagcctcccgagtagctgggactacaggcgccggccaccacacccagctaattttttgtattgttagtagagacggggtttcaccgtgttagccaggatggtctcgatctcctgaccttgtgatccacccacctcggcctcccaaagtgctgggattacaggcgtgagccaccgcgcccggcaaaattattgttaatttaaaggacagctatttacgcagaaaaccctacaaattcaccaagagaaatttttttttttttttttttttttttaaatacagagtcttgctctgtcacccaggctggagtgcaatggcacaatctcagctcactgcaacctctgcctcccgggctcaggcaattctcatgcctcagcctcctgaatagctgggattacaggtgtgcaacaccatacccttttttttcttttttttttcccagtagagacgggattttgtcatgttggtcaggctggtcttgaagtcctgacctcatgtgatccacccccctcggcctcccaaagtgctgggattacaggagtgagccactactgtgcctggccacaccaagaaatcttaaaatgtactcagtaggcttgttctttgaggtaaatgttggtattattattttgaagctattttattttacatattgtatatatacatgcctacacatattcacactgaacaggataaagttgataagaatttccttaatgttaggtacacagattttcaacataaaaggagatatgaatacaaaattaaagaagctaagtaaactccacgtggtcattttttaaaattggaagtgtaactttttaaactacagtacaggcttcctttgcaatacaccactattaccactgatatccttttcctattctgggctctgatcttggacctcatgctgtacttagctgtccttccgttgagtctcctttaaactgcagcagttcctcagtcttgccttattcatctacgcttttccagagcactagttaattactttgtagaatgttcctcaatttgagatgagcctgggacatcttaccatgaagcaggaagccatgaagacaactggtcccatcaggaagacacagaggccacagcaaactaagggagggattcccaatagccatgcacggagccacatcaggatcaggaagaatgaacggaaaacaagtcggcagcaatcatgagagctaccaccaccacagtgctcgccttgggactacaggacacccacttattattcccaagatcactaaaggacaacagttatttcaagctgctgttcctcgatgaactgcatttctgaataaccaaaaagctgatcagggcaagaaccacagtcaatggggagtgaatgacaggatcggaaaaatcaaaatatcccaatatctaatacaataataaagtcaataatcattgatgtctgctgaaattatcaagtgaagaacgtgatgggaggtttccaaatggttaagtgagacattgactgaagctatttttcagtattatcattaaaactgggcctctaggcattttatttttgacatgatcaaagactaccatccacaaagtagtcgtgccaaaaaaagagcctgtatttaatcatacctctagatcttactcccaatttaaagggaattctagggaaatacatgttaaatcacaccagcacaaagccatcatctaaatccaaaatgtaggcaagaaagacgacctcatttctatagcaaataaaagatatttaaaaggagagctatttttattgccacagaattaaaaagccttaaccaaaataatccaatgtgatgtaagaactgtgtttggatcctgagtcaaataaattaggtttaaaatgacatagaaaaacttttaaggttgcctaggtaataaagacagagaaaactttttgacatagaaaaacttttaaggttgcctaggtaataaagacatgataaaattactattaattttattgagttccaaccatagtattgttatatttattttaaaagatcttctttataacagctagaaactaaaagactcatgaataaagatatatgtctggaatttgctttagaatatgccaatttttttggtaagtttaagggaagagaagaaacaaaaatatatgaatggtggcaagctgatggtagctaaagctagatgactggtgaactgaggatcactatagtatcctctctacttctatgtgtttaaaactgtccacaataagccaggcacggtggctcacatctgtaatcccagcactttgggaggccaaggcgggcggactgcctgagctcaggagtttgcgaccagcctcgggcaacacagtgaaaccctgtctctactaaaatacaaaaaattagctgcgcatggcggcgtgtgcctgtagtcccagctactcgagaggctaaggcaggagaactgcctgaatccgggaggcagaggttgcagtgagccaagatcgcgccactccactccagcctgggcaacagagtgagactcagtctcaaaaaataaaataaaataacgtaaaataaaataaaataaaaaataaataaaattgtccacaataataagtaaaagaaaacctaacttggatatattatcagtacacacttaagacttcatatgcttatttctatttaaaatttgtattaatgaaataatactaaatgtgtaaacaaatttattaacaatgttcacagcagcttagaaaaaaaaaaatcccatggaaataaaaacgcagaaagtaggctcatgcctgtaatcccaacactttgggagacaaggtagggagatcacatgaagtcagttcaagtccaacctgcctaaccaggctggtgaaaccatgtgtctactaaaataaatacaaaaattcccagctactcgggaggctgaagcatgagaatcacttgaatccaggaggtggagattgcagtgagctgaaagcgcaccactatactccagcctgggcaacagagcaagagtccatctcaaaaaaaaaaaaaaagaaaagaaaagtagaaacgaatgcagtatgttacaattacttaaaatactcacaaaaactgcataaagatttaaaaaaaagacaaaactgtagatactaaagttgcaatatatttataaaaattcaaattttataagtacgtaaaaacaagaaactagaagaaaatatgccaaaagactaacaatgtgtgattaacttattgacttcatctcccagagtctcagttttttaaataacatattatttttattacacgtcttcataaaacatccagcttgctgattccatcagttgctgagtccaaggtcccctgccatctttcccacagaaagggcactgctgcccacgcaggagaagctgcccatgcaggagaagcatctaagtcactttgcagttgtttttcaatacagattaatcaagtgcaattcagtgagcaaattttcttgtgaaactacactgctcagtcctgttcactaagataatggttctcaatgtgtggtgtaggcatagtccagagtcccagaaacacttccagtggggccacaaagtcaaaccattctcaaaataatgcaaagatgttctttgcttttttcactcttattctctcctcacaaaaccacagtggagttttggtatagcatcaaagaatattcaatattcatttatatgaaatgactaccaaaataataaaataaattacctgaggccagatttccttcacacacttcaaccaaaataacacagtactaagagatgaaatgcaaaagcagacaagaatccagccaagattctattaagtcagacattaaagagatttacaaaacatgaaaaaacaatgccactcttcccactgaattattttttgttttggaaaatactactacctttcataaacaatgttatttatattacctaatgggtttgttattattaaaaatgtatatttataatattaattgattcttgatacttaacatagtaaatacagacagagataaaccacagatggagacaaaccatataataaactcaagcttttaggcatcttcagtaatgtttaacagcataaagacgtccttagaccaaaagcttgagaaccactccactaatacaaacccttaaaacccagttctcaaggacagatgcccatgttcatggatggaaagacatccatgtttatgaagaggaagacatcccatgtttacagatgggaagacatggtatttttacaatgccaacaaaccccaaattaagctacagattcaatataatccctatcaaaattcacttttgtgggagaattttttttttttttttttttggcagaaattgctgagctgatcctaaaattcctatggaaatgcaagggacccagaatagccaaagcaatcttgagaaagaataaaattgaaagacacacacacttcctaatttcaaatcttactacaaagctacagtaatcaagccagcatggtactggcatagaccagacaaacagatcaatacaatagaaacgagagtccagaaagaaaccgttacatttatagacaactgattttccacaaaggtgtcaagaccagttgaggggaaaagaacaatcttgtcaacaaatggtgctgggacaactaaatgtcaacatgaaaataatgaagctgggctcctacctcaacatacacaaaaattaaggcaaaatgaaccaaagaactaaatgtaaaagctaaaactatatgacttggaagaaaacagcagtaaatcttcataaacttgtattaggcaatggtttattaattatgacactaaaagtataaacaggaagaaaaaaatacactggatttcatcaaaacgaaaaacttttgcccctcaaagcacactatcaagaaagtgaaaagataacccaaagaatgcgaaaaaacatttgcaaatcatatatccaatacggaacatatatctagaatatataaacaattcctaaaacttataatgagacaaataacccaacttaaaaattggcaaatgagagcccagcgcagtggctcacatctgtaatcccagcactttccgaggccgaagcaggcagattatttgaggtcaggagttcgagaccagcctggccaacatggtgagaccctgtctctacttaaaatgcaaaagttaggcaggcatggtagtgggcgcctataatctcagttacttgggaggctgaggcaagagaatcacttgaacctgggaggcggaggttgcagtgagccaagatcacgccactgcactccagcctgggcgacaaagcgaggctccatctcaaaaaaaaaaaaaaaaaaaaaaaaaaatggcaaatgatccgaacgaacattttcccaaagaagatatacaaatggccaccaagcacatgaaaagatcgtccacatcattcgtcatgagggaaatacaaatcaaaacacaaaataccactttgaaatgaaattaaataaaatgaagtaaatacagaaaattaaaacaaaaatactactttgcatccacttggatgactattatcagaaagataggtaatatcaagtgtggctagtacatacagaaactacaatcttcacacactgctggtacaaatgtaaaacagagcagccattataggaagcagtctggcagtttctcaatatgttaaacaccgagttaccatatgatctagtcattctactcctagggatatatcccagataactgaaaacatgtatctgcctgaaaacctgtatgtgaattttcaaagcaacattattcgtaatagccaagaagtagaaacaacccaaataataaactactaggttaagaccctcccttttttatgtgtgtctggcataactcattggattttcaaataatagcaaaaatcataatttcagaacttgataatttctaagaaaatcaaaataaagaggcatttcctaaacagcaggtaattcttttctggtacgaaagggtaatgtgaaaacacaaattatttgtctctgaatcagaaacctggaaagaaaaagaatgagtttggtaaggattattctaagtgctttctccacgttaccaaataaacttaattctgttaattaggttccatgcctatttagcacagcaggaaattaagatcagggataatttaaggtcacaaagctactaagttcagtgaggctatattaatgcacatataattttgctattcaactatatgtgcctggagatcatttaacaggcaattcactctatcaatccctgcatgtgggtgaatgtcacatcgtaacatgacctcagagaagtgcacctacagtttccttagctcgtcttcattccttcttcccttttacagtaatattcactgcaccaatgtacagatcatgattttagcatgtaaagataagcatcttttttcttacaatatggtacttaaatataagctaaatatttctctttttatacaacaaaaacagtgatttgattcaatgccagactaaaactggtattggatcaattgtatcagtgataatattaaatacattgtaccttacacggggatcttcaagtatattgatgatttttgcattatgggttgaccttagaacagacatttcccatgagagtgtgctgtatgggagccaaatataaaacctctctcctgaatctaaaaacattattctgaagtcaggaactccctactcacaacagattactccctgttctatttgccatgttctgcacattctattgccttttcctggaacacaggtatccctgtgttttatcttctatctacacacagtgatactgagaacaggacagaaatacatatcccaccaatgatatattacaacttaccttgatcttcttccttttgttagtaacattcaaatatatgcagttttactacagtgttgtctaagtactccatttctttatttgtaaagtttgctaagttaccttctaactctaattgtctatgattaggaacaatgagttaagggatgacgcatgaacagagatggacagcacaagatgctcctagacagacatgtgttccaagaactccaacataattttattttacagaccattttacaaaaatcagtaaatgaatattcaactagataagtaaacagaaatttacctaaataaggaaaaagggctaagaactttagagattgccttaattaagtactatataatctccttgggaatcaattagaaaaaatcaaaatgtgttactttcaatgtccaaacaaaatttgtagaaaacagtttaccacccagactttgatccctttgaagctacataaattgatcagaaaaaaaaaaaaatgatcacagaagctaaatcaaatcatcagaagcacaatcatggccaggcacagtggctcacgcctataatcccaccactttgggaggccgaggcgggtggatcatctgaggtcaggagtttgagacaagcctggccaacatgatgaaaccccgtctctcctaaaaaatacaaaacttagccaggaatggtggcatgcgcctgtaatctcagctactggggaggctgaggcaggagaattgcttgaacctgggagaagaaggttgcagtgagccaagatcgcaccattgcactccagcctggcaacaagaacaaaactccatctcaaaaaataaaaataaaaaaatgataataataaaaagcacagtcatagcattctaggatcggaaagaaggatgtctttttttttttttttttttttttttttttttttgaggtagggtctcactttttcacccatgctggagtgcagtggcccgatctcaattcattgcagcctcgaccttctgggtccaagtgatcctcctgcttcagctccccaggtagctggaactacaggagcatgccacaaagcccagctaaaaaaggatatatttcctttttttttttttttttgtgagaagcagtctcactctgttgcccaggctggagtgcagtggcacaatctcagctcactgtaacccctgcctcccgagttcaagcgattctcctgcctcagcctctcgagtagctgggactacaggtgcacgccaccacgcttggctaatttttgtatgtttagagagacgatgtttcaccacactggccaggctggtctcgaactcctgacctcatgatctgcctgcctcagcctcccaaagtgctgggattacaggtgtgagccaccagcgcctggcctctttttttttttttttttgagacggagtcttgctctttttgcccaggctggagtgcaatggcacaatctcggctaactgcaacctctgcctcctgggttcaagcgattctcctgcttcagcctcatgagtagctgggattacaggcacctgccaccacgcccggctaattttttgtattgttagtagagacgaggtttcaccatgttggcctggtttcgaactcctgacctcctgatccacccgcctcggcctcccaaagtgctgggattacaggagtgagccaccgcacccagcagaaggatatatttcttaacagaaattttcattatgattcccacgtgcatatctaaatagagaagtgcagaaaataaaatacaataggaattctagttcctcatccatctgccttgtgctgttagttggatgatatggtttatctcacggctgccagcaccactctgtaatatttgaaatgcacatttttatcttacaatagaataatgtgagagcaccttagggcagattattttatgttccttccatgtaccttatacacatcatatactcaagtgaatctgtaagcttgaatagtgggaacatttacagagcaacagactgctgcttccaacaaaactgttattttagtcttttgtttttttcaagattcagtatctctatgatattccattcttttcgtttcatgttcttatagtaagtgtgtcactcaaagatactgacggataaaagaaatgcgtccaatctcagtagagtagttgtttatacatttaaactggcactcagcactggagtattcctaaggagatgttgccaataaatttcaagactaattttgtaaaatgtcctttatatgtgtacatcggtgcttctactgaaaaaaacagcagtgagaaaatgtgagttttatttatagtttgagttggttctcctcctaaggaggacataatcagacacaagatacaaaaacttatttgttagcaagatctgattgaaaaagtacctacatgagaagaccaccaaataatatactttcaaaatcttcctgattttaaatttagaacgtgtctactaagtcgacacacaaaaaaaggacaacggtcccctccaccgttaaagcctgtgactgggtctacgacattatcttctggagagtacaatcttttgaaaagaccattttagctaggattcttactaaaacataatacaaaacaaccaccgaaactggagtttagatcatctcattaaccctctggctaggagagcattttactcattaaacctttgacgaactcaaaaaccaccactctaatacttggttgtaaagaagctgaaataaagtatctgaaccaaatgcacagaacattgttttgcacaagccctaagctgcagcagtgcgaatcatggccctcggagtaccacttcttgcttttatcccgtgctacacctttcccagtaaagagcttcttaggaagggtttccacaccttttcacacactttcacaaagggaaaagcaaatggaaaagttgacaactacattaggagtatctttttaggacacaagcttagctaattcacacagcttcctttgtcaaatactggactaccaagaagcatcaaaaccaaaatctgcagtctaagcagggcacagctgcagcacgttcacttcatttaacctcaagttgaagcagaaacataaaatcttttttttttttttttttaattttgagatagagtctcactctgttgcccaggctggagcgcaatggtgccatctcagctcactgcaacctccacatcccaggttcaagtgattctcctgcctcagtctcccaagtacctaggattgcaggtgtgcaccaccacactcagctagtttttgtatttttagtagagacagggtttcaccatattggccaggctggtctcaacctgacctcaagtgatcccgcccacctcggcctcgaaaagtgctgggattaccggtgtgagccacggtgcctggcataaaatctttttaatacagatgttaaattacctggttgaaaagctagttgtctcttttgtctagtctgtttagaatatattctaacctccatttttctgtccatcagcattttattccattagaaattacttctcatgttgagaatgtcaacctggacaaacaagattcaacctaacctggcaggatgtgtgctggatgcccaggaagcctctcctgacttgcaagcgtcccctacttccactcttccacatccttcagacccacctgctcactgctgcactcaggctcacttatgccatctctcagccatggactgatctcgcagatggcaaacaaagtatacccagagtccagaggaggaaaaggcaacttcctgttgatgtttcacatgcaatcttaccttttggacaaagagcagaactgcctgattcaatcttttataatttacttttaccttaaggaattgcatatataaacttatcttactgcacggctttaattccattttgaatatgtattttcttgagattattgatagtctccataaaaatctttgcttcctctcatttacatctgaaaacaaaacaaaacaaaaatgctgatggacaaacgtagtagcatgggcatacacctgaactgaggaaaagccagaattggcagcacagcacacagggccttcctcgtcaggaatgcaccttgtagagtacaccgcttcactctgatgggtggaaaaggtctctctccacctcatttccagtggatcctgcatttcttcaaggaatacagatcatgttctattgagctttccaattcatcatcacaaaactacagttttcaattgaaaatacataatactcaaagagtaagatggggaagtggtgagtaaactcattttttagaatggcaaaatgtcagagctgggaagcagctcggagctgctttaatcctgtgcggctcaaatgggaaggcatatttgtccctaacaatgagtcagagaaccatgaaatgatacataaattgattttgttaaaaaaaaaccttgacacgcaacactgacagaatacaagctgagcagcactaatctgaaaatctgaaatctgaaatcctccaaaatctaaaactttttgagcaccaacatgacatcacaagtgaaaaattctgatgtttcttctcacctacgaaaattaaacacaatccaagcacaatgatgcatacctgcagtcctagctacttaggaagctgaggctaaaggattacttgagctcaggagttcaaaaccaatatgggcagcatagcgacactctgtcccctaaaagataaataaaataggccgggtgcagtggctcacacctgtaatcccagcactttgggaggccaagaaagggagatcacttgagctcaggagtttgagaccagcctgggcaacacagtgaaaccctgtctctataaaaaatacaaaaattagtcaagtgtggtgacatgtgcctgtagtcccaggaacttgggaggctaaattaagaggctcacttgagcctggggggcggagggttgggggggcattaagccgagatcatgccactgcactccagcctgggcaacagaggaagactgtctcaaaataaaaataaaaataaaaataaaataaaaataaataaataaaatgaaataaaataaaaatacataaaacacagtgtacagtgaccttttaatcacaacacagcatcataggtggacactgaaaagtctgctgctgctgttatctgacggctgatccaggtactgtggcgatgtcactgggctggttagttacccgagcacatcatttcctcactgtattaatgctatgtcatgttctttactgctgagtactcccatgcgagcaagggtaagaagatgactgccacttggtagcatataaatccagaaccaggcacgatggtggcattaagcaaccagactgtccacatgggtggctgggatggtgacatctttgctttctgatggttcaatgtacagacctcatttcacgctaaatttatttaaaacattgtataaaagtaccttcaggctatgtgtataaggtgtatacaaaacaattctgtgtttagactcggatcccatccccaagatacctcattatgtatatgcaaatatcccaaactccaaaaataactgaaatataaaacacttctggcctcaagcatttcaaataagggatactcaatctatagttataaaaatgtcttcctcaagttattaatacagccctggaggcactccctaaagtcttattatctgaacctgcaaattaccttccttaataattaaatgccatttaacagtgttataagtggtgataaaatacaccttattttacacatgcattaatgtgaagtcctcctttcttgaatttaatattcctaatatatacgtatttcttagcatttcagtgaaagggaaatattccataacaattataatcctatatagctcttgaaaatcacacctcagaagtcaagacaaggaatctaaatagagcagacataaaacacttgaccgaagtcaggatcctatcttcattagtccctccatgcccagtctagatcccatttactcctgtctttgcaattatgtttttttccattatgttcaatccttccctgtcactgtttcaacagcttattctgtcgcaaaaaaaagaaagtgaacgtggggaggggaggagctgaggagcaagggaggagctgaggagcaagggaggagctgaggagcagggaaggagggcagaatcagcaggactggacgtcctcctggcctcctgctgaagaggcagctctcaactgtttctatctccaacctcccagaaaactttccttctacaagaaccagcctcctgcttgctggtggacagggaggacctctcacagcacagtggaacagaccagcctttcccttgaagcccactctaccctcttccacttcgtcacctgctttctcagcctcttgggaatgctcttctgcactaagtagggcaaaagctctcttgccctgtgcaatcaaaagaaatagtaaatcaaatgggcaatcataaagatgaatacataaatctttagctattttatacatcttcattcacacgggcctttttctgagacttggtcaattagatattatttctttcccacataaactatatccataatgcatcaacaaagatcttcattgttttttaaagtgcagctgagagacaggaaaaccctctgaatagtacaatgcttctatgactcttcttcagtttttatccttattttcatatctaattcatcagcagtttctctgtgatttgtttttgagatactccaaagttttcaaatgagtaactgcttttacactattttgatcaatttatattaattaaatcacacagctgcacgaatgagtatgatcgatgaacaagtttggaagctgacctggctttggtaagcacacaactccactggtgggaagagggaacagccctgctgaagagaagcccagcgccagtgtggtgcaacccacaggtatgcatggatccacagacagcgttgatcctggtgacaggccacggtatgtgtgcaaaggagtctacctccttgtctccttgagttatgctcctgtgctcccagtttctcatggcttctgttcacaaccatatgctcagtttcagcacaaaattatctaagtgaatgcccagtgaacaccttatgatcctgcagagttctcaaaatcaattccctacttctcatttaaaacaaatacgaactgataaccaatctctcttattgaaggacatatcattgactcaggtgcccaaggcagaaacttgcaaatacagctttaacttctgctcaagtttctatccctgtcatgaaactgtgcagaaaaccaccaactgaactgaattaccacccagtttcttaaagcatctcccttcttcccacctccccaaactccacagattcttccagactgccctccctaaagcgagggactcgcaactgaaaccttctgacaggctgcaccaggataaagtgaaaagaaccacagctactgagatgctctccccatcctcccacaaagccttggttggttattctatgtactcctgcaaacctttacacccaggaatacagcatatcaaattatcatcctcactccaacacaaaagttttatcactcggaggtcagaaatatgtctaccctgttcactgttgtatccctaacacagtacctaaacgagtaaaatctcagtaaatacattaataatttattatcttgtggcaacaaatgtgggaaaaattaactagcatttaaaatatgaagcccagaaaatgggatgagtccaaagaacggcctctgctggtgcacattccaagtggtgtaataagggaaaaggcaatattcacagctgagggcaaaattactttgagttaattttcattttcattttattttattctctagactttgtatatgcatacatgcatgtccgtttaagtgtgcacctgggatctaaacatacaaaggagttaaatacaaagtgatgactaaaaatttttattgtattatcaaaacaaatcactaaagaagttccgaagtggcaaacacatactgaaacaattatttgtattgggggatgtgagatcgtgaaatatatatatttggttttcctcccatttcatggcatagaattcttaaaatccctggaatctcccaagtaataaatgtctttttgtatactaatgatatgactgggctggcagtcctaaggtgttttcaggatgggaactagtcaccagaaagaccgaggcagaattagactgttgggactttcagcccactcccaatctccaggtaggggaaagtggcagaaggttgatcatcaatggccaatgatttcagcaatcatgcctatgtaacggagtttccacaaaaaccctaggctgggtgcggtggctcacgcctgtaatcctagcactttgggaggccgaggcaggtgcatcacctgaggttaggagttcaagaccagcctggccaacatggtgaaaccccatctctactaaaaatacaaaaattagctgggcctggtggcgggcacctgtaatcccagctacttgggaggctgaggcaggagaaatcacttgaacacgtgaggtggaggttgcagtgagcctgagccaagatcatgccactgcactccagcctgggtgacagagcaagactccgacccaacaacaacagaaaaaggactcggtttggggagcttccagatagctgaacacatggaggttgttaaagagtggcagcccaaagagggcatgggagccccttgcccttcccccacaccttgccccacacatctcgtcatctgcatcctttgtaatatccttcaaaataaaccaggaaacatgttttccttacttgtgtgagtctgtcaagcaaagtaatggaacccaaagagggggccatggggatcctaggaagcatgggtaaacaacctgtggcgtgggagtggcatcagaaggggcagtcttgtagggatgagccctcattctgtgggacctgacactatctccaggtagagtgttgagactgaaggggagggtgccccactggtgtctgctgtaaaactgattggttgctggtggggagaaatccccgcacatttcttggtgaccagcggtcacagaattcttctgggttgattgttgtgacgcgaaagcaggagaaaaaccgctttttcttcaggagggaaaggtcaaaaaatcctttccaaaatatactgaaagctatgaaacagaattcagaagttccaggactcctccaagttcatctacaaacaagaaaaggaaacgtcaaggagtgcaggctgcagcacggggggggcctcccttgccaggtggtgaggggccgacccacctctcctcctttgggggacacctgaaacagatagcacaatgcctggcacacagcatgtgttacacaccacagccaaacggcaggcgtgggagctatgaaattccaagttgcggccaggcgcggtggctcatgcctgtaatcccagcactttgggaggctgaggcgggcagatcacaaggtcaggagatcaagatcatcctggctaacacggtgaaaccccgtctctactaacaatacaaaaaattagccgggcatggtggtgggcacttgtagtcccagctactcgggaggctgaggcaggagaatggcgtgaacccgggaggtggagcttgcggtgagccgagatcgcgccactgcaatccagcctgggcgacagagcacgactccgtctcaaaaaaaaaaaaaaaaaaaggaaattccaagttgctcagagagtcaatgtcactgactccaagcacagaatccaacaacaatcttcaaatattaggcattacacctgcagaccagaattgtttcccagaaacaatgcaaactgtttaatattaaaatatagtgaatgtcccctaaaattgttacttacaaaagtactttttacaaaagagaccgggctctgtggctcatgcctgtaatcctggcactttggggggccaaggcaggtggatcacctgagggcacgagtttgagaccagcctggccaacatggtgaaacctcgtctctactaaaagtacaaaaatttggcaggcatggtggcaggagcctgtaatcccagctactcgggaggctgaggctggaaaatcacttcaacctgggaagcggaggttgcagtgagctgagatcgcgccactgcactccagcctgggtaacaagaataaaactccatctctaaaaaaaaaaagaatttaagttccaagattttttttttaatcttactttggtttactattccaaatgacaattacctaagacatagcagtaccatctccatcctataaacaaattggattacaattacaggccagttatggttatatgcctacttcaatagacaatgtgactgagaaaagaaaaacagcttagtgcagttgagctatgtgaggtatgcaggcccagagagccgtgagtgtgggacttctgtcatgcctcccgccccagatccatgctgagcagaattgtttagtcattttgttcctgactggctgccttacccttatcttcatgttcctgaaatctatgacaacgatgaacaatgtacagccaatcaatagcttatgttattttgatgtacattttttgtaaacaactcaggaactgccttttttccctttaaaaatctacttccaacttctgctaatggggtgtatactcagagcaacctgaatccatacacctgggctgcaatcctcaggcttggcccaaatcaactctctacttatattaattttgcctcagcttcttccttttaggctgacatacgtgatgtaagacagcaggattcagaatgtctcccctcaatcacctggtttttctgagagtggcgctgggaaccagtgtgacactctccatcttcagaggtctcatgtggtgttttgtgtgaggtctcctgaaattggaactcccattctttggctgaacatctagattttacttggactgtttttcaaactccctctttcctttaagagtgagggctttgctgtctttggacaagagactggggtgaagagttccgcagacaactgccttctttctgcctctgcctcagggccaggattttgggtcaaggtttttccacctctgctcatggcagaggtttgggataaaggactggcagatactggtggttacgttttatagagcatgcttttaagattgcagctgttttctatcatttgaaaatctgggcttagcctttcatttgtgaccaactcctgttagtttcctactgaaaagcacacagcccttttgctcctccagatgggtgtgagggtctggtcccccgtaccctgcttgagcactcccgtcccctggcagttagggacagtccaagtcacatcacacttagaccctaaacacattcccagccatttgtcacttttcagaagttagtaaattatacaaaattggactttacaatctgagcagtctttgtggaaacatcagctggatgtgtgtgcacttagggggcactctcttacatttagaaagtggagccgcctaacacaggacagttgtgagcagcagtagccaaaatgagcatcctttaagtgtctaaaataattaatctgtgtacctaattgggggaaaagttggctttagaaccagagaaactaaatgggaaacgtactttatgtttgtgctgaaatctgatgataagatttgaaaacattctttttcagagttctacggtcagaagtataaaaagctgatactttggctattgtttttttggaaggaaaaaaaaagcctttctgctttttcctcttttggatcctgtttctgggaactcttttcagtcaactgaaactcaccttaaaatgtgtttgatccctgtttgcttcctgtcttgttggtatgatttttgtggaggaaaatacaaaacttaatttgcctgtcagaaagcttaagatcttcctaaaatggttcctctgagacttgttctgtttccttccacacttctactccttctttttgccatatttgatacatgaagaaatctagaggacacttctaatgactctgagacccgcttcggaacacaggaagaggcaacactcacccccttctggaagggtcttctgttttcagtacggagtctgaagagttgtgagtagtttcctctcaggtctaaagctctgctcccttttgcattgcgctgtccaatttcgtggttttcgggggctttcgggattactttacactgtgagagagaccctgacttttgtgtgtgcaatggcggacaagtcactggtgaaagctgcagtttgggaagtggctgactgaatagttgttactgcaggatggctactgtttctttacacatttagacagatgcagtttgaacacttggaggttaggagagtgctcaccaccaagtgataagattcccatatgggatgggctggtcacagtgggctgactgggccactcaccaaccttgagggaatgtccttgcagtgagaagcactgtggaagctctgcgtggcaggtgttatggcgtttccctcctttgggggacccaagattcagtctattaataaaagtggaatccttgatttttaaagatgtagatcaagggtgtccaatctttggcttccctgggccacactgatcttgggccacacataaaatacactaacactaatgacagctgatgagatgcttaaaaaagagagagagaaaagaaaagaaaaaaaaatcgcaaaaaaaaaaaatcttcatactgttttaagaacatttacaaatttgtgttgggccgcattcaaagccatcccaggccgagggtaggacaggcttgatctagatgctctgcctttcatctgtgcctgcttttcaaatttaagtattaggccctagaaactgcaaatgttttctttttccactcattaaagtcagtaatctaaccaagaaacatctaggttggaagaccacctatctaaccagactgctctccaatatatgacgttctatggccgagcgcattggctcacacctgtaatctcagcactttgggaggctgaggcgggcagatcccttgagctcaagaggtcaaaaccagcctgggcaacatggagaaacctcgtcttgacaaaaaaaaaaaaaaaaaattcaaaaaaaaaaattagcggggcatggtggcgtgcgcctgtggtcccagctactcgggaggcatcacttgagcctgggaggcagaggttgcagaggtcactgcactccaacctgaatggcagtgagaccccatcaaaaacaaaaacacaaaatatgactttctgacatttagctagctatcctgaacctctttataaaagaaactgacatctgtaagggcatctcccttcctgcactcaagccactataaacttttacaatgaaaaaaacattggcttaaagtttacagagcaaaccttccctttgcttgatgcttttcctggcaattcctgactatccctttttgattcaacaaataatagtgtttagatctaagttctctgcctttgggatgtaagttttcacctgagagtcatgtctttggaagtgaaaatttagggttgtctagcaatctgaattgtttaggggagtggaacagataattaagagactgatagtctaaaggagggggggaattattttcactagcaaatgaaaaatcttataaaactgtaagatctgcttctgttagtgcatctgcatgtctttacttttatgtatcatatatatgtgatatttcactaccaaaatatatgaaacacctctaattaaccagcttaaagaaaacacaagtgcttaaatcaaatatttcatcagacaaatagaaactcaaatgtcttttagttcatgacttgggtagatctttggtaaataaagattagtttgttggtttaatgaaaggagctatgtcttctcatcagcaaatactcattcatttaactctagggtttcacaggctgtagaaatgattaacaaagaaataaattgagatgatggctaactttgtttaatgaactattcaagcataataactgttaagaatgaataaattagggccgggtgcagtggctcacgcctgtaatcccatcactaggagttcgagaccagccaggccaatacagtgaaaccccctctctaccaaaaatacaaaaattagctgagcatggcagcgcacgcctgtagtcccagctacttgggacgctgaggtgggagtatcacttaaacccaggaggctgacgttgcagtgagttgagatcaagccactgcactccagcctgggtgacacagtaaggctgggtctcaaaaaaaaataaaaataacgaagaataaattagatgaatgtaaataagatatttataaacaaacttttcatagtttcacaaacccttttcaaaaatttaatcttaaagccatgttatgttaattaacaggtaatcataaaatatctatctcatttatagggtacagaaaagttaaatatatttaggttataaacaaaatatatttaggttataaacaaaaattgaggaaatattcagaaattgttgtcatgtggtataaaacagttcaaaattacttcctgggtttttcactggaaattcgagttactaagagttaaaattgtagttaatatacgtaattaaaactattaggtataagaaacaattttatatacagagcatattttaaaagatgtaaggaaagttgaaaagagactaattgtttttcccttgtacacagagatctttgtatggtcaaaatgataagggggaaaggaaagtaagtttttctcttaaggtaaaatgccaatataaaaaagaaaggtaggttgcagtgagccgagatcacgccactgcactccagcctgggctacagaggaagactcagccaaaaaaaaaaaaaagtcgagtgaggcgtggtggctcgcacccgtaatcccagcactttgggaggccaaggtgggtggatcatgaggtcaggagttcaagaccaacctgaccaacatggtgaaaccccatctctactaaaaacacaaaaattagctgggcatggtggcgcatgcctgtaatcccagccactcgagaggctgaggcaagagaattgcttgaaccgagacccgggaggcggacgttgcagtgagccgagatcatgccactgcactccagcctgtgctacagaggtagactcagcgccccacccgcccccaccgcccaccccccagcaaagaaaaaaaaaaaaaagaggtataggtcaaaaccaaaggcttcagcaagttgtagaccatttgtggaagattaatcttgtgaaaaaaaaattgtgtgtaatcaagcttgctaaattagaagagaattatttagttttgctaaaattgaacattaatatacaacgtacacaaatgcagggccagagtctgggcccctgtgtcagaacagcagacttttcttggagcactggtctgctctttaagaaaaaattttaagtggttgtaaaaagtttatggaaattttatcttgcatggtccaagctgattgagatttgatggacagtttcattaaaatagctttatactcaggaggctgaggtgggaggatcacttgagcccaggagtttgaggctgcagcgagctatgattacaccactacactccaccccaggcaacagagcagaccctgtctccaggggaaaaaaaaataaaaggctctagcactgacaatatactgatgcaaaggtaaaatttatttttctcttttgaacaagatgttcatataatattaatgaggataacaaaagacttttgctcaccttttgaataagctggaaaaaaaaagattctgttggtctcatgtcgtctttttaggtcttttgattgtttagaaaactgagtatcaaaaaagagaaaaagtttttgtttttttggccgggtgcagtggctcacacctgtaatcccaacactttgggaggccaaggtgggtggatcacgaggtcaggagatcgagaccatcctggctaacacggtgaaaccccatctctactaaaaatacaaacaattagctggatgtggtggtgggcgcctgtagtcccagctactcaggaggctgaggcaagagaatagcgactcaggaggctgaggcaggagaatggcgtgaacccaggaggcggaggttgcagtgagcccagatggcgccactgcattccagcctgggagacagagcgagactccgcctcaaaaaaaaaaaaaaaaaaggtttttgctttttgaaatatttcaattatctggctaaatgactattattttacagcaacctgtgattctgttttgaacaacatccttttcaatatttgacacatttcccaaaatcaactttcaaattctaaaattaagtcttttccaaaaggaaccccctggaagtccgagagagacctattaggcttaattggtatgttaaaattgtatgtgaagctttgtcaaataagaaatggtgtttaactttgggttatatttgtgtgcatggtattaatgtgtgttccaacgttacatgagatttctgaaatcctgatatgtcttgatatgtcagacataattatggttattatgttaaattgttgtatgccacaaaaataaccaaatttccttgtaaattgtgtctttaactgtagctactctaagtcttttggcatccacagacaattattgttctactttgactcttctcaaaaagtagtttacacttggctacagtcaaaaatttgctttttcttcaagggaattcatggaaaataattttttttttaagagacaaggtcttggctgggcgcgatggctcatgcctgtaatcccatcactttgggaggccaaggcaggcagatcacctgaggtcaggagttcgagaccagcctgaccaacacggagaaaccccatctctactaaaaatacaaaactagccaggcgtggtggcgcatgcctgtaatcccagatacttgggaggccgtggcaggagaatcacttgaatctgtgaggtggaggttgcagtgagccgagatcacgccattgcactccagcctgggcaacaagagtgaaactccgtctcaaaacaaacaaataaataaagagacaaggtcttgctctgttgtgcagattagagtgcagtggcactttctaactcactacaacctcaaactcctggacctaagtgatcctcccacctcagcctcccaagtagctacaactataagcacacaccaccacacctggctaatttttctattttttgtcgagatgggggtcttgctatgttggccaggctggtcttgaactcatggcctcaagcgatcctcccttcttggcctcctaaagtgctgagattatagctatgagccactgcgccaggtggtaagtactcttgaatacaagtttctgataattttgaagaccattatcattggagtaagtaaaaactttcagaactctaataaactgttgtgttcatgatgattgctaactctgtatatcaagcagaataaaacttaattacatgggactgaaattacagatgactgaaatgattttgacgactttttgtttgaaacattgctgattcttttcatgttttgttttcccaagtcgaggaagcttttttctttcaagctttttatagcttgtagcaaatgggtaaaacataactttatgagcaagactgaaacattcaccttactctctaccttatttctccaaaatgtataaactattcatgagtactcttattttatgacagtctaattatatgcgttttaagttcaataaaaaccggtttattgtaacaggacacaattaagacactggttattctaccgacactcttgactggaatggcgtattttaagatatgaccagactggtttaaagaacagaggttgactatgtagagccaataaaaagcctgttggaaagactagcctggtaccttgtttacatggctcctttacaaggttcctgatgtgcagcaagtaaaacaatcttactttctgacaagcccaggaacctcaagatattttgcgacctcaagaagagaggaattcacccaattcatgtaagtattaccagcatagtccttggcttggcttcctagccttgaggctttatagttgaatccaaaattccttatgaaagttccagcaaagacaacttaaagaacctatatggccaatcattattcttgttgcattttatgcaaataatcagcccaagtataatactaaaacttattttgcaagtaagctggtcctcctaagatttatatcttcagtaaaaatggggactggagagagaaaaaattatgcttcataagaaaactatagtacccatgttattagattccagccttaaccattgtgtttgagtttttattgttttcctacaatttggattgaatctccaatgtaataggatttttactatgtattttattgttttacctctaagaaaaccaaaagcatgaaattcaaagactacagaagatttaacaagcaatgacagttacataaatcagtgacttgactgagggctgagaatgagccttcccagcaccgtcatacatcatcccatcataaaaatccacttgtaactgccgctgagcaacttggtctatgctcctgggttgcaatcatcatgcttggcccaaataaactcttcactcagcttcttcattttaggtcaacactaacatcacaaaaagagtttcagacaggccggggatgatggcacatgcctgtaatcccagtgcttttgaaggccaaggcaggaggattgcttgagcccaggagtttgagaccagcctgtgcaacaagatgaaaacccatctctacaaaaaaatacaaaaattaaccaggtgtggtggcacgtgcctgtagtcccagctactcgggaggctgaggagggaggaccgcttgagactgggaggtcaagaccacaataagccaagatcacgccactgcactccagcctggcaacagagtgagaccctgtctcaaaaaaaaaaaaaaaaaaaaaaaagtttcaggcaaactataagaatcagccattgaaaattcctatcacttccaatgattctgaattactgttcggaaatgtagataactttactcaatcttgtagcataggatatctctggcttcaaagataaccacaatgggccaggtgcggtggctcacgcctgtaatcccagcactttgggaggccgaggtgggtggatcacgaggtcaggagatcgcaaccatcctggctaacacggtgaaaccccatctctaataaaaaaaaatacaaaaaaattagctgggcgtggtggcgggcgcctgtagtcccagctactagggaggctgaggcaggagaatggcgtgaacccgagaggcggagtttgcagtgagcggagatcaagccactgcactccagcctgggcaactgagtgagactccgtctcaaaaaaaagataaccacaatgaaaattactattaatactttgtttaacagtaattattcaactattaaatatttaaataattaagttattaaactattaagtacagggcctgtatctctgatgctgaactatgatgtgtgacttaagcccccaaatacatcatgttatttggatccaaggtgctgcacagaacgctgaccctctctaagagctgggtattacttgcaaaaggcttataagcatcggtgcatgggtcgttcagtggtagaattctctcctgccacgcaaaaggcttataagcaagaagctataaagttcccattttctgttcttcctgtattggatgatgtaaagcaaactgtcaccaagactcagtttcccaaacagtaaaacaagtgttctgaagaataaatggggggaaaaaagggagggggctttcaatcctctgaattacaagtccaatacattgttgagggtgggagttgttgcaatttgctgtagtttcttaagagtgtaagatagtgtgaaagatcctgacacacaccacagttgcctgaggacagtaaaccaaaggccaggagagctcacagcaagtcacattatctctagtgtgagttcctctacacaaaggtgacgggtatgaacacaggtgttgaagttggatccaagactgcacacagactcctgtgttaacagcgtggacgttaaaatgaacaactctccctgaatgctttaggaagaaaaccatttaatttacatgaatttctcttagactatttctcaaagatgaactgtaagctgcagtctgattacacgatacaaaccggagggtgttaaccagaacaccaattagcacctccctatttggattaaggttaatggattatctaaaatgacaaaacacttaattttcctggagtaaatatatttcaatcttttaaaaagcacagtctaataactgctttaaaaatctacctcaaaaagttaaaacacttatttaaattatctaacatacataaaattaatgctttcaccaatttcttttgatataccacagcggagggtgcgccttaacagcgaccacagtaaactctgcaattacagtgcaacgggatgctggacttaaagaggaggctcgttacagtcctagctctgtcaccaactagccagctgtatctctaattaattttacctcatgggcttcagtttctgagtcttcagagatctaaaatcctaagactgcaactgcaatattacactgtttttctgacaattattttcacaaactagttaccaaatctcagttgacaaaataacgtagaacaaaactcacagtcttagaatataaacatcttacttcaaaagtactatttaattcacacctaacattttatgaattaagaattaatcaggccagacacagtggctcaggcctgtaatcccagcactttgggaggccaaggcaggcagatcacttgaggccaggagttgcagaccagcctggccaatatggagaaaccctgtctctactaaaactataaaaataagctgggcatggtgacgtgcctgtagtcctggctactctggaggttgaagcacgagaatcacttgaacccaggaggtgatgattgcagtgagccaagatacagccactgcacttcagcctgggggacaaagtgagactctgtctcaaaaaaaaggaattaaaaagaattaaaggttccttcagtcttttaattccagactgataacgatggaactgataaaaagaaaacactccatgcaactgggttaaggctgattaaatgttatgttcactattattattattaaacatttcgtaaatatatgctttacaataaatttacctaaccacacttcccaacatcaaattgaaaactggaagttaagggtcaggcatggtggctcacacctgtaatcccagcactttgggaggccaaggcaggcggatcacctgaggtggggagttcgagagcagcctgaccaacatggagaaaccctgtctctactaaaaatacaaaactagccaggcgtggtggtgcatgcctgtaatcccagctactcaggaggctggggcaggagaatcgcttgaacccaggaggtggaggttgcagtgagccgagatcgcaccattgcactccagcctgggcaacaagagtgaaactccatctcaaaaaaaaaaagaaaaagaaagaaagaaaactggaagttaatgatccagcatttatttgccttgctcatataattatctaacacaatttgtggccatataacgattttgggaaaacatctagtctacagttatttatgttgagctgtaacttcatgtgatttcatgaaaaacctattctcaataacagaataaaactaccacttctttctttcctgtaaggttggcagggggacgcggggagggggaggactaccacaatgaccaacacacttccaaaattctgaacttacaggaaatagtatgccaagaatctgtgtggccttgcctgaaagataataaaacttgtggtcactcggaatcctaaggcacactgcaaaagtttactcttcactggaatttctccaggtcatggagatttttaagtgcctcaatgcttctacagtttatttggcaattctacatcccatttccagtcctttcatgcttaggtttaactctcctgtactgagccctaaagaataatgatttcagcagaagagattaaattcatcggtgtgtacaaagaaatgggaagagcagggaaaaactgaaggccacgtgcacacgcagcaacactggtaatactgcttcccatattcattctttggtcttcactgacagcgtgaagaagcaactattgctgattcatcagttactcattttcacaatggtcagtactccaagtcagcggtaaccaatcttttttggcaccagggactgacaggtttcatgcaagacaatttttccacagacagagcggaggggtcagggggtggggggtggtgaggaggatgctttcaggatgaaactgttccacctcagatcatcaggcactagattctcataaggagcatgcgacctagatcccttgcatgtgcagtgcacagtaggatttgagctcttatgagaatctagcgcaactgctcatctgagaggaggtggagctcaggcagtaatgctcactcaccctgctgctcacctcctgctgtgcagcgcagttcctaccaggccatgatgggtacgggtcggacaacctgggagttagggacccctgctccaagtgacccactgaaaggcaacctgaactagcaatttagcctggtaacaactgtcaatggagcaaggcacaggggctcacactcatattcccagcaacctgggaggctgaggctggaggatcacttgaggccaggagactgaggccagcctgggtgacatggcaagacctcatgtctcaaaaaattattatttaaatagccaggaggatcactggagctcagaaattggaggctgcagtgagcagtggccacaccactacactccactcctgcagcctgggcaacagaacgagaccccgtctgttaaataaataaataaataaataaataaataaataaataaataacaagtatcactggaggtatggatattaaccacagaggaatatggaacatagaacttaaaatcatgctacgcaggccgggcacagtggctcacgcctgtaatcccaacactttgggaggccaaggcaggcagattgcttgaggtcaggagattgagtccatcctggctaacatggtgaaaccccgtctctactaaaaatacaaagaaatcagctgggcgtggtggcacacgcctgcagtcccagttacttgggaggctgaggcaggagaatggcgtgaacctgggaggcagaacttccagtgagcggagactgtgccactgcactccagcctgggaaacaggtgagactccacctcaaaaaaaaaaacaaatcatgccagacagaagtccacccaaaaagactttcacagtaagctactgtatttacagtactcaagaaacactaaatgccagtgttctatccgtggtttaaatgtttttaacctcctaaaagcacaagagacaatgctttcatcctttcaaatgtctagatttttagaaggtagcttcccatagggacttcaagtctacttttaaagtcaggactgaatggttaaagcaatgaactagaaatccattggggtttcccggcacaggtctgaatcctaccaattaccgcatcttttcctttgcaaacgtgatttactgacccctcctccagatggagagcctggtatttactacctctcaggaagaagtgtgactgctccccaacctgaccaaactttccccctttatggacccagtaaaaaaaaaaaaaaaaatctgtacatgcctcctaaaggttactggtattctctgactgataaggcaaaaattacacagacgataatctcaacaatgaaatacaaatatgtaatcaacaaagataaaaagaatgctcagaaaagcatgaagccacctttaaagaaaattttaaaggacctgatatttttaaaaagagaatgttcaacatgttaacagataacaataactgaagcaatttgtacatctataccaaattgatcactaggttttcatctctgtattttgagcactgacaataaaaacaaagctctctgaaatgtgaaaacaaaatgttctcatttttcagagacactcctaaaaaaggcatgtttgaaattatctgaaataacaaatatactttaaacaactggcaaatattagcaaatttaagacatattttataaacaaattttaaagcatttttaggccaggtgcaatggctcacatctgtaatcccaacactctgggactgcttgaacccaggaattcgagaccagactgggcaacatagtgagacccgccacctctacaaaaaaaaattttttttttaattagccaggtgtggtggcatgcacccatgggtcccagctactcgggaggctaaggtggcaagatcgctcaagcccaggtcgaggctgcagagagctgtgagcatgccactggactccagcctgggtgacacaaactgtctcaaaaaaataaaatattttttaaacatacacgattatatgtaatacaaattaaagggattttaaggaagctggctggtctcatttagactggggcttggccttttcaactatgaagagaggtgtacacaagaagaaagagattccctaccttgccgcccagtaacacccacatgtgaccactccctgcttccacacgactctgcaaagcagaatcatttaaaaaagacaattctatgacataaaatcctccaactgcttcccactggtcttaggataaagggcaaaataatcaacctatatgggacctcccaagctctgtaaaataaaactctccacctacctcccagccgcgttctcttccttcagccttgttcacactagttccttcaaagcactctgcacctttcccacttggggcactacacaggtaattctctctgctgacctctcactccaccaccatccctccaacctcggtgccaccatcacaacctcagggaagccttctgatccctcccatccaggccggatgtcagtgcactgcactttcttattggattatgtgattgtccacctgtctcaatggacaccaaactccaagagatggcaatctatccctcttgttcaccatactgggatctactcatcaactatttagcgcatgctacctaccagatattgttctaaggcttaggttcatactgaggagcaaaatataaatcttgatctcataagagtttacattcaagtatgagaagacgggccatacataaattagtaagtaaattatatggtatgttatagtgtcataaatactatgaaaaaagtacagcaagaaggggagacaaggagagtgcagggcaggatacaccataatatatgtgactgttgtagcagactatccaaagaagcatgcagctgagagccagccacttccagaggccagtctctatggctttacatagaacaatgcactttcctattcctgctggatgacgggccttacagaaaaatcctgttgcctttcatctttgcatccctagtgttcaactggtcagaacacctgccacaggaagaaaatgaacccttttcttaccgtaatctcagtggccctcctttatgccaggccctttagcaatacttaacagaaaataaaaaatggaaaaacatccactaaagtttaaaagatacattttcaatattgcaattgtttcattttgggttaacatgatgtttttattttaaagcaaaataaaggtaagaaattctatggctatctaaaagggggcatttattttattttatttcattttttttcagacagagcctcactctgtcgcccaggctggagtgcagtggtgtgatctcagatcactgcaacctctgcctcccgggtttaagcaattctcccgcctcagcctcccaagtagctgggattacgagcacgcaccaccacgcctggctaatttttgtatttttagtacagacaggttttcaccatgttggccaggctggtctcgaactcctaacctcaggtgatccacccgcctcggcctcccagagtgctgggattacaggcgtgaatcaaagtgcctggccgaaagagggcacgtttttaaagactgagaaacagtataatttaaaggtcatgtggctaaattactctatctgaaaatactttatgcgctaaatgtagctatgaaaagtcagttaaaaacttgtaaatataacttttatactctataagaaactttctaatgtatgctttttgagtaaagattttcctatttgtttacagaaatgtgcaagtatacaatcagcaaacaatttctctggaacacaggtgggagatgtctttgagcattcttatctctttacttgaattactttcactaaacatctacagtttaccagtccctgggctgggcagaggtgacaagcataaaaagagaatctcactcacaaggagcttacattaattatgtgctaagtaacacaaaggtacacttagttgctacagaaacagagaagcataatctcagaagttaatgcaaagcagtctggaggactcctaaaatatctttttaaggatggtttaaggagctaagtaaatattttaaaaatttttttaaaggaggtggacattcaatttcagtcaaagaatctaccaacagcaatggctacaacgtttgcaacaccaaggtaggagagggaggcgtggtcctgattaaaaggtggggcagggcaagaaggaagacacagaagtggaagcacacacagggcgaggcctagggcagtcctgatgagtttctgaaaagaggccagccatcaggctatgccacactctggctacagtgcgactaaaatgatttgtgtaaataaaagagcattttattgggcaaatttatgcacatcagacttcataaagaacactttcagcaaagatcaagtctcatctctatgattatcatactccccctaaaaaactaagcagtacgctttcaaatttgtgttaaacatggccgggcgcagtggctcacgcctgtaatcccagcactctgggaggccaaggcagatgggtcacttgaggtcagaagttcaagaccagcctggccaacacagtgaaacccaatttgtactaaagtacaaaaattagccgggcgtggtggcacgcacctgtatgtagtcccagctactcaggaggctgaggcaggggaatcgcttaaaccctggaggcagaggttgcagtgagccgtgatcgtgccagtgcgctccagcctgggcaacagaacgagactcggtctcaaaaaaaaaaaaaaaaattgtgttaaacatgaaatactttcaatattgcaatgtactccatggtctaggtctcctaaccagggcaatggggttgatgggaaagaagatgtaaaaccagtagcatcactgaactgcaaatcctttatggttgaaataggagccatgacagcttcaccagaaaaactatgagaagacagagtttataaaggcattgaagggacaaaaggtattaaggtatggggtggcgggggggcagtgagaaagagaagggaaggaaacacagctgagttaataattttccttgttcctaaggaaggcatttacacacaggaaaaacaaagcattagaacgttaggggaaaaaactttcaagttggaatttatctcccttcttttgagaacctagcagttttctaccttacaattccatgttctaaaaaaggaattcattttccaatcaaaataactctagaagtagagtagttacaaagatatcaaccagcataagagcaaaaagtttaaactgaactaaactcagacctgatgaggttaactctctgagtgcctcatttacttcgtactctaaaataagcttttacagaaaaaggagaactcttcacatcaataaagttctacaaaagagcataagcaaggaaacccttacagcagtgtctgtttttaacaaggtattttccaaaaacatgacttcagtgttcatgtcttctccccattggaaaaaggttgttttgagaattttgtagaagaaattacaagaatatactccaagatttttgtgcaatttatcaatctgaaaagaatatccctaaatctgacagaatctataagagtactgtatgcatgataaaagcatatttaaaacttgtacctttggccaggtacgccgtggctcacgcctgcaatcccagcactttgggaggccgaggcgggcgaatcacctgcggtcaggagttcaagaccagcctggccaacatggtgaaatcccaactctactaaaaatacaaaaaaaaaaaaaattagccaggtgtggtggagggcacctgtaatcccagctactcgggaggctgaggcaggagaatcacctgaacccgagaggcggaggatgcagtgagccaagaacgcaccattgcactccagcttgggcgacaagagtgaaagtccgcctcaggaaagaaaaaaaaaaaaaaacttgtacctttaacactaggataaaaacaaatgaaatcgattgatggtaacacatctatacagcttttttacaactttgagaggccctaacatagacaacacgttactaagattagaagacctagattataatcctagctatcactattttgacggaaaatatgaattttaacatgacaatgaaataacagtgaaaggagtttgtcagccactccttggctggtaacatctaccatagcctatcactacaaaaacttgcaaatctatgtagagtagctgcagctacctgaaggcactgttcattgtaaacaccattaacaatttgatgtcccaatttgcatgttttgggggtggggggagacaaggtctcactgttgtccaggatggagtgcagtggcaggatcatggctcactgcagcctcaacctcccaagctcaagcgatcttcccacttcagcttctccaacagctggactacaggtgtgagccaccatgcctggctaattttttgattttttggtagagatgaggtctctctatgttgcccaggctggtgaactcctgggctcctaaactcacctaggcctcccaaagtgctgggattacaggaatgagccacctcacccagcctgcacgtattttagaactacattttaagataatgtgaagactgcttcataaaaacaccttaaatatatacttgtcaaaacttgtgcttacttatggaaattgcattaaattcaataaattctttaaatctcacttttaaaaatggcaatcttcccgaacattaaaccaaattacatttctccctgaatttgctgccacttaatttcagctactcttctacagaatagtacccatgttatctttttttctgtctggttcctactcaaaaagagtggaactgctttctccaaatatgcattctgtgctcagaagctgttttctctgcccagatacatgtgtaaacaagccaaaaaaaacaaaacaaaaaaacaaaaacaaaaacaaaactttctgctaatagattgacagctacaaggtagaatattttaaaaattcagtaagctgggcgcagtggctcactcctgtaatcccaacactttgagaggccaaggcaggtggatcacttgaggccaggagttcgagaccagcctgggcaacatgctgaaaccccgtctctactaaaaatacaaaaattagccaggtgtggtggcatgtgcctgtaaatcccagctactcggggggctgaggcaggagaataacttgaagacctaggaggtggaggttgtagtgagttgagatcgtgtcactgcactccatcctgggtgacagaacaagactccaactcggggggggaagaaaaaaatcagtaatagtgaaaatagcaaaaccagacaacatttccatgtttgtgttacaacagtcctaagaaaatgagattatcatcatccccctgttacaattgagaaaatgtaggcaacacgagggtaacttctaatgaataagccatgcctttgtttcatataaataagtcaactcaactcacattaacttttcaaaataccggataaaatttatttctaaccaatgcaagtttcaaagataagtacacaaattaaatttatgattaaataataagcttgttaatctgatgcctttcggaacgcatttcacttagcaaacctcaattaagctatttcttatatggtttgattacaaaactgcctttcagcatattaaatacaaggagaaaaaactgaaaagccacaacgatttcaacttctgtaaattaccctgactgtaatgaggggcgccaggcaggttggggaagtatggaaattgcacactgcacacaccacctgaccaccaagaaaaaagaggacaccactcttccccactgtggtcttcacaaactacaactcagcacctatttcaagtgcatttaaatattcaaacaactgaaactaagagaaaaaaactttcgaaagggaaaataacttgtctgtccccttcaatgttcaccttggagttgctctcatctctagaaaaaggcctcacgcatactgtttatacttacaaactccactgccctgtcaaggaaaaccttcctgttttctcagttatccaaaacttcaaacttccaatttactattaagacaagttattgggcatccacttagagaatctcaaacgaaagccagataggaggtagttttctacagctaggtttctcaagtttcatctcagccaagttttaagaacgttttacgtaaaaataaggggaaaagcaaaattacattcgcatgaagtttcgacgcacaacggcactgaaacggaaagactcttcacgttcccaagcgcaccctgagaggcaggtgcagcagctttccgatggcttctctgccgcccatgtatcccagccccaagaccaacacaggcaatcttcacatctgactttatttttttaactccttcagatccacctctgctcaagtctatcaacaggaaaacaggagcgttccaaacacacaccgagcaacaggatcccaacttcctggttctaaaggaatgcgatgccctgatgacccgtcccgccccgcacccgcacggccgcctatccgggctccggcgggaccgaggagcgagtggcaaggctggcgccgcactgcgggtgccggcgcccgcccggcctgggggcgctcgcggcccgcgaccccggccccgcccaggccctgcccgacccccgtcctcgccggccttcgcccaaccccggcctcccgaccctgaccccggcccggtcttccgggcacccagctccgtcgactcccgcctcgcctcaacgggtcctcctaagccccggccccggccttcccctgccccggcctcggccatcctcagccccagttttcccctgccccggccccggtcctcctcagccccggctttttcctggccctgaccccggtcctcctcagccctggcccttcccgtgccctagccccggtcctcctcaacccggccccggccttcccctgccccggccccggccccggcccaggcccggccctgcccgccgcggccgcgtcctccgggaagatggcggcgcagtgacaggcggcgcggcgcgggtccgagctgggccgggagggacggcccgccgcggcccagggtgcctcacctgtcagcgccgccgccccgcccgaccggccgcccgcgggctcctcgcctcaaccccggggcccggcggccgcgccacacgcggggacggcgaggagagagacggcagggagaggcggcgcggccgggccgggccgggccggaggtaggggagagggcgggcgcgagctggcggcggcggcggcggcggattcttcccctttcgggcccgaaaatgtctcaaccccgggactccagatccccaacgctccttcccgttcgcatgagaacacacagctcccacttccggggccctgcggaagtcccgcccccgcgcggacccgcgcctcgcgccctgaactcgcgcactcacccgccggtcccgcggactggcgctcagccccgggagagcctcacgtcatggtgttgcggcgcgctgattgggcgcacccgacgctcggcccgccccgccgccttcttggcctctccgcgcgtacaccctgctcgcggccttgcgattggcgcgtgcgcgcacatcgccccgccccgcgcacgccgcacgtccgccccgcccgccccgcccgccccgcccgccgtccccggcgcgaccggagcgcctgacgctggggggccgtgtgggccctgacttccggagggctgggccctggtcctccgccaccgcgtgcgccccttaaagacccctgcccgccgcccaggacggatggcgaccccggccctagcctgtccccagaccctggaccaaggccccggccctgccccgaacccctcatcccacccccaggacccaggccccgaccctggccacccaggacacgccctggcccttccccgaactcccaccccacagctgggatcaaggtcccggccctgcccggaacacctcaccccacacccgggacccaggccccggccctgccccgaactcccaccccacacccgggaccaaggccccggccctgccccgaacccctcaccccacccccgggaccaaggccccggccctgcccagaactcccaccccacacccgggaccaaggccccggccctgcccagaactcccaccccacacccgggaccaaggccccggccctgccccgaaggccccaccggggacccaggccccggccctgccccaaactcccaccccacacccgggaccaaggccccggccctgccccgaacgccccacccgggacccaggccccggccctgccccaaactcccaccccacacccgggaccaaggccccggcactgccccgaacgccccaccagggacccaggccccagccctgtcccgaactcccgccccacacctgagacgaaggtcccggccccgaagtcccaaccccacacccgggaccaaggccccggcactgccccgaacccccgccccacacccctaaccaaggcctcggctcagccccggaatccccaaccccacacctgggatcaaggccccggcccttccccaaacccccaacccacacccgggaccaaaaggccccggccccacgtttcctagaggcgctgggttcgggcccacgttgcaacgagtcagatgctcttggtagctcagggaggtgttcacactcctgccgtttccgtgaggatggtgacgactccgaactatagcagcatactctacctacccctgatcagtttatggaagaaaaggaaaccaaacaaagtatgttgcgtttcccttaagcttgctgcctgattttctggtttctgctctgattggctacatatacacatattatcaattattccaaattttaggtttgttcccccattaaaacggcttttcagggataccatattcatggttaaccgtgtacctgtgcttacaactgcttttttaattttgttttttgatacagggtcttgctctatgcaggtctgcactctgagctcagagtgctgtctcgggcccccaaaatctgggattagagatgggagccggtgtacccagcctgtgcttataatttttcgtactcagcgttcaaatgctgacaattctgcattttggaagaaagcctctccggcttcccatagtgggtagactgttgacatcaaggttgggtgccttctttgtgaaaccttgttgcatcctagctttaagggaatttgcaagttaaataattatattcatagtaatgtttttaaagaacatttaacgacataagacacatttcctttaatattaaaagcatgtacatatttcagaaaacttgcttacctggacaacctgccctgaccagtaggccatagtgtccttgcttaggtgcctggttcctttacctccacggataacctacaggagcttactcttggttcataacattgctagggccattgatgtggtataagtctaggaattctgccccaaaattggtaggttaaacttttttttttttttgagactgactctccctctgtcaccccggctggagtgccgtggcataatctcggctcactgcaacctcagtctcccgggttcaagtgattctcctgcctcagcctccggagtagctgagactacagccgcatgccaccacgcccagctaattttttgtatttttagtagagatggggtttcaccgtgttagccagaatggtcttgatctcctgacctcgtgatccgcctgcctcagcctccctaagtgctgggattacaggcgtgagccaccgttcccggctggtaggttaaacttcaatcttttttgtctatgtctacattccagcagacatctatgtcttacctattacaaaagaaagtaatgggatgggttcagtggctcatgcctgtaatcccagcactttaggaggccaaggcaggcagatcgcccaaggccaagagttcaagaccagtctgggcaatatgtcaaagccccatttctttaaaaaattatacaaaagtagccgggcatgtggtgcatggctgtggttccagctactcaggaggctgaggtgggaggatcgcttgaggttgaggctgcagtgagctgtgattgtgccaccgcattccagcctgggtgacagagcgagaccctgtctcaaaaaaagaaaaagaaaaaaactaaaactaaaagaattccatctcttctttctcttcgtattgtgtaatcctttccaacaatcagaactgggctttttgttccctcatgatcttctttttttcaaacctgtgtctcagaagaaacatccattttcaccttgagatgtgaggttataacatgaaatacattttcatggcatctctccttagacaagatcagttttttaaaactttagtataaatttctcaaaccatgatcagatacactccctcatttcccatgtcaagtggttacaaattctgtcaatcctacctaaaaactctttccttctccccgtccccccagtggttttgccgttgttactgctcacctggtttgattcagtggcgtcgcggttggtctctgctacagtccattactcacagtgccagcacatgtttccttaaaaagcttcatcaccatcctcctgcaatgcgaccttcaccggctccccgttgcctgcccaggaggataaagtccaagttctcctgtggaaagaagacccttcacacgctagtcccagcctgtcttcagcccagccccctgtgtttcctttcctgccttatcctaagacatccttaccttccaatcacactcactttccgagcatttttgaaggtattgagggagttgatgagtctacacttgaataaaatacagactttacactccagactgcacagttgacaggtaagtccacagttcatagtgtggacagtcctatacaaagaaatggagaggtgccccagctccagacgctgcgctgctctggaagtcgagggcggcattcttttggagcctgagcacttaggtcctaatggatgtgagtcccctggcctcaaatgtgcttcctgtacttggatgtctccttctggcggaatctcgcttatttttcaagttacagcccaaatgtcaaccactgaagtgttttagacagttgattttccttctgggccctattattagcacttgtttgtagctctgttgagctacatcacatcatacaattttcagctgacactactgtcatcccaaagaaatggtcaggcctcaagggcagaggcagcgagggcagtgatcttgggacaaagtctctaccaaacaaatacagcatgtgtatttctctagcagaggcctacatttcaagtggtgtctgagaacattcttttctttttcttttttcttttcttttcttttttttttttttttttttgagtctccctctgtctcccaggctggagtgcagtggcacaatcttggctcactgcaacctgcgcctaccgagttcaagtgattctcctgcctcagcctcccgagtagctgggattacagggatgcaccatgatgcccagctaatttttgttgttttttttttttgtttgttttttgtttttagtagagtcagggtttcaccatgttggtcaggctggtctcgaactcctgacctcaagtaatctacctgcctccgcctcccaaaaatgctgggattacaggtgaacattcttttattttatcccgaagcattttctgtgaaaaaataaacactacttctccaatgtgtagccgcattgctcaaaaattcatttttgatgatttaggactattcctttgcccattgattaaacaaatattcactgagtacctacgcggtctcagggactgctaatgttgcagagatcaggggagcatcacagatgagaagcaggtaacgagggatggagggtgaggatgagggatggagggtgaggtgaggctgtgtagagtgcttgggtggctcacaagcggggtccaagccaacttaagaaggaaccagaaaatgatgactaagccggggccagagacaaaccatccacgagaaggacacaggtgggaagaaggaggcagtgagtcacgatttactacgaggcaggccagacacagtagctcaaacctataatcccagcatgttgggaggccgaggcgggtgtatcatctaatgtcaggagttcgagaccagcctggccaacatggtgaaacacctgtctctagcaaaaatacaaaaaaattagctgggcgtggtggcggtcgcctgtagtcccagctactcgtgaggctgaggcagaagaattgcttaaacccaggaggctgaggttgcagtgagcgagatcgtgccattgcactccagtctgggcaacaagagtgaaactgtccgccccccaaaaaacaacaaaaaaccagatttactatgaggcaagaaagacccttagaaggttttgctgtggagtatctccagccacaaaagccactccaatagaaacacaataaggaactggcctaggcaaattaggtggaagtattaaaatgaagaatggtggtaatacatttgaatactgtgagtaaaaaagaacgcatgagcttttacagatactaagaaatatacgtgagtgggtaagtaaaaaatagtagcattgaggaaggaaaaaagaaagctcttctttacagtaaaatgctgattaatatatgaagaagagatttttttatttttatttttggagacagggtcttgctctgtcgcccaggctggagtgcagtggcgcaatcccagctcactgcagtctcgacctcctgggctctagtgatcctcccgcctcagcttcccaagtagctaggactacaggcatgcgccaccatgcccagctaatttttgcattttttgtagagacgaggtttcatcatgttgctcaggctggtctcgaactcctgggctgaagcaatccgcttacttcgacctcccaaaatgctgggattacagatgtgagccaccacacctggccagaattattttaaaaatcactatcttgtaaccaccagaattctggcaggaatcacaaatgaatgctaaaatcattgggtgaaactctgttgaggatatagattatgtacaccacctcaaagcttattaattgcttgttgcttattaatttcaaagggaaaggagtatttttacagtgaacaaatatgttagaccccatctgaatcaagtaatcaatgttagcatcactaataatggcggcctgaccccccctcccccacaccactatgtgtctgcctcagttatatggtattccggctaaaattcacaaacttatcacgaggaacaatcagacaaactcgaaggacattctgcaaatgacccataatctttaaaaatgtcaaggtcataaaagacaatgaacacttcaggaagttttccaaattataggagactaaggagagaagtcaagcatgacatgggcaaacctagattagctccgaggtcagaggaaacattcgctgtgattaacattactggattttattttattttatttatttttatttatttatttattttgagacggagtcttgctctgtctcccaggctggagtgcagtggcgtgatctcggctcactacaacctccacctcccgggttcaagcgattctcgtgcctcagcctcctgagtagctgggactacaggcacgcaccaccacacctggctaactttttgtatttttagtagacagggtttcttcatgttgtccaggctggtctcgaactcctggactcaagtgatctgcctgcctcagcctcccaaagtgctgggattacaggtgtgagccactacggccagtttgggatttgaatatggactgtgtgtcagtcttctaaccaaggctaaatttcttgaattggttctttttctttttttttttttttggagacggagtctcgctctgtcacccaggctggagtgcagtggtgtgatttgggctcactacaagctccgcctcccgggttcacgccattctcctgcctcagcctcccgagtagctgggactacaggtgcccaacaccacgcccggctaatttttgttgtattttttagtaaagacagggtttcaccgtgttagccaggataggcttgatctcctgctcttgtgatccgcccgcctcggcctcccaaagtgctgggattacaggcgtgagccaccgcgcccggccgaattggttcattgttttatggctgtgtaagagaatgtcttttatcttaggagatagcaatgaattatttaggggtgaggggttaagatatctgcaagtttctctcaaaaagtttagtgaaatatacacacacatatgaatgtgtgtgtctgtatgtatatgtctatatatacatctctctctctcagagaacatgacaaaaccttaattggtaaatccgagggtaggatatataagtggctgcaatttgtctgtaaacttgtaattcttcaaaatagagagttatcttgtagagacacattctgcagttatttatgaatgccatggtattatgtttaggattttcttctcaataatctaaagaggaagcagttggtagagacaggtgagaaataatggacaagtggcgtggtgaaaattgttgaagctgggtgtgatgggtacaggcagggttcctgacactcttctccctgctttcgcatgttttaaattccctatggcaataaaaacatagtaatgagatgaaggattttaattcgtcatagacattccatgacagcgtatggctcaaaaagcagtcagagaggactccacccttcctggctgtaggaaagagctctgggtctcccagcctgggaagccagggaggctgcagtggagttgaatgaaggagtcccgctcaggcgaggagggtgcaggcttggcgggaggggatggcacaggagggagcagccagggatgaaggaaccgcaagggtgaggcctgttaggaggtttagggtctgcaggaacatgtaattttggaaagaccctctctagggggagatgagaaactctgctgtgatgtattttataactctctagggctacagcctttgcagaagcccacattaaaggcctaggctgccctgaaacggcttcctgaagttggatgtgtgtttcctttgaaactaacaccactctggcctaagatgtctgggactgcagcttgtattcatgtgatttcttgcagaaatctgctggggtgtttaacctacacagcacccgtctacacataggcataaaattatcttctaggcctgagaaaaggctgcacttgcaccttgatgacttgcctggccttagcactcataaagaagaggaatgagttgatgagacatgagatttgggaaagactccccagttgaggattggatgtttcaggaagaggctgagaaccagacttcataagcacctggagaactggcaaagtggacattgtttttaatccaacatatatggagacttgactttttatttttatttattttgagacagagtcttgctctgtcgcccaggctaaagtgcgcagtggtgtgatctcagctcactgcaacctccacctcccaggttcaagcggttctcgtgcctcagcctcctgagtagctgggattactggcatgtgccaccacgcccggctaattttttttttttttttttttttgagacggagtttcactcttgttgcccaggctggagtgcaatggtgcgatctcggctcaccgcaacatccacctcccgggttcaagcgattctcctgcctcagcctcccgagtagctgggattacaggcatgcaccaccacgcccggctaattttgtatttttagtagggacggggtttctccatattggtcaggctggtctcaaactcttgacctcaggtaatccgcctgccttggcctcccaaagtgctgggattacaggcatgagccaccatgcgcgggcttaatttttatatttttagcagagatgaggtttcaccatgttggccaggctggtctcaaactcctgacctcaagtgatcctcccaccttggcctcccaaagtgctgggattgcaggcatgagccatcacgcccagctaatttttgtatttttagtagaaacagcgttttgccatgttagccaggctcgtcttgggccaggaacgtggcggggggaggggggcgcctgcccagaggaggccccagtgcctgaagtgggcatgaagagcccagcagcattagaggaacaaggactgacatgtttcccacagtggaaagaaagtttttgaaacagaaaaatagcacgggcatttgtggggtacataagaaagagacaaaatggaaccatttggaccagaaggcatgacgggagaagtgcgggagcgcaggagaggtgtgagctagtctcatcctggggtggccggtcaatgccagactgtgtccaggaggccactgcgagactttgaaaagatgtttcacatagaaattactgtatgcaggtgagaagcagaggttgacctaaacactgcagagaatgttggatggaaagttgggacttaaaatcttgatttggcaaaatcacagactcagctggagaggtgagtgttggccaggacatgggacccacttcctctaagacggacaggagctcagagccccggacttcagttttgtggacgaggaggtcaggttgtttgctgaagatgagggtggaccgatagggtggagaaacaatggggtctgtaaaaatgcttgaggcaggtgcttggaggaggacggacatttgccagtgtccacttcattgcccactcccacctgtgggtgctggggactcagcctgctcttcctcctcttcagagttgtcacctattgtgttcatggaagtccttctccaacccccatttaagaccagctaatcagggagagtcccaattccccatgagcttactttgttttgtttgtttgtttgtttgttttgagacggagtttcactcttgtcgcccaggctggagtgcagtggcatgatctcggctcactgcaacctctgctcctgggttcaagcgattctccttcctcagcctcctgagtagctgggattacaggcgcctgccaccatgcctggctaatttttgtatttttggtagagatgggcggggggtgtctcaccatgttggccagtctagtcttgaactcctaacctcaggtgatccgcccgccttggcctcccaagtgctgggattacaggcgcgagccactgcacccggcctgatcttgctttttaagcgattgcaattccacctggtgctatggtgatctggggttccatggcctgtttaccagaagagcaatgcttttgttgtgctatattgttatttcagttatttttttattttttattttttgtctttttttgtttgtttgttttgttttgttttgtttgagacagggcctcagcctgtcacctagactggagtgcagtggtgtgatcatagctccctgcagcctctaactcctgggctcaagcgatcctcccacctcagcctcctaagtacctgggattataggctcaaactagcatgtatggctcagtacatttttttaaaaatctgcattatgtatatcttgaactatacctagagaagtatacattggttgaaattttgaggtgaacaaatgtgccactgttcagaaacattctaatcacattctccactgttcgaaattccccaaggtatctatttttgccttaatttatattccctatgttaagaaggtcatttgagcacattttcatgtttgttagctatttctatttttcccttgcctgtttagatctagatttattacaagaagtccatgatggagacagctcaggaatggaagaggtgagaaataattctgtcaaagaatatgggggtgttgtagggaaccggaagatgagggcagagaagggattgaagctgcctgattgcgtgaccttcccaggatcccgatccctcactggttccaacaccagattccatgttcctcctctcccctaagttttttctccggagtcagatgcatttccctaaaataatttattttaaccaggatcttcttttacgaatgtcctatttgcacagactcaagcccaaagatcagaagaacctctgtcctggaagtcggttctctttccaatggaacagcctctgcaaagtgtaccacacgatgagttaatatatctcacttttagaaagaaagatactgatatgccactgatgtggtttggatgtgcgtccctccacccccacccacagtcccatgctagaagtgtcactcatattcagctttgaatcagtggggaacccatacaggaagatcataataaatatggaaaattctgataattttgtgattccatgagataagaaaagaacttccctctcctggaaatctcactctgaggggagccagctgacatatcttaggcctccctgcacccctgggagaggcccacatggagaggagcccacagccaaggaggccttttggaactgggccctccagcctcactccagctttcagatgatcacagtccaagctgacttctttttttttttttttttttgagacagagtctcactctgtcacccaggctggagtgcagtggcatggtctcggctcactgcagcttctgcctcctgggttcaagagattctcctgccttggcctcccaagtagctgggattacaggcacacaccaccacccctggctgatttttgtaattttagcagagacagggtttcgtcatgttgcccaggttggtcttgaactcctgacctcaggtgatctgcctacctcggccttccaaagtgctgggattacaggcatgagccaccgcacctggcctcacaagtcctttctgaaaccacagatgggcactttgcctgctgtgtgttattctgggacttcagcagcctccctcctcctgtcacctccatccatctgtgggatgcacatggagcctcttcacaggacagcaagcatttgaacatagcaggaggatgacctggggccagggttttttgttgtgtttcattttgtcttttcgagacagggcctcactctgtcacccaggcgggagtgcagtggtgcgatcatggctcacggcagcctcaacctcctgggcccagatgatcctcccacctcatccttttgagtagctgggaccacaggcatgtgccaccacatagggccagttttcagcctccattctgagtggttatgatttctgttgaattctttttccaagaggtgattgggtgagctaagactgacattataaagtatttttaaaacaaggttgtgaaggaagcagtgagcggcgagggtgatggagtggagggaaggtgcaggggggcccaggtcaggagggcccgggtcgggagggcccggggagtgcagcggcatttccggggtaattgtgtctacttcgcagctttcttggtggtgtccacgtaagctccacaacatcagagccgctgctttatccccagcacctgatacaggcaccattgaagctcactgcagcctcagcgggatgggtgccttacagccctacagggctgcagaaaatacggaagaacatgaatagcatgattcaaaaagaaaaagcggtcttactggtgcataacaaagggaattaggaagaaatgaaccaaagacaccttgaattttgaggtcagacttgtctgtttctttagaattcgtggtaaagtactgaacattggctgcataaattatttacatacttgtcacggtgtagccgaggactaaaacttcaacattcacctgctaccaacctccgaacagtggctgtgtttgtatcaagttacctgaatggtaggtggggaagtccaaatattcctagtaagacaattgcattcaaggcctggctggtgaaacctgtttcctgggaaggtagttagttggttttcaccacagggagaacctggacatcattcaacatcatcagcctgggatatggctcccagaagaggttggaggggggatcttggagctggcagatttgggtttgcatgtcaacccccagctcgcccctgccctgtcacccccaagtctctgcttccccatctgcatggggactgacctcgcgttgcaatgctgctgtaggtatgaagaaacagcatagcctatgtgcctgccactcagccagcgctggggaaacagcactcctttcctgccagcgccagtgccagggcaaactccagctgtgggcatctgctgtcagccccacgcgtgtctgggcgttgcccccgccctgccttggtgtctgcccgtgactcacttttcctgctgccttcagctttgagttcctgtttcccatcttgaagtcctggccctaagttctagtttctgtttctggtgttctttgatttctaattaaatccagtccctaaatggttggctcaagtcggcgtctaaaggcgattctctgacactgtgaatctcaggagtgcattacagtccaagtcgtacttagaattagtggccagtaaattgctgatagtctttaacaaatgttagcaatttggaattcaagaagtgcttgttgatacttgtgtttatggattttaaaatgtttccaattttttacgtattacaaaaaatataagcatagattgtaaccacgtttataattcatattttataaatgtatttttaaaaataaagacatttttaaggctgggcatggtggctcacccctgtaatctcagcactttgggaggtcaaggcaggtggatcacttgaggtcaggagttcgagaccagcctggccaacatggtgaaacctcgtctctactaaaaatacaaaaattagctgggcattatgataggcacctgtaatcccagctattcaggaggctgaggcatgagaatcacttgaacccagaaggcagaggttgcagtgaacggagatcacaccactgccctccagcctgggtgacagagtgagactctgtctcaaaaaaaaaaaaaaagacatggtccaggcatggtggctcacacctgtaatcccagcactttgggaggccaaggcgggtggatcacaaggtcaggagatcgagaccatcctggctaatatggtgaaaccccgtctctactaaaaatacaaaaaaaattagccgggcatggtggcgggcgcctgtagtcccagctactcgggaggctggggcaggagaatggggtgaacccgggaggcggagcttgcagtgagccaggatcacgccactgcactccagcctgggcaacagagcgagactccgtctcagaaaaaaaaaaaaaagacattttagcattactatgtgttaggaactgaatgtatgtgtccctccacaaattcatgttgatgccttaacccccaccatggctctctttcaaataaggaagtatttatagttagttaagttcgtaagggtggggccctgatccaatgaggttgtgtccttataagaagagacagcagagccctctgtcatgggaagacactgcgagaagctgccatctgcctgccagggagaggccctcagcaggaacagccttgatggccccctggtctcagactccagagctgcaagaatgtaagcccagcctgtggtgttttgttacggccagcggagtagacttgtaccccatgcagcggtgtgtctatgagccttctttacatcttgaattgaagtcaacttacagccaggaaaaactcaattacaacaggataaatcccggaaaaaaggtctctctatggatatcatttgctgccacttcttcacatttatcgttttttggttgataccacatcacagaatactgaaaatccactagcaaacataaaaatgaccttttaaacattttgcattctgtctgaaaatttctggggaggcctttacacccctttccttctgtgggaaactttctaggagctgaagtttctatgccaattacatcagctgcctctaaagcgaaaatacaaagattcttaaattgtctgattagggataattgtgatttttaaagtgacatttatccaaaaggatgtagaaaggtaagcaagttactttcctgattcacttttaggttggttagagtggcagtttctgtttctccagttatgaaagaatctcatagggttagggaataggcctttcctttaaactttgtcttgtaattcagtgtggtaacatgaccggggttgggggacccctctctctctctaaattttggcaagttatttaacctccttggggcttgttccttccatttgttgaatgaaatactgaactagaaactattctgtgactgaacagagcagttatatcaattttttttatcttacaagttcacctccctcctcttccttgccaccctccctctttgtggaaaacattcagtgatgagaacttaagtcaaaggtgcctggccatgagaacttccatacttttgactctgaaacaccatttttttttccttttgagacagagtcttgctctgttgctcaggctggaattcagtggcgcaattttggctcgttgcaacctccacctcctgggttcaagcgatttctcatgccttaacctcccgagtagctgggattacaggtgcatgccaccacatcaggctaatttttatatttttagtagagacaagttttcaccatgttgatcatgctggtcttgagctactgacctcagttgatccacccacctcagtctcccaaagtgctgggattacaggcgtgagccactatgcccagccggaagcacttttatctgccagtctccagaagtaaacctatttcagactgacaaggaagcaaggcagcgtttcatcatctgcgtgtcttgccggttcttgccaacaaacaaacagagttctgttctgcttctttcaggcatggaagatataaggcacagttccattcagcaagacaaacggcaaatatgctgtggctctcgggggcaggatggccattgagtgacccacatattctgaggccatcacaaccccgtcccaggcagtcagaacacaccacgcagtcccagaaaggacgaaagaagtgacagcctgctacgacagaacaaaatgttctgtggccctggaaggaggaggctgaggagtctccgattttcttgattgactgaggaatactggtttcttctttaaatgtaaaaactcccaaatcatgaccttaatgaaatgagttttttgttttgttttgttttttgagacagagtttcacttttgttgcccaggctggagtgcaagggcgcaatctcggctcaccgcaacctccgcctcccaggttcaagcaattctcctgcctcagcctcccaagtagctgggattacagggatgcgccaccacgcccggctcatgtttttgtattttagtagagacagggtttctccatgttggtcaggctggtctcgaacttctgacctcaggtgatctgcccacctcggcctccaaaagtgctgggattacaggcatgagccactgcacccggccaatgaaatgttttttaaattaacaaatcaaacaaaagtggctgaaaacttaccacgctgaaactgctggcagtgtgatagtggacctgagacctgaggagggcagcacgggagacccccaagagtgaggtcctcctgcctggagctgcgccgactgcccaccgcccaccacccaccaccgagattcctgcgctgctccctgctgatggggcccaaggcatgcattcattcagctcacacacggtcaaagaccaagctccaaatacaaagccacgctgcctggtttttaaaattaaactgttaattttgagataattgtagcttcatatgcatttgtaaggaataatacagagaggtcttgtgtattgtatctggagtacagtgacctgatctcggctccctgcaacctccgcctcaaaggttcaagcgattctcctgccttagcctcccaagtagctgggattacaggtgcccaccaccacaactgactaatttttggcatttttagtagagacagggtttctccatgttggtcaggcaggtctcgaactcctgaccttaggtgatccacccacctgggcctcccaagtgccgggattacaggcgtgagcccccgcgcccggcctcagtggtcgcgtcttgcacaactgggggacaatatcaggatcctgacttgtggcccaggcacagacgtccacccccacaggaccttctgctccctttaaagccacagaacttccctcccatccctgcctccttctcagccctggtaaggcctccattgctgtacttggatcatttcaagaatgttctataaatggaatctcatggtgtaccaccttttggtctggactcccttcaccagggccactctgaaggtttgttcaggccgtggtgtgtgtgcccatagctcgttccttttcactgcagagtatactccatagtgtgggttatgtcgtctgcttaaccacacaccggttcaaggccatctcggtagcttccagtttttgaccatgatgaataaagctactacgaacagctgtgtaccagttgtcatgtgaacgtcagtcttcgttttctccgggatgaacaccctggcccgaagttgccaggtccgacagtggttgcatgtttagtttgttaagaaactgccaacccgttttccaggtggctgtaccatcttacatcccaccagccccgagtgagtgaatgatctccaacccatttcccaggcggctctaccatctaacatcccaccagccccacgtgagtgagtgatctccaacccgttttccaggcagctgtaccatcttacatcccaccagccccgcgtgagtgagtgatctccaacccgttttccaggcagctgtaccatcttacatcccaccagccccgcgtgagtgagtgatctccaacccgttttccaggcggctgtaccatcttacatcccaccagccccgtgtgagtgagtgatctccaagttgttttccaggtggctgtaccatcttacatcccaccagtcccacatgagtgatctccaacctgttttccaggcagctgtaccatcttacatcccacgagccccaggtgagtgacctccaacccgttttccaggcagctgtaccatcttacatcccaccagccccgggtgagtgatctgctctccccgtcctcacccacgtgccgctgcatcactctgttattttcagccatgtggatagatgtgcagggctgtcttgttgttgttttaatttgcatttccctaagggcccactatgttcggtgtcattctctcggacatctcttcttgtgcttatttgccattcgtatcctctttggtgaaatgttttttcctgtcttttgctgatttttctaactggactgcactttttttttctttttttgacacagggtttcactgtattgtcgaggctgcagtgcagtggtgcgataacagctctctgcagcctcagccttccaggtagctgggactacaggtgcgtgccaccacgcccagctaatgtttgttttttctgtatagttgaggttttgccatgttgcccacgctggtcttgacctcctgggctcaagcaatccaccctccttggccttccacagtgcttggattacaggcgtgagccactgtgcctggccttagcttttttttttaaccgttgagttttgagagttctttgtatatttgaggcactaatctgtgttggatatgtagtctgaatatattcagaatattttctctcagtttgtagcttgtcttttcatcttcttaacatagccttttgcggagcaaaagtttttattttttgtgaagtccaatttttctatttttccttttatatattgtgatgctggtaagcaatcttatatattatcatgctggtaagaaatcatttcttagtcttcaatcccaaagattttctctgtttattttctaaaaggttgatagttttgcattttacatttaagtctgtgatccattttgaaatcaggtagattgagtccatcactttattccttttcaaaattgctttagctactctcattcctttgtctgtacatagagattttagaaaaatcttctctatgtctgcatgacatttgctggcatttcaataggaattgcattaaatctatatatcattttgggaaaaatgatatttttgctataatgagtcttccaatcgatgaacaccctgcgtctctctctttatttaggctttctttgatttctttcactggcattttgtagttttcagcatatagatcctgtacatgtcttagatttatacctaagtatttttttgagtgactgtaaataatattgtattattcattttggtatctttgtattcattactagtatatggaaatattattgaattttgtatgtttgtcatgtatcctgtgatcctgatgaactcacttgttagttgtaggagggtttttttttttgagattccttgggattttctctgtggacaatcatgtcatctgcaaataggggacagcttctttccgtccttcccgcctgcctgtctgccttccttctctctcagtctctctctcccttccttctctctctctctcagtctctctctctttcttcttttccctttattttctgtttttgccttattgcaatagctaggactgctagcaccatgttgaatacagtggtgataacaggcatccttgccttgttcctgatcttaggctgggagcttcagtcttttccattaagtatcctgttagctgcaggtgttttatagatgttctttattaagttgaggaagcttccctttatttctattttttaacagttttttaggccgggtgccgtggctcatgcctgtaatcccagcactttgggaggctgaggcaggtggatcacctgaggtcaggagttcgagaccagcctggccaatatggtgaaaccccgtctctactaaaatacaaaacttagctgggcatggtggtgggtgcctgtaatcccaactcgagaggctgaggcaactagaaccgcttgaacccatgaggtagaggttgcaatgagccgagatcgcgccactgcactccagcctgggtgacagagccagactctgtctaaaaaaaaaaagtccactctgcagagatggctgaattaaaaacaatgtccactttgccaggaacttcaaacaggagaccaagtggtgacttcagggacatccagggtgatgttgcatcccaggacgagaagaggctgccactaggagccacagatagagctccagggagtttaacatacaacctttaagaggaagaaattgcaccagcccagaatcaactgcataacagacaacctttaaaacgaagaaatcacaccagcccagaaccaactgcataacatacaacctttaaaaggaagaaatcgcagcagcccagaaccaactgcataacatacaacctttaaaaggaagaaatcgcagcagcccagaaccaactgcataacatacaacctttaaaaggaagaaatcgcagcagcccagaaccaactgcataacatacaacctttaaaaggaagaaatcgcaccagcccagaatcaactgcataacatacaaactttaaaaggaagaaatcggcctggtgcagtggctcacgcctataatcccagcactttgggaggccaaagtgggtggatcacaaggtcaggagatcaagaccatcctggctaacacggtgaaaccccatctgtactaaaaataaaaaaaaaattagccgggcttggtggcgggcacctgtagtcccagctacttgggaggctgaggcaggaaaatggcatgaacctgggaggtggagcttgcagtgagctgagatcaagatgctgcactccagcctgggtgacagagcgagactccatctcaaaaaaaaaaaaaaaaaaaaaaaaggaagaaatcgcagcagtccagaaccaactgcataacagacaacctttaaaaggaagaaatcgcaccagcccagacccaactgcataacagacaacctttaaaaggaagaaatcgcaccagcccacaaccaactgcataacagacaacctttaaaaggaagaaatcgcaccagcccagaaccaactgcataaaagacaacctttaaaaggaagaaatcgcaccagcccagaaccaactgcataacagacaacctttaaaaggaagaaatcgcaccagcccagaaccaactgcataacagacaacctttaaaaggaagaaatcgcaccagcccagaaccaactgcataacagacaacctttaaaaggaagaaatcgcaccagcccacaaccaactgcataacagacaacctttaaaaggaagaaatcgcaccagcccagaaccaactgcataacagacaacctttaaaaggaagaaatcgcaccagcccagaaccaactgcataacagacaacctttaaaaggaagaaatcgcaccagcccagaaccaactgcataacagacaacctttaaaaggaagaaatcgcaccagcccagaaccaactgcataacagacaacctttaaaaggaagaaatcgcaccagcccagaaccaactgcataacagacaacctttaaaaggaagaaatcgcaccagcccagaaccaactgcataacagacaacctttaaaaggaagaaatcgcaccagcccacaaccaactgcataacagacaacctttaaaaggaagaaatcgcaccagcccacaaccaactgcataacagacaacctttaaaaggaagaaatcgcaccagcccacaaccaactgcataacagacaacctttaaaaggaagaaatcgcaccagcccagaaccaactgcataacagacaacctttaaaaggaagaaatcgcaccagcccagaaccaactgcataacagacaacctttaaaaggaagaaatcgcaccagcccagaaccaactgcataacagacaacctttaaaaggaagaaatcgcaccagcccagaaccaactgcataacagacaacctttaaaaggaagaaatcgcaccagcccagaaccaactgcataacagacaacctttaaaaggaagaaatcgcaccagtccagaaccaactgcataacagacaacctttaaaaggaagaaatcgcaccagtccagaaccaactgcataacaggcaacctttaaaaggaagaaatcgcaccagcccagaaccaactgcataacagacaacctttaaaaggaagaaattgcagcagcccagaaccaagtgcataacagaatgggccccagtgtgtaattggcaggatttgctggaagatgtctcctaggatgcgctagaagcatgaagagacgccggttgtaaggcttctgcctcaggatgtgtaggctaggcagtccagccctctggagaccactgaagaggcagcattcaaagtcttctggaaaacatcagaggactaacaggacatgaagaatccctgagcaagctccaaggaaagacgggagctcgcttcagcctggaggcgtttgctgattcggagcaaggggaaggcaaggtgcaaggcggaggccaggcctgccaggcagagccacatgggtttatcctggagtcctgtctgtgtgtgacattggccgggagggctgcacccttgctcacaccagcagctgggcagcctaggaagtccgaggcacgcaggctggatctccgtggccttgggaacatgctcattagtttttgcgccatctgctgcactttgagctgcaaagtcgagaccacctacagcttcagccaaaggcctgtcttttatggtggcctgtgtccaccagcccgtcttttatggtggcctgtgtccaccagcccgtcttttatggtagcctgtgtccaccagcccggctggggaagggctcctgctccaggcctcctacatgtggacgcggacgaaaagggggctctaaacaaccagtaggaaagaagtgtgtgataaggacatctgcggcagtggtgaatgtgatggaaagacgggggtgtgaggcagagccagggagggtagctgggctcattcagaccggtggctcagagaagaggtgcgaaaagttgggccccgtggaatgggagtcgggacatggccttggctgcctgaggtcgggaggaggacacagctgctgcgtggagtcacgggaccgagaggccacagaacctaaatgggacccgtgggtctgggggtgcggccgtgagtggcagcggagtccttcagggtaccggccgggcgcattcgctcactgctggtgcgacacatgcatggcagatgtctcctccccgcacttcccaggacagctcccatccacgcttccccaggacagctcccatccacgcttccccaggacagctcccatccacgcttccccaggacagctcccatccacgcttccccaggacagctcccatccacgcttccccaggacagctcccatccacgcttccccaggacagctcccatccacgcttccccaggacagctcccatccacccttccccaggacagctcccatccacgcttccccaggacagctcccatccacgcttccccaggacagctcccatccacgcttccccaggacagctcccatccacgcttccccaggacagctcccatccacccttccccaggacagctcccatccacgcttccccaggacagctcccatcccacagccacactctcgggcagctctgacactcctcccaacagtaggctcacattccctccctcttcaccccagggggcttctgaggtggtggaggtaacaccccgacttctgaactgagggccccacccctgcctcacttcagtctgcccctgccccctcgacccagccaggactgcagcccgtggggggcccacaccacaggcgccaggcaggctatggggtggcagcttaggcaggtgcctgagtacactgccaggtcgttcttccttgtccctagtccccaagggattagaagggtttctggcacttctgtgcttcctgagatgactccctgttctgtggttttggtgccagtaattgataaacctccaaaatgctgctgattggagcatgtcctcgctcctaacactcagaccttcaactcgggcctttgcctcttcaataagaccctccacggcccctccacacgtgtctccacctgttgcccaggacggggagtttacgtttgctaacaccatggttattaaagagcttttccgggctgcctgacttcaaaatctggagagcttagtgttctttctgctttaagttgagttgtagcaggaaataaacaaagtaaggactgccctattcactggaataacttgaaactgcactgttaattaaaaaaaaaagaactctaatcctttgaaaatcctggcagaaaggaaactgtgtgaggccatttggaaacctggccttgagttcctcctctcactcccacctgaggcgactgtttcccctctcacgcccgcctgaggccactgttccccactggctgagcgtccttccctcccaccctggcccctgcagtttgaggctcccacttcctgccccagtgcctgccaggtgccccacagaggtggggacacaggatctgcaggacaggaggctcctgccaggtttccggctaatccaccaaatgggcaccttctttgcacagcggctctgggagctgactcagatggcaatgactccacgaaccctgacagattccatcaaattatacccaagccaacccctacagctgagcgtgacggcagcttggagctggacggacaccacaaactacacagttacgttatgggagtacgtatgagcccctgactatgggcccaggagtacacctgcgtctaaggggttcaagcagtgttgtctcactcagaaattctttttttttttcttttttttgagacagagtctcactgtgtcccccaggctggagtgcagtggcgcgatctcggctcactgcaaggtctgcctcccgggttcacgccattctcctgcctcagcctccctagtagctgggactacaggcgcccgccaccacgcccagctaattttttgtatttttagtagagatggagtttcaccgtgttagccaggatggtctcgatctcctgacctcgtgatccgcccgcctcggtatcctcggtatcccaaagtgctgggattacagccactgtgcccggcccaaaaattctttaatttaggattccaatcagcctaaaagacaagcactaagcagtttccgactggactgctccctggagggtgggctgtgggctacaggatccagggctcccacacctgttgctagagccatggcctgtagccgagaggaaagtccctccaggcccaaggtatgtggcttggagctaggcctggggggtcaggagaagggtaaagacactgcaggagctcttaatttgggccaggaaggtgacgcatgagataggatgtaggcagacactgaagaagagcttgacatctccaaggcctcgtctggagcctgagacgcggtgaacagtttgctcctttacatcctgtcattctgtgatgggaatgaactccaaatgggaaaacagcaaagcctcaaatcccaaaccagcagccctgctcactgttcagaagcacttttgtgatgggagagtgcaagctcttccttccggggaatctggtccttctcctgaaccctcttatttttttacttttatttttatttttgaaacaaggtctttgctgtgtcacccaggctggagtgcagtggcacaatctcagctcactgcaacctgcacctctggggttcaagcgattatcctgcctcagcctcccgagtagctgggattacagacgtgtgccatcacactcggctgatttttgttttgtttttagtagagacagggtttcactatgttggtcaggctggtctcaaactcctgacctcaagtgatccacccacctcggcctcccaaagtgctgggattacaggggtaagccaccatatccagcctgtagttcattactctattggcaattttgggattgatgatgaatgtttttagatacttatatgaattgcttatttgtcgattttggagctggtgttcttattttattgttagactttgtataccaaaaatataaatgctttttaatatgtgatgggattattttttgggttatatgtatccttaattgtgttcttatgacactcaaatataataaaaattttataaggttaaatctaagctttgcggggtatgattttggccttttgaatcacgcttagagattttataaaatattcttgcctgtaatcttacccttttcaattcattttctttcttttttttttttttttttctgggtctggctctattgcccaggctggagtgcagtggtgtggtcttggttcactgcaacctctgcctccctggttcaagccctcctccctcctcagcctcctcagtagctgggaccacaagtgtgcaccaccacgcctggctgatttttgcgttgtttgtagagatggggtttcgccatgttgcccagactggtctcaaactcctgggctcaaacagtccatctgcctcagcctcccagagtgctgggattacaggcgtgagccacgatgcctggcctccgattgatttcctccgcgtaactgtggtatgttcctaaagtgcccactgggttgtcacttggatttgctcaacatccacccggtgctccccgcagcccttgggctgaagggtccctgagagctgacctgtcttgctggtcagctgctccctggcttagctgggtgcttgcaaacctgcctcttctgggacctgactatctgaccactgtcaggcccagggacaccggctgcacctgggcgcagacaccccgtgaaagcaccttgttcctcacgctcagtgccttggcacgcaccactacctctcctgatgttcttctcctttcttcaagggacctttgaaatgtttaagcatcctgcagcctaaggcaggtccctttctcttgatggctgccaagaaaagcacctgtgtagccttgctggggatgttggtgcaggtgttatccacccaccagggaaggcaggggcctctgcacaccccacacctctgatttatatcttcccctaaaattatgtcataaacatccttctttgttagcacaaaagtacctgcctcaggtcttcatagctccacagtcacctgaagggacgggtgaatccgtttagccgctttctctgctgacctcatccaagtctcaccacccagtgtttctcctgtaaatggtacagcttcgcgtagacacactgacaacgttcatgggggtccacgtggagtcacaggcctgctgcccacatcacccactatgccagcttggacttaaagtacttatcagagacttcaggttgaacatgaaacattaattctgaaagaacagaaagaaacaaaacgcattagaccagaaggacaaagagcccaggaggagcaacttcagccaggatggagtggcatttggaagagtggagtctctgggcagaggaaggacgctccgcctgaggtccccacaggcaacggccctgggctggtggttgccgagtccctggagatggcagggcagggcaggtggactaggtgtggttgacagtgggtgctggctgagtttggatatagagtttgtggtcccaggacaccttcagagaagtttggaaaatttattcctgaaaatgtgagatgtactgggctgcaggggtgtggaaatatgcgtattctcccctagtgatgcaactgctgggaagggaaatttggcagcatttgttggtgaaaggtgtaaagcaggcattcctgctggttcagcaatcccacctcctcatcaatcccacctccccgtcaatcccacctcctcatcaatcccacctcctcatcaatccacctccccatcaatccacctccccgtcaatccacctccccatcaatccacctccccatcaatccacctccccgtcaaccacctccccgtcaatccacctccccgtcaatccacctccccgtcaatccacctccccgtcaatcccacctccccgtcaatccacctccccgtcaatcccacctcccccccgtcaatccacctccccgtcaatccacctccccgtcaatcccacctccccgtcaatccacctccccgtcaatccacctccccgtcaatccacctccccgtcaatcccacctccccgtcaatccacctccccgtcaatcccacctccccgtcaatccacctccccgtcaatccacctccccgtcattcccacctcctcgtcattcccacctcctcgtcattcccacctcctcgtcattcccacctcctcgtcattcccacctcctcgtcaatccacctcctcgtcaatccacctcctcgtcaatccacctcctcctcaatcccacctcctcctcaatcccacctcctcgtcaatcccacctcctcgtcaatcccacctcctcgtgtcccctcatgaatcacccacacatgggcattcttcattgtgaaatgtcttgcagttgttggaaacaagattgttcaacaatagaaagaatgagcgatcaagccatgaaaaggcatggaggaaccttgaatgcatgtcactaagcggaagaagccaatctgaaaaggccacattctctacgagtccaacgacagaacgttttggaaaaggcggaactggggataataagatcagtaataagatgagtgattgccaggggttgacagagggggagggatgagagggggagcacagaggattactaggccagtaaaatgattctgtaggatactgcagtggtgaatccatgtcatcatacatttgtccaaacccataggatgtacaacagcaagactgacccccagtgtaaactgcggactaagaacgggagggaggcgctgggtatggtgggaggcgctgggtatggtggctcactcctgtaatcccagcactttgggaggccaaggagggtggatcatttgaggtcaggagtttgagaccagcttgtccaacgtggtgaaaccccatctctactaaaaatataaaaaaaattagctgggtgtggtagcacacctgtaatctcagctactcgggaggctgaggcaggagaatcacttgaacctgggaggtggaggttgcagtgagccaagatcatgccactgcactccagccagggcaacagagtgagactctgtctcaaaaaaaaaaaaaaaaaaaaaaaaaaaaaagaatggaagagagggtcattaccaaatgattgatgaattaattatgtaattaacacggttaatttcagggaccccttagagcattgaggactccactctggcatgtaaggagctgggatgtcatcatttatattctcagaacaagaaaaaagcacaacaatgtgaaaatcaacaccttttctttggtctgccacagaatcgaggcatagggaaaaatcactgcccaaagccccagagaggcagaacacagaggagcacagcaggagcggaagccccgtgtggatccagcaccagtaggaacgccaaactgccactgatgcctgctggagtgtgggaagacaaaaccacctacctaagttctgtgtccagtgaaattacctgaggggatttgttgtcagtagatctgccttgcaagaaatgttaaaagaagttcttcagagaaggaaaatgacgtaggtcagaaactcatatttcttcttggctcgttgatggctgttgtcttagtccattcgtgttgctataaaggcacacctgaggctgggtaattcataaagaaaggaggtttatttggctcacggttctgcgggctgtacaagaagcatggtactagcatctgcttcaggtgaggcctcgggaaggtccactcatggcggcgtggtgccagcatctgcttctggtgaggcctcgggaaggtccactcatggcagcgtggtgccagcatctgcttctggggaggcctcgggaaggtccactcatggcagcgtggtgccagcatctgcttctggtgaggcctcgggaaggtccactcatggcggcgtggtgccagcatctgcttctggggaggcctcgggaaggtccactcatggcggcgtggtgccagcatctgcttctgatgaggcctcgggaaggtccactcatggcagaaggtgaagaggagctgcttgtacagagatgatgtggccagagaggagacgagagagagggggcaggcaccaggctctttttaacaatgagctcttgggggaactcatagagcaagaactctctcattcctgccaggacagcaccagccactcatgagggatccaggggcataacctgaacacctcccactgggccccacctccaacactggggatcatatttcaacatgaggtttggggagacaaatatccaaaccatagcaggcaacttctccctgtgtcttcctttcatcttccctctgtgcacttgtgtgtcccaatctcctcttcttataagaataccaatcctaggccggacatggtggctcacacctgtaatcccagcactttgggaggccaaggccggtggatcacctgaggtcgggagttcgagaccagcctggccaacgtggcgaaaccccatctctgctaaaaatacaaaaaaaattagccaggtgtggtagctcatgcctgtaattccagctatttgggaggctgaggcaggagaatcacttgaacccaggaggcagaggttgcagtgagccaagatcacaccattgggactccagcctgggcaacaagagtgaaactccatctccaaaaaaaaaaaaaaaaaaaaaagaataccaatccttttgggttcgggcccaacaatatgacttcatttaaccttattaccctcatataggccctgtctgcaaatgcagtcacatggggggttaggacttcaacatgtaaatttggggacacacaactcagtccgtaagagtgcaagggagaggtcaaggcttaaaataagaatttggcttccttgacacagagatgactgtactcagtgaccctcctcctgtcatgtgtgggacaaacctgttagcttggtgtgatacaaatcctgtgattatgcaatgtcatgtggcaaaagggatttatagacggaatcaaggtcccaagccagttgactcagttaatcaaaagaaaaataatatcaagtaggcctgacccaatcaggtaagctcttgaaaagcaaaattttcctctggctggcctcaaggaagaatgcagagacctaagctttgaactcccactggccaacagccagccaaagccagggacctccctcagacaaccacagggtctgacttctgccgtagcctcagtgagctcggaagaccaccggaactcactccagaggagaccacctgaactccagatgagaccacctgaactccggacgcagcctcccgagaccctgggcagagggctgagcttcacgtgcacagaattctgacctacagaagctgaggtggtagctggatgttgctctccactctaagcttgcactaaactgtgcagcagtagcgtttcccagacttgccatttcctttctccttctccttcctccagcctgtggccaggtgcctgctctctgcaccccacataccatggtagtccaggccttggtcctcccccaccccaggatcaccacagtgacctgctatttttaaccatatgtttaaaatggggtaggaagacagaagcatgtcaagttcatgaagcttgagttccagagacaccctgacttcacaagtgagtgaccgtggatctttctcaccccatcatcttctttcttggttcattttcaccacgtgcttcttatccaccacgctgctattccttgacatgtgctctgaggaccagccattgcacatggcttggggagctggggccctgcctccaacgtgcagaatctgaatgatcagcacagggctgggcatttgcgtgttctcctgggggcttttggatatattaaaatgtcataattcctctggtgtctaaacagaagtgtgggaaatagaaagatgaatgggttatggtccccatcttccaggagtttacaaattcaacctaataaaggggaaaagatgccttcagtgacaatgtaagggagtgtctgagtccattttgcaacacaatagcagaacaccacaggctgggtaattaagaaatagtcaatgtttatttggctcatggttccagaggctgggaagtccaagatcgagggtccttcttgacgtgtcatgacatggtggaaggtgtcagtcacacggcaagagagagcacaggctcaaagttgcatcagcattaagcccttcgtgagggtggagcccttgtgactcaaacaacccccatatggccccacctctcagtgctgttgccttggggatgaagtttccaacatgtatttttgggggacacattcaaaccatagcagggagaatgtggtaagttccataaacaagttctaaggcctaaaaatgtagatgcccccatttataaacctggctgtgagttgagggtgatccaaatctttttatttatatttttgagacagagtctcgctctgttgcccaggctagagtgcagtggcgtgatctctgctcactgtaatctctgcctcccaggttcagatgattctcctgcctcagcctcccatgtagctgtgattacaggcgcccgccaccacgcctggctaatttttgtatttttagtagagatggggtttcaccatgttggccaggctggtctcgaactcccgacctcgtgatctgcccgcctcggcctcccagagtgctgggattacaggcgtgggtcaccatgcccagcccagattcattttttgaaatatggttttagtaatattttagtaacattagttatatctgtttttttttttcctgtgggctagggcacagtccccagaaatctgtggattagggccaaggatagacgaaggaacctgaaaccaggatgtcaaacgctgttgcagcagatgatcaatttgggcttcataaaaactggaatgtgctgaagttagcagaggtctggctcaatggacatgtcagacgtcagaggccacgtcgatgttaaaggtcatgggccacaaaacgcagggtccaagcctaagcccagagtaacaccgggtttcctgacccctctgaagataacgctgttggccccgctaactaatgagggtgtttgtgatgaaaaggcgacagtggccaggactgtgctgactgtggggtgccggggctgcggggagagagggacctcaccagctgtgtgtttgtcatgggcgtagacagctcaggacagcacagaacagcacagctctgaggcggtggacaagataaacacctactgtggggccaggccccaccaggagccctgggagtgaggcttatggaacactgacacacactcagtgtagatgcacaggctgtgatgaatgaccccaggtggggcctccacccagggctgccttgcacgctgaggcccgagagggctgcctgggagccatgcagggtcaggccgggagtggacgggggacctgctaggtcctcgcggctcagcacccgcctgcctgtggtccacacagtgccagtttccttgggagaatgggtccttccagccgtgtgtctgtgtctgtcctgctgggagtgcccgtggggcaaggccgggctgagggccccgctcggctgtcggcgtctcccacggtggtgctcagcggaacgtcccaaggacagaaggcggtggtgctgattcacttccgaggcacaatcagaaacccaggtcctgcctggactctgaggcccccaaggcctgggctggtttctctgccctcatttccccacctctgtgcggctcctgggtcatctcaaagacacggtgcccgctcccccccgtttctcggttacacaattcgaaggcgatccgtattttcaagcagcttacagtctggtcggagacaccaagaacgcagcagacgcgatggaagaattagcaactgacagatatttgtatataagcagaaacaaactaaggaagaaaggaaacatgccatttacaggcatttctgcactaaccaggtgctgattagttacataatcgatgaaacggttgtttatgcgccaagtcgttcaaacatttgttaactggcacctactagataccaagacccggcgctgtgaagaaaacatggcaatgtcacacactgggagatgcctgccttctgggagagagttatgtctgctgcttaacatgagcaataaacaagtgacattttggtttagaatcatcaaccgatttatgtcaaacaagcaaaggaagcagccatggaaacagagctcaggccccttcccggcagtggctttgctgtttaggagagagaggcctcatggtggactcactcattattttaatttatccctgtttggagcataacgttgtttgaaaaagcagaaagggacttacgtgtagatgaattgaatacacagtgggttcttgtatgtgtgggttttgtgtgtgtgtgtgtgtgtgtgtgtgtgtatgagattttattttgtttctatctaaaaatctctctaaaaagacagtagaggcaaggaagatagagaaggagaaaaagaagaaggaggctgggtgtggtggctcacatctgtgattccagcacatcgggaggccaaggcaggaggattgattgaggccaggagttcaagaccagcctggctaacatagtgagaccccatctctataaaaaattttaaaaaatagctgggcatggtggcgcacacctgtagtcccaactacttaggaggctgaggtgggaggatcacttgagcccaggagtttgaggctgcagtgagccatgatcgcaccactgcactccagcctcgttgacagagccagaccctgtctcgataaacaggaggaaagaagaatgtggcacaagcctttgaggacaaaaggaacagaagaggagccgtgggagctgggtcagcagtgtccgcacatcctaccgaggaagccgaaggctggtggagctgcaggcaagcacatttgcagctcaaacccgagaggcacagaacgggagtgtcagcacccatgggtgtcgggcgaaggcaggcctgaaataaaaggcttgcgggagacagggcaagaagcctgctcctccacctctcacagaaggtgagtgacccccactgtggctgacgcctggagaaggtgtgttctctggaccacacagagagaggtaggtttctcctgggatggtttgagtctgaggccaccccctcacccccactgtggctgatgcctggagaaggtgtgttctctggaccacacagagagatatcgctcctgggatggtttgagtctgaggccaccccctcttccccacttggctctcagaacactggcagccaaaggattatcgtctccaagacaaggcgttcgaaccctttcctttgagggatctcattcatccacttggaaagccacaaagatcctaacaggaaggggtctccgatgaggcctcccccgggatcacggaacaatgtggccacacacagagctgcagtcagcctggtagtgcctgacttgctgggtggacagccccaaatcttcagactcctggggaaagcatccacggtcaagttcacacacaaacaggacaaacggaaagctattcggaggaaatgggcgcagcgcagggaggacacttcaaggaataaaaatgctagaatttacatccttagagagagaagtagacattgaacccatgaaacaagaacagaacaccttaaaaaggaacgtatgaaaggaaacaaaagcttgtgcaaaaaaattaaactatgagagcaaaaatgccaaccgcaaaagaaaggttggaagataaaatctttaaaaactctcagaaggtgaaaccacaagacaaagagatgaaaaataaaagaataaagatacatttttggttcagtgaggagctaaaacatttaaaagaaacgagttccagcctaagcaaagaatggacaagacccacaaagcatgccacgaaatcgcagaactctaggaaggaggaggctcagcccttgctgcggagagaatcggaagccagcctgacactgggccaggcggaggcaaccccggacttcagggggcaacagagggaggaatgccgggaattccgtgggcacaccatcttcattaagcttcctcacccagccatgatctcggctcactgcaacctccgcctcctgggctcaagcaattctcctgcttcagccttccaagtagctgggattacaggcgtgtgccaccatgccccattaattttttgtgtttttagtagaaacagggtttcaacatgttggccaggctggtctcgaactcccgacctcaggcgatccgcccgcctcagcctcccaaagtgctgggattacaggcaggagccaccgcgcccggccctgttttctatgttctagagcagtgtttttgatggactgtgttatcccctcatatgtgtggttctggctcaggaaatagtcaagcagaggcttctagaaatggataaaagattggattcaattcccactaagattccttctgtctccaagaccctataatccttatggcatgaaaacctcattaacatgaaacctggtaattggtaatttgtactaaccatactgagctcaagttggagtgtggcgttgagctgataaaaaggctttcccagcaagtaatgctgcttaagaacaaactgaggtcaaactttataaatgcaccatacaagcagtttgtgtgataattaaaatagttcttagagatagtttccaaagaatgtttttctacttagcaaccctttattagcatattttttggttactgaatacacttgacttttccctcattccacggccttccctccaattagcctaaattgatagggttttaccccatgtgagcatcttgactatcgccgcagaaagaagatgtgaatgagggtcctctaatctaaggaacaaagacaggtcactgaggacggagactgactcccacttggctgttgtcaataggattttcctgaaagctcagcctctgacaatttcacgtgctttgttgatggtatctcaaagagcgaacattccttgagccacaaagaagaacttggctgacggaatgaagtgatggcaacatcgggaggaaatgccatcttcttcagagtctggtagctgtgggcgtgagcgccttcgcgtatgatggcttcctgcgcgacagcaagcacatcctggggaaagggctagaaagagaataggcagttctatctaactgcaaatgcaatataaatcacaggatgctgtgtctgtggagaaagctgttatgatcttatgctttattcattgtgcattccccggaacaacagctattctccaagccctgtgaccttcggagtcggtagaacacatcttccgtgtgcccttgggccttggcaccgtatcttaagagagacttgggcagacaagtgcagactgagataaggtaaaacaccaggaactctgtcttatgaggaatagtggaaggaaatgggaataatttctggattggataggatttcaggcaaacacgaaagatcttttcaaatatttgggaggaaagtaaggggaaaaaatggttccttttacgaggtaggcagtgacaacctgtattgtgtcttcctccatttaccttcccggtttgttctcccatctcccaactccactccaagtgacggttcagactttgaattcagctgctgcgggtgttttccagaaagcttgatgacaagggctcttcttgacttttataaaagcttggaagaatgtagtggtagggtagatagaggagtgatgtgtttaagaattaggagaaaaggctcggcacggtggctcacacctgtagtcccagcactttgggaggcagaggtggatagattacttgaggccaggagtttgagaccagcctggccaacatggcaaaatcctgtgtctactaaaaatacagaaattagccaggcgtggtggcacacgcctgtagtcccagttactcaggagactaaggcacaagaattgcttgaaccaggaggcagaggctgcagtgagccaagattgcgtcattgcactccagccggaacagcacagcaagactctgtctcaaaaaaaaataaaagaaaattaggagaaaaagaactgctctgggaagaagggaatggaactatcccaagattagaggaaggctgactcccattttatggagatgtccaaaagagaggacctcacatgcagctgacgggagttcgtgacctgcatgcccacatggaaggtaagggaccgtgagcattttggcagtcatgagcccacatggaaggcaagggaccgtaagcatttcagcagtcatgagcccggactgacgcctgcaggaggtccctgggtgctaggctctgccacaactccggtgacctctttgttgtcccagggccgtcgggcagtgactgggaactaataacgactgagatgaagtgtcgacacaatgctgatggaaggaggcttagacatgaatggaaattgacttaaagaaattactttcttgcatgcctatacttatggattcgatgactatacatttatacagctcaaggacagatcaaggaccaatgagtagaaggttctggaaggaaggtttagttactgcaaaaagaaatgtctaagcattgtcactcccagcagtaggagagtgcttttggaagccggagctcctgccacagggcagaacactaacacccatctttcaggggcgttttaagggaaaattccatgatgggtgtcacacactggattaagcaatatcttccacccctcccaaatctggggttctgtcattctatgaattatcagaatccctggctcacaagtgggactggactgagtctctaagagcttgtaaatatttgcacagccgtcctttgaaagcactcatcgggacttctgtgccataacactctgccctgagtgaccactgaagtgtttattttactctggatcctcgaatgggtgactgaattcatttgcaaacagggaaaattcagccgtgtcagctttgattgctctcaaggtcagaggtgttgttttctttcttgatgtgtaaggaatgtgtttttttcttcttatggtaactgtaagaccggactgagcataaagagagaagacatttgaagtacatgttgcaagcagagccagagggattaggggcaaaggaaatggaaggcagagactgagaagagacagtggaagtactaaggttacttcccagcccagctgagcgttttatgatggatgtgtcagggctccaagcggtggccttggctccactgccctgagattgctctgctgcgtgtcagaggacatcatcagtgtttgcaaaatccaattaaagcagcattagtgcacacgggcacactgagccgcccagcacgtttcatgcccagtccctctggcagttctgcaagcccagccgcagttttagaaaagagttatttgggtaagcctttggaacagaattttttcctccaatttaaatcatttttcattttattgaaaacttccagagctccatttggttctaatatcaaagcagggaaaagaaacttttccttcctttttgtgacatgcttataaaaattatttttgtcactcttaggtgaattattagcaagtatgacgtaatgctgctgagatgaagcacaaggacaggggagatgcaaggcaggaaggctgggctcccacccctcgctccttacatgtagaatgtggaactgaatcgcagctgttactgttacgtaatccagggatactaggaagtagaagtggcccaaactattttataacaatagtaggaaaaaacattttcctcaatttgtaaagatttctgattttgattatgtatcagtccataatctgcatgtacatccacagggtgaaattgttttgcataatctgttttcggccacggcagagttgcctgtactggaggaactctcctgctaataacgatgatagcttctgtattagatattaaaacaacagtttgaaggcactagagatcacccagaagctgacagaaactggaagggcaaaacccttgcaaggcgggaggcaaagtgaacaagcttagtgtagccacatgagtctatttgctgagggcgcttcccagttcacgcagggtgtgtgaagatagagttcaaatgagaagtgccaatgttctgagcgcggagtctgctagtgccccggagttcacgtgctggaagctgagttgctcttgtaaccgtgttggggcctttctgagattaggcctgaggctttgcccctgtggatggaatatgcttttgtgtcgggagtggattcgttgtcgagggaggtggctcctgataagttcattcccattcctctctctctctctttattttttttttgagacggagttttgcaattgttgcccaggctggagtagtgcagtagtgcaatctcagctcactgcaacctctgcctcccaggttcaagcgattcttctgcctcagcctcctgagtagctaggactacaggcatgtgtcaacacgcctgggtaatttttgtatttttagtagagacagggttttgccatgttggccagacttgtcttgaactcctgacctcaggtgatctgcctgcctcgacctcccaaagtgctgggattagaggcgtgagcaaccgcacccagcctctctctgtctcttgcacccacttccaccaggggaaggccctcaccagatgctggcaccatgctcttggacttcccagcctccagaaacatgagccaaaaaaacttctattccttatgtattacccagtctgtggaattgtggcaggacagtccacagctctcattctattctcagaggggtgacaggttccaaaggggttcatgtccactcatgtagaagccagaggaagacagatcacacagccacagcgtcagagttagaccaagaaaggggtgtttagagacttccaagcaatcatgaaacattccatttctatgtaagccgtttgactggtatgaagtatgcacttgctgagaatcaaacactgagaatatcaggcattctacattgagatctgatattgacaagtaaatgacataaggcagagaaaagtagttagaaaataaagaagatgcagccccaggtagccgcattctttcccctctccaaggccacacatgctgcccagcaggtcttggcattacagagaatgctggcagttctgtctgttgtttgtttggagggctcgctgctgagccacatcgagttttctggagacgcatcagctaagctactgaaaccatgctcagttcctccccgtgcagtaggcgttaccactgtgattctgtgggtgggacaaagaggcaaggaggctaatgggagaagtcgaggggcaagcacccactcagtgcccactcagctgctgaccctgtgctgcgggctgcctttcttgcagagagtaaaggagctctggtctggtgatggagggggatgtgctatgagagtcccacctgccaaagccctgatggaaatgggcccagactgctggagagtgcagcagggacaactcaccggggcagggggagctcgcagggtggctgggatagcacaacctcttcctcacacagggcatggcacaccccactcctataaaacaacaaccattcagttctcacttaaaaatccgaacgtgatccgcttttggtgaactttttttttttgagacggagtcttgctctgtcacccaggctggagtgcagtggcatgatcttagctcactgcaagctctgcctcccggggtcacaccattctcctgcctcagcctcccaagtagctgggactacaggcaccctccaccacacccggctgattttttgtatttttagtagagacggggtttcaccatgttagccaggatggtctcgatctcctgacctcgtggtctccctgcctcggcctcccaaagtgctgggattacaggtgtgagccactgcgcctggcctgttgaacttttaacatacttccctgtgctctagccacagccacactggttcccgttagctaaatttttaaccatacagtattgtcatttgcatgctgtagttaagagcttccagaggttacatgcactagatcttaacagcttagccctcatgaataacatgttatcttccaccatctcagggaagcagtgataccgtggagtgagaaaagtgcattctctcaggatttctgccgtgttttcatgctgaggtgtgacagagtatttccagtcccctaactctggtccatgaccttaagttaggtgggaataaccttaggaagtgccctttccccatgtggtcctttacaaccttcaaaactcccaaggatggacccaacttgacaaacatcaacagctccctgtgtcccaaaggtggacagtcggagaacctggggagtgagcctgcttctgcacagctaatcaaacatcacaccttttgtgcgaggtctgggagagctggtttggaatggcaaacactcgattcaacctccagacagcacggggtaaccaggaggggcagtggtcaaggtcccatgaggagtgactcagcaggtgctttgtctacatggctcgctcccacggaaacccagggcgggtgggaagggattttccccttgaggagtgttccctggggagtttgcctctttcccccattaactatttctccagacaatgctgagcttctgaaaccgcaacttcccagggagccttaccgtggcaaatgcgtctgagtgtttctcagagaggcctgggcacccacggcctgtgtgctctcagcttccttcattgttccgggcctcggtttccttatctataaattgggaatgtgaaaggctctcttgaagccttgctctcgggactagaaataactcacgtaaagcaaggggctgtggcgtgcacactgtcatctggaaagcactgctctgacctgggctgcttgtctcagaacacagaaatgaggccaggccactggtccgagctccctcgcccattaggccagactgtaatcggttctgtgtttacagaagttcaacaagatgtagtttacctcaaccgtgaaacacctgctaatacagacctcaagggtgctgtgaagattaaacagcttcacgctcatcgaaagcttggagctccacaacattcaacaaatgtcggctgtcactgttgcacagacgctcaagcctcccactctgccattcaagggtctggggacaggcatgagatgatagtgtgactgggaaagtagcggtgggggtggaagccagggcaggctcaggaggctcaagacctggcactgttcagtggctgggatggggtctggcctctgcaggccctgcctggctccttgtgtgtccactagtcaccaccacagcagatcaaaccagcacacagaaatgcctgtgcttcagaggaagtcacttacataaaaatttgatgtttaaaagggaaatacatacaagttactttcatgattttataggttctcagcagtcagaaaaagtagcacatctattaatgagaaatagtttacaatacagttctcagatgatgtgcttgtttgaattaattctcctgacggcatccacccgtggtgtcccgagcacacgtcctgatgcagcaatagtgacatgttgttttatttactaatgtccccacgtgtttagtacagggtctgccgcacagctggagctcagtaagcgtctgttgaattcagttgcgattcactaaacaccctgaggtgtactcctagaatttcttcttccagtcactggggcacaagccctgcctagattttcatatacaaaatgttaggtttgaagaaatggaagaaatgctgttttcttaggtgcagtcaaggagcgactttcaagggagctccactgcgtggcgaatcgtctgaatgcacacaggtctcttggggtggacgtgacagaagccaggcagtgtgaagtgggaaacacaataggaaggcaagaattgtggcccggcctagtacaaggtaggcctgtcgcgtaatgtgcagcccggcctagtagaaggtaggcctgtcacgtaatgtgtggacccagcctagtagaacgtaagcctgtcgtgcaacgtgtggacccggcctagtagaatgtaagcctctcgcgcaacgtgtggacccggcctagtagaaggtaggcctgtcacgtaatgtgtggacccagcctagtagaatgtaggcctgtcgtgcaacgtgtggacccggcctagtagaatgtaagcctgtcgtgcaacgtgtggacccggcctagtagaaggtaggcctgtcacgtaatgtgtggacccagcctagtagaatgtaggcctgtcgtgcaacgtgtggacccggcctagtagaatgtaagcctgtcgcgtaacgtgtggacccggcctagtagaatgtaagcctgtcgtgcaacgtgtggacccggcctagtagaaggtaggcctgtcgcgtaaggtgcggcccgccctagtagaaggtaggtgctgcgtaatgtgcggcccggcttagtagaatgtaggcctatcatgcaacgtgtggacccggcctagtagaatgtaagcctgtcacgtaacgtgtggacccggcctagtagaatgtaagcctgtcgtgcaacgtgtggacccggcctagtagaaggtaggcctgccgcgtaatgtgtggcccggcttagtagaatgtaggcctatcatgcaacgtgtggaccctgcctagtagaatgtaggcctgccgcgtaatgtgcggtccggcctagtagaaggtaggcctgtcgtgtaatgtgtggatccagcctagtagaaggtaggcctgttgcgtaatgtgcggcccggcctagtagaaggtaggtgccgcgtaatgtgtggccggcctagtagaaggtaggcctgccgtgtaatgtgtggcccggcttagtagaatgtaggcctatcatgcaacgtgtggaccctgcctagtagaatgtaggcctgtcacgtgatgtgtggcccggcctagtagaaggtaggcctgtcatgtaatgtgtggcctggcctagtagaaggtaggcctgtcgtgtaatgtgtggacctggcctagtagaatgtaggcctgtcatgtaatgtgtggacccggcctagtagaaggtaggcctgtcatgtaacgtgtggacccggcctagtagaaggtaggcctgttgtgcaacgtgtggacccaacctagtagaaggtaggcctgtcacgtaatgtgcagcccggcctagtagaaggtaggcctgttgtgtaatgtgtggacccggcctagtagaacataggcctgtcatgtaatgtgtggaactcgctttcttgtctgcaaaatgagacacttgaggaacagatctttcacttagcagagaggaatcagtggcatgagtttaaatcagtgagtctaccataaggtatttaaataatgctgaatttattttatttatttatttatttatttattatttttacagacagggtctggctctgtcgcccaggctggaatgcagtggtgtgatcacagctcactgtggcctctacttcctgggctcaaatgatcctcccacctcagcctcctgagtagctgggactacaggaacttgtcaccatgcacagctaattattttatcttttgtagagatgggatctcactgttgccctcttgaactcctgggctgaagagatcctcccagctgggcgctgtgatgcgtgcctgtattcccagctattcgggaggctgaggcaggagaatcacttgaacctgggaggtcaaggctgcagtgagccaagatagtgccactgcactccagcctgggtctgggctacaaagcaagatcctatctcagaaaaaaaaaaaaaagagagagagagagatcctcccgcttcagcctcccaaggtgttgggattataggcgtgagccaacgtgctggcctagagttctttttcttgttattattccctaaacaatatagtacaactatttatatatcatttacattgtattaggtattataaatcacctagagatgacaaagtacacaggaggattgcataggttatatgcaaatactatgccattttataccagggacttgagcatccactgatttgggtgtccacagggattcctggaaccaatgctccacccataccaagggatgactacatacaaagaccctgatgaaaggcaagggtggactgaggtcactgggtgtgggggtgggtgaggcaactctacccacactgccacactttaaaagtgagccccccgcctagggtgtgccagatgaactaccctatcccataggctatttctatagagttacaaacagaataatggggctgaagaatgaggccacacattcaggagccacctctaggctggaaacagtatttccactattcacttttcttcatcagtcttgccccaggtttgaccatttagtcttttccttatcaacttttgttttatacagcatgaatttctgctcattccttcattttatttgttcttttactttattttgctgttcttaaatttaagatggatgtttacctcgttaactttcaggtagaattttgtactcatgtacagagaaacgagtttctctttgtaagtcaattttcgcattctatatttcaaggttacgttattggtttacattaaagttatctttatgaattaaacatttattgtacttattaacacatttgggtttatagctaccatattatttgtggtttttccatttttttgtttcttttcacttttttcttgccttcatttcaattagcttttgttaaccattttagatttttttctactaatttggaagttatacattctgcttgtgtagttataatcattaacctaggaattataacagggatacttaatttaccaagtcttaagttcatcagtactttaccctagttctgaaagtaggacctagaactcttaactctatccctttcttgatttataggctttattaattatgtgttaaaatgtaataagatattactattgttttttatgcactttatttgttcctcattctgatcactttgcttctattgcaagtatattatttaaactttcttttacaaagggttggcttatggtaagatttctcagtgttcctttgtctgtaaatgtttttctcctcatccttaaaggatattttctctgggcatcgaattctagtttggcagcattgtttgtttcccaccccccctccttaatattgaagatattccactgtctcctgtctctcaatgttactgttgagcagtcagctgtcacactcactgttgctcttttgatggcaatctggcttttcctttcagttgcttttaacaaattgttcttggctttggtattctgcattctgtctatgatttcttatttatcattctggtactttatctttcctggaaaaatcttagtctttatatcttcaaccattgcctccttcccttgctccttctcctgtccttctggagtacttattggacaaacatttgctctcaatcctaccggtcttctcaatctatttcaatctgcttaagttcagtgttgtgtgttttccatttgcccctccagattgtgtcttcctctgccctgctctatgcccctggaagttgacttctacagactggatgtccaggccctcttgcattctggctgttgggttagtcaaagggaggccccagcagaattataaggaggagagactgctctggttattaatttctctcactccctttctgcagggctgagccttggtgtcactgtgttcctctatggctgtggctcccacctagggcccttctacatggttttagcatttgctaggttctatcattgccttaaccctcagtcctatgaattgtgatggcttcccacagttgccagttaactgggtcctttgtcatcctttgttggttcttttaacccagctaacacttctgttaatagtgtcttcagccagatgcggtggctgatgcctgtaatcccagcactttgggaggctgaggtgggtggatcacgaggtcaggagatagagaccatcctggctaacatggtgaaaccccgtctctactaaacatacaaaaaattagccaggtgtggtggtgggcacccgtagtcccagctactcgggaggctgaggcaggagaatggtgtgaacccaggaggcagagcttgcagtaagctgagatcgcaccactgtactccagcctgggtgacagagcgagactctgtctttacttccaagacacagtggagatataggcagcattgggtaaacattcccattccaaaagggagaaatcagccaaaagaaaggcactacaggccccaggcaaacaaaacctagcaggagtcattaaatcttaaggctccaaaataacctcctttgactccatgtctcacatccagggcacacggctgcaagggtggtctcccaaggccttgggcagctctgcccctgtggctttgcagggttcagccccctgggctgctctcaccagttggagttgaatgcttgtggcttttccaggtgtagggtgcaagctgctggtggatctaccattctggtttctggaggatgatggtccccttctcatagctccactaggcagtgccccagtggggactctgtgtgggggctccaacctcacatttccccttggcactgccatggcagaggttctctgtgagggctctctccctgcagcaggcttctctgtgcactcagaatttctcatacatcctctgaaatctaggtggaggccaccaagagttcttcatccttgcattctgtgcacctgcatgcttaacaccatgcaggagctgccaacggttatgttctccaaagtggcggtccaagctataactgggcccctttgaaccacggctgcagctaagcagctgaaatgtgggaagcagtgtcccaaggctgtgcagggcaatggataccctgggcctgacccgtgaaaccattctgccctcctaggcctctgggcctatgatgggaggggctcctgggaagatctctgaaatgccttcaagcctttttccccattattttggctcgcttttagttatgcaaatatccctagcaagtggtcattctgcagcctgctttagttcctctccttaaaaagctttttctttctgtgccacatggccaggctgcagattttccaaagttttatactctgcttcctgtttaaatgtaagttccaacattaggtcatttctttgctcccccatctgaggtaagctgttagaattagccaggctatctcttgaacactttgctgcttagtaatttcttctgtcagatgccctaaagcatcactttttagttcaaacttccacagatccccagggcacgactagaatgcagccaagctctttgctaaggcataacaagggtgacttttgatccagttcccaataatttcctcatttctatctgagacctcagcagcctggacttcactgtccatatcactatcagtatttcggtcacaaccactgaaccagtctctaagatgttctaagctttccctcatcatcctgtcttcctctgagccctccaaagtcttccaacctctgcctattacctagttccaaagttaattttatgttttcaggtatctttatagcaatgctccactcgttggtaccaattttctgtgatccaaacaccttgcacgaggccccacctccagcactggggattacaattcaatatgagatttgggtgggaaaaatatccaaactatatcactaagtaatatttagataactttaaagggtgtttaaaacatattttaggtactttgtactttttttttgtttcgttttgttttttgagatggagtctcactctgtcgcccagactggagtgcagtggtacgatctcggctcaccgcaacctctgctacccaggttcaagtgattctcctgctcagcttccagaatagctgggattacaggcgcctgccactgtgcccagctaatttttgtagttttagtagatatggggtttcatatcttggccaggctggtcttgaactcctgacctcatgatccacctgcctcggcctcccaaagtgctggattacaggcatgagccaccgcacccagccatgtactgttttcaatgagactgttctttatccctagctgaccatgtaaaagaaatggcacttgttttaaaatttgttattatgtgtggaacagataatgtctgaaattgcctgaatctagcagcaggcagcagggtaaacatgcttttagcatatatgtgctaatcaaagctattctttgattagctacttttttttttgatctgctacttcttcaacctatagcttttttttctttctttctttctttctttttttttttttttttgagatggaatcttactatgttgcccaggctggagtgcagtggcacaatcttggctcactgcaacctcctgcctcaagcaattttcctgcttcagcctacaggtgcgtgtaactatgcccaactaggttttgtatttttagtagagatggagttttgccatgttggccaggctggtctcgaactcctgacctccagtgatctgccaccttggcctcccaaagtgctgcgattacaggcgtgagacactgcgcccagcctcaacctataactttttatattttaaaaaataatttggactagaccacattttctcatggcagagtgggccagtcaagtaaaaagggaaaaaagagcaaattgtgatgagttgacaagatggaaaacactatctagataaagccacatatagcaggcaataacatattgcctcaaaatatgaaatcatgaagtttttacatatatacttctaaaatttactatttaaagttattaaaattctgtatgattcaattttctccaccaatcacatggccttcctagtactttcccattttgaatgtgtttcaacttctgtttacggagtattggcatggcagtctgccacagaaattttgaaaatgagaatagcttaaaataaaaaagtggtctgcattaatcccaatggaaagtgagctatgaagatgatcagctgaaacagactataaggcgaaaggaaacaggataggagttatttgctgggtagggatcattcacaagagttctttcatgttttcttaagagtttggaattcctactttgtcagtccccaggtatactgatgctttaatggagtttttaaatgaatgaacatttatgaaggaagacctgcattagtcaatattagcctgggacagaggaacagaagaggggttattacctttctctttatgtattggtcataggttcggattttctaaacttaagtattttgacattattcgttgtagcatatttggattaattatcagttgagcacagatttaaagagcatcttctttagatgccaatgcagtaggcatcagtactgtttacagataactctgttattctcaactcactgtccagaaataggcccatgggagctgagacggaaacatttaattgtcaaattcattcccctttcctcagcatagctattgtcaacctttactccaggagtctgctccctcaatgaccatcctgaacagaggcccctgctgacctatggtgagtatcttaaccagcttgggctgccataacaaaataccagactgagtggcttaaacaacagaaaattttcttttcacagttttggagactggaaggtccagatcaggacaccagcatagttgggttctggtgcagcctcttcctggcttgtggaaagccgccttctctctgtgctcacatggtctctccttggtgcaagcatggggtcggggaagcctgggagcagctctctggtgtcttttctcataagtgtgctaattccatcaggagagctccagcctcgtgaccttttctgaaccgaattacctccccaaggctccatctccaaacaccttaacactgggagacagggctttcacgtatgaatttggggagacttaatttggtccacagcagtgggcgtggagcatcagagagaaataactgatgctgagatttggagactatttgttatcacaggataatttagactgtccagacacatacattctgatagtgaatactattatttttatacttctatgcttttgtgaggaaataatatgtttttaattaaaaataatagcaggaaaggcacttagcttactattagtctagaagttggtggcagggctggaattgaaattttaagcctcctccctctggaaaacggaaattgctaaagcattatggtttccttgtgcagaccttcaaaatcaattattaaacttgtgacaatgacgtcacatcatcaaagtgaatttttttcactgtttttaacctgagggtcagacatcacaaccacctgcttaaccagcttccagaaacactaaggattcagatgtctgttgcaacatgaaacttgtctttgcttatctcgagtatctttttgggtacagcacagaatgctaatcttaagaaattctgcctgcagatatttagaatcatttggaaattgatcatacaagcataagtacatgcattccaaatacgtgtatgattattatcacaaatcttctctaggaaaagagatcgcaagatttccattaaacctaaaattgttcctttatggaacagcagaatgcaaagaatgtttttaacagtgtgtcaatagaatgactcgtactcaacccatagaaacaccccttatcagcagctctgacgtgagcaagggcagaagttcattagcacaggtgcctgtcatgatccacgcacaggaacggaattctcacagaagaaacacaacctgtctgcatatgcaaacagtgctttagtgaaacacaggtgctgggggattattgacagcatatgaccccaagtgcaatccatcatgtacctccatttaaataccaaacaattcatgaccagcctggacaacatggcgaaatctcccctctactaaaaaatacaaaaagtagccaggtgtggtggcatgtacctgtagtcccagctactcgggaggctgaggcacttaaatctgagaattgcttaaacctgggaggtggaggttgcagtgagccaagatcacaccattgcactccagcctaggcgacagagtgagaccctgtctcataaataaataaacaaacaaacaaataccaaacaaggtaataactctacagaggtcaagaacaaagccactctcggctggcagtgcaaaaggagagtggctttggagttccatgcgccctgaacgcacctcattgtgtctctccagctgtgtgacggtgagcaagcactcaaccacctcaaagccagcactcttgtctgtgaaacagagacaatcacacccacctcactatgctgtcccgagaagaaagcaagtgacctggcacatggtggaggctccctgcattgcagttgttaaggttcaacgataatttaatgaatagaacaaaagtttagcaaatattattgtaactaagcagctaataagaacatagataatacataatgcataattaataatacacaatctctttgctcacttattaatgcctgtagaatagggttagtgaaaagctaaaataattcacataaagtatttttaacatgcctggtagatagtaagtgagcaaagagtgaagaaacagaggcttggggaagctgagacattttcccaggatcacagcgggtggagctgtatctcagaaatgaagctcacagtcttaactcactgtgtaattctgcagagaatgtcaggctgcacctttggcccggagggtggctctcatgccattgctgccttccacctaaggaggtgtttccttagacctccctgttgacagctttcctctttatggcacagtgtggagttctgacccacttcagggttgtgcagagggggtctgacagtactgtaattcagtaggactacttgagtattgcagaagcttgattccaaccgctacagcccctacatcaggaacttactcaagccaacattcaatcaacggagttccacagtcactgtgaatgctcttggcagtgctgcctgaggtgagggatggcaaaaaagtaagacacagttcctgtccacgaagagctggctacttcttttggaaacaagatgtacacaaggaagcatctaggtacaaagcagcatgtgactcgttctgaatgagttcctgtggggatccagggaagtggccgacgggcccaatggagcactcataggaccctctaagaccggatgcctactgatggctaatccccatgtaaaggctcctttcaggcaggaagttcagttctgcaaaatgtacctttcatccatcagaattacagcaacgagaaggtaaaacagaaaagaccaaacccacaaaataaaaaggtctgaaaaacaaagctttttactgagaagtgcctcgcagtcagaagctttgcagagtacccttgagagcatcctttactacagctgagaagtacctttctgtcacaaggtacacactcagaggcgtcctggcagctggaacctgctaatgcagtcaggaactggcaatgtgcctcgtactgcaggcagcatttgcgacactcctcagaaaaggcctttagagtttggcttccccagagaagcccagaagtgtatgataaagaagcttgctcctagtggtgtagaatacatacttgcccccaagaagctatactctgccacaaaatcacaagaacaggcaaggatgttgattctcatcaacacgcacatggtgtaagatgcttggtaccttatcattgttatagctctgggcccatgatgagtcattatggttgtgcattcacagacatgcctttgtagctgaacaagttaaaagcaggtggctcatgcctgtaatctctgcactttgggaggccaaggtgggtggatcacttgaggtcagggtttgagaccagcctggctaatatggtaaaaccctgtctctactaaaaatacaaaatattagccgggagtggtggcaggtgcctgtaatcccagctacttgggaggctgaggcaggagaatggcttgaaccctggaggcggaggttgcagtgagctgagatggcgccactgcgctccagcctgcgcgacagagtgagattccgtctcaaaaaaaaaaaaaaaattaaagaaaggatgtttgcccatctgaagcaaagtattgactggacttatctaaataccggattacaagaaaaagaggaactggctatatcagagtgagagaaagtgggagaggttgaggaaacatacaagaacctaaaagaaagggcaataagtatgagcatagctttgctaatctcggaaatggtggccagaactgtcctgtggtttagcaaatgatcatagccagcaaatcctaattaccctagaagcttcctttagaagtgccacaaagatgtaggaggtatgcttatccgccttgtgacacaaaaatggaagcatagttaatagatgagaaaagcatgacccagaatgattttcaatattggaatgctgggaatttatgagaggtattttcgcgtaagaataataggacttgtttaaaaggattggagagtggggggcatcccagatgcgtgagaagcagtatagctaatggttagaagcaggtttgctggagccaggctgcctgggttcaaagcccacctctgctgcctgttagcttgtcagctgcacaaccacggggtgctttcgagccttgtgtgcctttgtttccccatgcacttcatgaggctgttgcagaaattaaacgagttaatatatagtcagcagctctgaacactgcttgactgagtcagccctacctaacgtttaatttaagggatgtggccctgggttcccaaagggagcggccactctattcacaaacataaaagcagtaaaggctccatcctcatcaaccttctcctcagttggaccccacaggactgtctctcgcaactgttccctgggctctcctaaggcactgcgcggaaccagctgcacctcttttgccttagatcaggctttcccttctccgcccgttttgggatttaacaagcacgagaaagcagggctgcagggaagccgcgagggcctcctcaccacggcccgggatcaagtcccacgcgcgaggccggggtaggggcgtcatctgctccacacccagaggctgggcacgccccgcacgcgcggcttcctcctcctttgcggggctcgccgcgacccaggacccccagactcccggatcccctagaccctctggactcctaagccccgcaactcccaaatcccaagaccccggaccctccaaccctggcccagggcgcgtggctgggggcctgaacccgctccagaaacccgcagggcagtctgtcggaaacccccgctttactcagcaggaatttagtctccgcgctccccctaaaacccgggcgtcctctcctctgtaccctcgctcctgaggccctcacacgccctccgtggctgacctccaagccgggcgggtgcgctgtgcgacgcggaaagcgccgtagagcacgcagaacacgattggctgagctcccggaagtgacgtacctcaaccgcccgacagtggaagtcccacctgcgcccgacggcggaagttccgggagtgccaagtacccgcgtgcatacggctgccggcatggcacattacaacttcaagaaaattacggtggtgccgtccgccaaggtaggcggccccgggagggccactgcaactttcgcgttctcctcagctgggtccccggggagggtccgggcctgtagccgtgggagagcggtcgccttccgctcgcccatcccccgctcctgggcctgaccgtctggccgcgtactcgggatcatttcccctcccccagcagaatccggggtccaccagagatcggatcccccagagaccggggtccacctaagaccgtggtccacccaaagactgagggcccccagagatgggggtacacccagagttgggttccctggaggggccccgggtgacgatgtgggcgagtggagggggaccccgacatgtgagggaggaagcgttccgtggtccgtgatgagccttcggattctgggtttggcgtagccccctcccctctcaggaatcctgggttcgttgttctcgtgatttaacgtttcataatttttaagtcattctctttcactgttagatttgggaatacctgttccttttcagaccatagtaggcccagactaaatttttacagcgttggttggtgtggcaagaatgagtcaacaagtgttgagtattaggactttttttttttttttttttttttgagacatagtttttcgctcttgtttcccaggctggagcgcagtctcggctcactgcaacctccacctcccgcgttcaagcgattctcctgcttcagcctcccgagtaacagggattacagtcgtgcaccaccacacccagctaattttcgtatttttagtagagacggggtttcaccacgttggccaagctggcctcgaactcctgatcccgggtgatcctcccgccccggcctcccaaagtgctggaattacaggcgtgagccactgcgcccggccctagtattaggacttttaagaagtcacgtttttatgtagtgaacattcgatttgggtcgcaattacacagacattgacgggcaactggagcctcccagggactcctgcacgagagggagttactgaagtccctgcagagtgactgttttcccctcgtcagtgcctccttttcttcaggtctcaaggacgggatgagcttgccttggaaagctttgtgggagtctcgtattttaccttcatagcaaaagttgtttccccacttctctccaccatttcttatttcttcctgacagttgttctggcacatctcttgatcgattgtagtattttctttctttctttttgagatggagtctcgctctgttggccaggttggagcgcagtggtgtgatcctgactgcagccaccgcctcccaggttcaagtgattttcctgcctcagcctcccgagtagctgggactacaggcatgcgccaccaggcctggctaatttttgtattttcagtagaagtggagtttcaccatgttggccagactggtcttgaactcctaatctcaagtgattcacttgcctcagcctcccaaagtgttaggattacaggcatgagctactgtgcccagccagattgtagtattttcgagtgcaggagtcatgtcttatttgtatttttggtcaaccatctctcaggtttgttgaaggaatttgctctttggattatatgaactttgttcatgttattgacttatgtggagaactttagaatatattatacaccatccgtcttctgttctgtggagtgagatttatatttttagagaacagatgacttatctaaaaactgggtgatggtaattgtttggtgattggaagtaaaaaaaaaaaatcacatcgggaaagtgtggtattcagttcattctagaagatgttgagtgagtgcctgtcctgtgcatcgggtactgtgttacaaaaatgcattagataaaatacctgcctctttggaagtcattttcaagagaggtaagtcgaggccgggtgcggtggctctcgcctgtaatcccagcactttgggaggctgaggcgggcaaatcacgaggtcaggagatcgagaccatcctggctaacacggtgaaaccccgtctctactaaaaatacagaaaaattagccaggcgtggtggcgggcgcctgtagtcccagctgctggggaggctgaggcaggagaatggtgtgaactgaacccaggaggcagagcttgcagtgaaccgagatcgcgccactgcactccagcctgggcaacagagcaagactccatctcaaaaaaaaaaaaaaaaaaaagtggggtaagtcatatctcgtatgaccatactagaaataaaacattgttatcatggaggacacacatggattgggagaggagaagagtgtggttagctgtggtaagttggagagtcagggggaaccttatgaagtaggtaacctttgacttggtcccccttcaggatgtgcgaacggcattaggtgcagaagaacgtagagaagatcttgtgtgggcccagaggggagaccgtgtgtgcccctcatagtacttggcagactgttgtgaccacccgtttacttgtctcacttgtaggcccagaggggagacagtgtgtgccccttatagtacttggcagactgttgtgaccacccatttacttgtctcacttgtaggcccagaggggagactgggcgtgcccctcatagtacaatacttggcagactgtgttgtgcccacctgtttacttctgtcactggaccctgaattccgtgaaggaagggacagtatcttgttcattatcctcagcacccaagtatccctaacaacctttgtatgaaataatattgagttaatcaaattgttgaattaatcaaagtgttcaagaaaaaaggtcaagtaatattgtgtggctagatacattggatttaggaatcctggggatcggatccttattaaagagaagtgctgactctttgcactgggtaactcatgcaaaaatccttcatctcctcaaatagttcccttccatctctttggaaattataaacagtggattttagttttacctgttattttatgtactttcaaagtcaagggtatgcataaacaaatgggaggattgtttctttttctcaactattctaatttatggtttgaattctctgattatttaagtttcaaaggttcttaggtgtttggaaattaagatagcatcaagaaagtatggtgtaaaatttatcttttttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggtgcccgctaccacgcccggctaattttttgtatttttagtagagacggggtttcaccgtgttagccaggatggtctcgatctcctgacctcgtgatccgcccgcctcagcctcccaaagtgctgggattacaggcgtgagccaccgcgcccggccggtgtaaaatttatcttagccatgtgtttcaagatgaacaaggttgtacatgaaacgtttagtaaatttttgtaatttaaaatatgtagtactgtaagatattagtgttttaagaaggtttcagggccgggcgtggtggctcacacctgtaatcccagcactttgggaggccgaggcaggtggatcacgaggtcaggatatcaagaccatcctggctaacatggtgaaaccccatctctactaaaaatgcaaaaaattagccgggtgtggtggcacgcgcctgtagtcccagctactctggaggctgaggcaggataatggcatgaacctgggaggcggagcttgcagtgagccgagatcgtgccactgcactccagcctgggcgacagagcgagactctgtctcaaaaaaaaaaaaaaaaaggaaggtttcaaataaatggctcaaaagtagacccttttgatgtaattatgttttattttctttaattgcaggacttcatagacctcacgttgtcgaagactcaacgaaagactccaaccgttattcataaacattaccaaatacatcgcattagacatttttacatgagaaaagtcaaatttactcaacagaattaccatgatagactttcacaaattctaacagatttccccaaattggatgtaagtgacttaggggacttctgtggttatgtaaatacgggctttcagagaaccagtgtttaaccagtttggtgtactcatttgacagaaaaggaaacaaaataattgacttaggttactcagtaagttagtggcaaagaactaatttgttgaatttataaaagtgagaacagaatttgggttttttgattccctagtattctttctttcctccaaccaaaacccatctaaggaggccccaagctgtcttctcaggctttctgtgtaaaccctgggcttgcaggtgccaacccaagtgttaatgatagctgtgggttatgaacacagaagctagcagctcactggttgtctgggctttatctcttccaccttctttccaagggttttttttttcctctgggctcagcttgggtcagtggtgtaagatccaccactgtttgtgatcttgttgcttcatcagctgatgacagtcagttcagcactgactgttttcttctttggcaaggagagatcacatgggagctatgacttttgaatgaagccagaaaccttgagctcctttctctgctgcacattgcagtttgcctgtttctttttttctcttttttttggagactgagtctcactctgttgcccaggctggagtgcagtggcgtgatctcagcccgctgaaatctctacctcctggattcaagcaattcttgtgcttcagcctcccgcgtagctgggattacaggtgcataaccacgcctaatttttgtatttttagtagaaatggggtttcaccatgttggccaggctggtcttgaactcctgacctcaaatgatctacctgcctcagcctcccaaagtgctgggattacaggcgtgagccaccacgcctggcctgcctgtttctttagctgtagaaaagcaagagcagaaactgcctggcaaactaacaaagccttatgacaccatgtgtggggtaatgtggttgcaaggttaattgaggttgtgaagggcgtggggatcagcagtatagtctcaaagcctaaatctgccgttgccccagaatagtccctgaaggcaggtgtaggcagagagaaatgtttggcttctgtgacagtacttcatatttaaacaagttataatggctttttttttttaagccagagtatcacaatctcagctccctgcaacctccacctcccaggttcaagcgattctcctgcctcagcctcccaagtagctgggattacaggtgcccgccaccacgcccggctagttttgtatttttagtagagacagggtttcaccatgttggccaggcttgtctcgaactcctgacctcaggtgatccgcctgccttggcctcccaaagtgctgggattacaggtgtgagccactgcacctgtccaataatggcttatttttaaaatacagaagtgcttaaaatacaaaaattcttgctagaggacggacacttaggttgtgtctagctaggatttgacacagttgctcagtagatgtttgttgaatgagtgaatggtttcttgggaaaggtcaggtactagagagtacctgggggtgaagaaagtgatttaagaatgagatttttgtttgtttgtttgtttgtttgtttgttttgagacagtcttgctctgttgcccaggctggagtaaaatggcgtgatctcagctcactgtaacctcttcctcccaggttcaagcgattctcccacctcagcctcccgagtagctgggattacaggcatgtgcgactatacccggctaatttttgtgtttttttagtagagacgaggtttctccatgttggccaggctggtctcgaactcctgacctcaggtgatccgcctgccttggcctcccaaagtgctgggattacagacataagccacagtgcctggccaagaatgagattattcttaactgatttgatattaggaaatatttgattttagccaacaacatactttgatctacttagtatcagatttttgtggttctttttaagaagttttgtctttttcatcctcagtgttatagccatcagaggtaggagagttcaaatgtattaacattctattactctttttaaagccaggactagttatctgagaacagcttcagagtggagggttagatattaagttgtcattcactgaatgcttattgtctgtcaggtactgttctgagtcctaggaatccagaagtggtaaaggttcctgctctcattctggtggagaaaagatagtaaatagcatgtcagatgaatgcagtgaagccatggaagggagtagggagtatctgtgcggggagagggtgtcaggcctgtagtcaaagaagcagcaggtgcaggagacccaggaggtggggcaggctagggaggtgaacactgggacatgggattggaggtggtagtcaagggtcgagtttatatgcactggtgagatatctcaggagatgctggcctggtgatttaaaatgcattagtaaaatgtagacgacatttaaatctatctgagatcaccttggaagggaatgtaggaagaagggtgctgtggggagcatgaatgtttggggtagagctgtgagcactagccagcacaggacttagaggggtcagactctccacctagaagctgtgaggaaaataccgcaggcaggatgcatggccagcccgcagcgtttcaagaggtctgtgagataaaaactgagaattggtcattgggaggtccttggtgagcttgtaggctgtttagatggagtggtggacacagaattctggagagagtgggttcaagagagggaggagaggagagacacagtgtgtcttgggagcaaagagagggaattggaaggattttggggctatgggaatttttgattttttttcctaaagattgagaaataacagcaaatttttaggctgatgggaatagtcaggtggagggaagaatttctagtgctgagttcctgagcaacaggaagggtacatgcagggtcgggggctggtcattgctgggtcccacagctctaccactgcactgagagcgaggtgggtgggagccgtgactgtcggcacccgcatcccttctgatgcctgttttctcagaggactaaatagacagggcccctggccaggagagggaactggggaggagacactgcaggcgtggagggagagggaaagaaattgttcttcaagtggtagggatgaaaaactgctggccccaagtgaccgtggtgtgcttttgtttgttacaggatattcatccgttctatgctgatttgatgaatattctctacgacaaggatcattacaagttggctctggggcaaataaatattgccaaaaatttagtggacaagtaaggtacttttttctgtagtgtcttttaagttatcgaaagtggaaaaaataatattttttattttttacagtgttgctaaagattatgtgcgactgatgaagtatggcgactctctctaccgctgcaaacagctgaagcgtgcggccctgggacggatgtgcacagtgatcaagaggcagaagcagagtttggagtatttggagcaaggtgcttgtcacgcatccgcgggaaccgtgctagcatcctgctgagaggatgcgtccttgttgaggacttgagatgtctgtttttcttgtattttggagatgacagggtcagttattcttcctagctttacctatgagaaacagtaataggctggtttttattgaaaataaatacttacaaatcaatagcactgataagaaaatttatatatttcatatttaataggtaaggcatacacaaaaaagtcacgagaaaatactgaaaagtataaaaactaaggtggctcatagtttattattgacttttttatttttaaaaacacttgtatttaataggactttctgaattaatgtactaggattctgttgaaacaattacttgcttattgtgtgtattcttacatgacaaattattttgactcattcggttttgttttctctcctgcatcttagaaataatttttaacaaaatttgtgatacttggatgccttgcaggtgctttgctacagatctgtgtggtcttcatgatggccggggtgccaccctggagccgtgtttgttacagacgaggtggcagagtggcagtaacccatgttgtagcccaaacggcatggcctgcaggcttcaaagtgcactggttccctaatgtcatcttgctaatgagaattgtctggacactgccagacatgctgttggccccacctgtcacctaatgaattaaaacgtgggcttagaagggctgaggaatatgattcttaccagagccaaacttgggagatagcaattgaatatactatgtgtatactattactttctgcaactattttctccatcacttttgcattacaaaagttggagtaagatgaatatcaccataggcctggactgtaactaagttgaaaagaaaatttaaagcaaatcttaaactttgaatttcttaatttttcaatttgaacttttcctagtgcgtcagcatttatcccgtttgccaaccattgatccgaataccaggaccctgcttttgtgtgggtacccaaatgttgggaagtccagcttcatcaacaaggttggtctggtttttatcgtaaagcaaatcatctgactattttacgtcagtgttactgtattctggcggcgtgggattcaggatggccttgtaggtcagtgttaactgtattctgactgcgtgggattcaggacggccttggtaataatttcggcctccgagttggtccttgagtaaaacactgccctggtctgcaggagttcccggtgcctgagcacgccgagctcctcttggtgaggatttactttgtctgtatctacatttatattactattacagaagccattactttttgttcttgtgtgtgtcctataatttctaaggaatttgagacatgtaagtgcatttttgttgacaactggggaggttttcttgggtgttgttggcctgtcctggagtggctatgccagcggggctccggtggcaggtgacactcacccagctggggtcttcccgtctgcagctgcatctgagtgatctgttaccttggttgctgtgtcagctttcacatgaaatcgtatgtggtctagtagagggacggtgccgagtcgctctttccctgggtgagctcactgactaggataagtgtaacatttaagggactcggtcatttgttgcttcaggaaagtttggctgagtttcagggactcaggaagaggcaaagcaacatttaaaatgtgaatttacaaccagcaacagctcatgtgccaagaaaatggtcaaattttatggcttactcagtgccaagatcactttatttttaattaaaaaaatttttttctttctttttgttgaaactttttctttttgagacagggtctcgctctgttgcccaggctgaagtgcagtggtgcagacatggctcgctgcagcctcaaccttccgggcccaaacagtcctcccacctcagccacccaagtagctgggaccacaggtgcacgccaccgcacctgtttaatttttttattttttgtggagatggagtctcactgtgttccccaggctgatctcaaactcccgagctcaagccatcctcctgcctcagcctcctgaagtgctgggattacaggcatgaatcactccaccctaccttaagatcacttttgctttgaaatagatttgtgagttttattttgtctacaggttgctgtgacatggtgaccagcaaagctctgcagggtccttgctgatttttcaaatgcttgtcagctctgaacctgccctgagctctgagccagtgctctgtggccgatttggtggccactgcactgggtggctttttaaattgcagtttaattcagcaaaatgaaaatttcaactcctcagtcacatgagccacatactgaaagttcattagcagtgcatgactggtggcccggtttggacagtgcagacagaacatgcctgtcatcataaagagctctgcgggcattgcaggcggtggggcaggacttgggagggtgaggggaggtggtggctgtcctccaaatgccagccctcacgctgtcctagtaccccagtccttggcctggtggtgcaaagggagaggtaccaggctcctattcgatgcagttttatcgtgtgaggtttcttctatggttatttcctacccaaaatcagtcttgttaaaacacacagatcccacgtgtacacagaggaaatgaggtgattctgaaagttctcacttgttccaggtgacgagagcagacgtggatgtccagccctatgcgttcacaaccaagtctctgtttgttgggcacatggattataagtatctacgttggcaggtgagagtcttgtctttatttttattcatttatttattttgagttggagtttcactcttgttgcccaggctggagtgcagtggcatgatctcagtccactgcaaccttcacctcccaggttcaagtgattctcctgcctcagcctttcgagtagcagggattacaggtgcacaccaccacgaccggccaatttttgtgtttttttagtagagagggggtttcaccatgttggccaggctggtcttgaactcctgacttcaggtgatctgcccgccttggcctcccaaagtgctaggattacaggtgtgagtcacactgcacctggcaagagtcttgtctttaaacagaacaaatatcttggtttatcaagaacttgaaatttctccatcatcataaagaaaactcatctgagctcttgggatgcataagaacaggtcgcatgtctctgatataattcaggggaggcagccagctgccagtgtggatttctgcattttcttaacataaaatgaaattatctttgtgtcatttctaactctgttatcagaaatggcatatatacagtttaaaagcgtgaagcaggctgggcacagtgattcacgcctgtaatcccaacactttgggaggccaaggcaggcagctaacctgaggtcagaagttcgagattggcctggccaacatggcgaaaccccatctctactaaaaatacaaaaattagctggacgtggtggtgggtgcctgtaatcccagctacttggaaggctgaggctggagaatcgcttgaacccagaagacaggggttgcagtgagccgagattgtgccattgcactccagcctgggcgacaggagcgaaactctgtctcaaaaaaaataaataaatacaaagcaagaagcaatgtttccacactctaattttgtaaattgtgaagaaagtaattcctaagacatgggagggttctcagttatcccagtttttgtgttttatgatgtcgctggtaaaaagaggagtcatttctctcaacatcatggctagcatttctttgagctctacagggttcctcctcccttttttgatgtttaaatagtatgtacttttctgtcactggtttattttgtggtattcagtttgggagacctacttttttttttttttttttttttttgagatggagtctctgtcacccaggctggagtgcagtgtcgctatcttggctcactgcaagctccgcctccctggttcacgccattctcctacctcagcctcccgagtagctgggactacaggtgcccgccaccacgcccagctaattttttgtacttttagtagagatggggttttgccgtgtgagccaggatggtctcgatctcctgacctcgtgatccacccgcctcggcctcccagagtgctgggattacaggtgtgagccaccgcacccagccctacttttttttttttttaactacaattctgctgtaagattattaggtctggttgggtgtgtgtgagtgacttctgggatgtgctggacaagaagcttgtgggtgagtgtgctttcagtgacaaggtctggctgtgttaggttgtagacactcctgggatcctggaccaccctctggaggataggaacaccatcgagatgcaggccatcactgccctggcccacctccgtgctgcggtcctgtatgtgatggatttgtctgagcagtgtgggcatgggctgagggagcagctagaactcttccagaacatcagacctctcttcatcaacaaggtgtgtgtggtcactcatgttttgcttcatatcctgcagtacgagaataatgatttcattatttttcttccttgcctagcctctcatagttgtagccaacaaatgtgatgtgaagagaatagctgaactttctgaagatgatcaggtaaatcacgttaatattttgaatatttcttacttaccaattctgaattctcatctcagacaaccaaagtttagatgaaggaattttagcaatactagtccacaattgtattttatagttgagataatatcctcagtggtttagtgaaaagacataataaaaacttagttattggcaaactaaaacgaaaacataagtttctggattctttgttcttgagtgtgtggaagcatctgtatttgatgggttggacttttggaaaatgtgattacttaggagagaactgttggagaagggtgctcacaggtgttacttcataaaacaggttctgtgattaaatgagtttggagactaatgattgagtgaaggagaaggaggatcttggaatttgggctttctggatctggatctatgagtgagacgtgcctgctagctttctccaagaggcaggcagtattgttggacataatttttcaaactgattgaatcctacaacctttttaataggcatccttcatgataaatgcttttagaagcgtgcactggtggagtggctttcaaattgtggtcctggcccagcaatgtcagcatcaccttcttaatttcttccttaatttcctcattgatccattggtcattctgggacatgtttataattctcatgggtggtttttttttttttttttacagttttgaaagtatctcttggtattgatttctagttttattccactgtggtctgaaaagatacttggcaatttttaaaaattgatgagatttgttttgtggcctaacatatggtctatcctggagaatgtttcatggactgaggagaggaatgtgttttatgcagcggttggatgacatgttctgtagatgtttggtctacagtgcacttttttttttattttatttttgttttttttttgagatggagtctcgctctgtcactgaggctggagtgcagtggcacggtctcggctcagtgcagcctccacctctgaggttcaagtgattctcctgcctcagcctcctgagtagctgggattacaggcgtgcgccaccacaccgagctaattttttgtatttttagtagagagggttttaccataccggccaggctggtcttgaatttatgacctcaagtgatccgcccaccttggcctcccagagtgttgggattataggcgtgagccactgcgcctggcctacagtgcactttaaatccagtatttgttgattcttttttgcctaggatctgtctaatgttgcgagtctgatgttgatgtccccaaatattattgaccccttttattattatataatgaccttcttgtctctttttattgtttttgacttaaaatctgctttatctgatagaagtatagctattcctacttgcttttagtttccatctgcgtagaatatctttttgcatctcttcattttcagtctatgtgtgtcttaatgtctttacaggttaagtgaatttcttggatactttttcatgttttcatgatagtgattattgtcttcgcttccagatgtaggactttcttaagtatatcttgtaaggctggtctagtagtgacgaattctctgtttttgcttttctcggaaagaatttatttctcccttatttctgaaggatagctttgctggatgtaatatagttggctggcagtcttcttttttttcttcaacactttgaatatatatcatcccattgtctcctggcgtgcaaggtttctgcaaagaaatctgctgttagtctaatggggattttcttatatgtgacttcaagcttttctctagctgtttttagaatttcctttatatttgacttttgacagtttgactataatgtgccttggggaagacctttctgggctgactctatttgggaattcttgaacttcctggttttagatgtctatacctctccccagtcttggaaagttttcagctatctcattaaataggttactaagccttttcccttctcttctccttcttgaactcccataatgccagcatgtattcacttaatgttgtcccataaatcttataggcttccttcattctttttcgttcttcctgctttttttctctctgactaggtagtttcaaatgacagagattttttttctgcttcatccagtgtgctgttaaaactgtctattgtattatctcatccattgaattcttcagctacaggatttctgtttgactcttttttacaatttctgtctcagtttaagttcttgttcatatcatgaaattgttttcttgattttgttgaattatctatctgtattttgtttctcattgagtttccttcaaaaaaattattattttgaattctctttctggcaattcattgatttccttttcattagagtctgttcctagagagttaatattcctttcatgatttcttatttccttgctttttcatgtttcttgtgtccctgcattgatgtctctgcatctggtagaacaggagcctcttttatactttcttctagagtggctttcatggagaggttttcacctcacttgggttttactgtgccatttgggaagagaaccgtgactttctggataggagcagtgacattgtttctgtgcagcttcctcacctccatgaaatgttggcaataactgggtggctcagtggcctcagctctggaagtttgtgccagcggtggtgtatgtttttaaggtccttggtgtcaggggcttttggggtcctgctattcttgtttttcccgcaatgggggacttatctgaggggatctttcttggtgtcaggtctgacatggtctgcaagcagctgccacagtgctgggtttcagctacaggtactcagggtagctgtgggactggggtcctagccttagggtcttgtgtgcctatcatggcctggccttggggtgcaggtttactctctgtggtggatctctgatcctgaagcacccctagcagcttaagcccacagggcaaggctgtggctgtggctccacccgtggggtcagggcacagtcctggcctgactccagggaagacgcactctggaggtttgagcctgggaagcagggtagagctgtacttcagaaacctgagccagtagggagggcttagtgtcagctcaaggggaactctggaccctgggatggtggggcccagcagtatcccagactctctgatgctaggtgaggtggcagcaaggaccccagaatggactagtccagctgtcatttgggccctagaggacagggaggaggacagcagtgactccatttcctggaaagagtggtgactctgcagctcagaatatagggttagtccagctccagggagcaggtgctggagctgtttgcgtggtggggcaggtgcctcggctcagcccctgccctgtttccctggggtgtggagtacaatgtcagctcctccccatggtatgtggctggtcagcctgggcctgagggttgtgactcttctgggcgccccaggcaccgttgccctgggatacaaggtacctcttcagcatagacgctgggatatgtgaccattctgggcatttcccaggaagcagggcactgcttcagctcaggcagcagggagacaacgttccctgagaggccacggtgctatttaccaggaggcagggtaccgttgggtgctagagcaagggctagtagaggggctccacctccaccaagccctgctgggaaggggtagcagctgctcacagctggcttggggatgttgggccaccaggtttgggtagtttggaggcagtttagcctcagggatgaaggggagctgtggccacttcccctgagcaagacatactccagccgcagttccagtcccaagatgatggagtatagccgccccatgggcccaacagacagggcccagtgtcagctccttctgtgtgggagcacagctgtgaggatgccagggggctccggtggtgagggctgtgggtgtccagagtggtggcagggctgctgccatcctcttgcttaccccctcaccgtagggagaacctcctcctgggtcccgttgcatcccagctgtagggtgggttgctggcggcccagtgtgttttttttggtttgtttgtttgtttgtttgttttaagacggagtctcgctctgtcccccaggctggagtgcagtggcgtgatctctgctcaatgcaagctccacctcccaggttcacaccattctcctgcctcagcctcccgagtagctgggactacaggcggccgccaccacgcctggctaattttttatatttttagcagagacagggtttcaccatgttagccagggtgaccttgacctcctgacctcatgatccacccgcctcggcctcccaaaggctgggattacaggcatgagccaccgcgcctggcccctggtgttttctttgggctgtatttcatcgtcttgcgtttttctgctccccagggtgcctgttactcctgtgatgccctctggagctccccctcagttattaacatgtagttgttcgttattctgattgcctttgttgtgggggacagatgtgaggggctactagtcggccatctttttgatgtcatttgtgttttcttgatcatagaagaatatgaagaaaataactgtttttaggatatgtctgttttttaagactttgaaacaaccacagatgttcacatttgcagcctccatttgcagaactgtacagtttgttccatagggaactggaaatgaataatacatctctcgttttttctttgcattcccagaaaatatttacagatttgcagtctgaaggattccctgtaatagagaccagcaccctgactgaggaaggtgttattaaagttaaaacagaggtcagtgctgccttaagtcaggtattagtctttttactgtctcttgtttgattcaagtcagttgtggggagaaaatagttttctttctagacattgttaacacttggagccctcgcagtagcgaggcgggtggcgtgcgagagtggggcgtgaagacagacccttctaagacccactttgccccccgtggacagtgggttgtgaggggatgctttgctcttctcaccccaaacaactttaccctaaagcagctgttgtctctggccttttaatatttcggtagcaagtacagtgaaaattatttttatggaacctgttcgaagtagaagggagaaaagtctgaaaagcagaacagcttttgcaggaggcagtccgctgctggatttcacatgctgtcctaattactttgtatttcatgttgtttttatctcaaataaaaggacatttctggccaggcgcagtggctcacgcctgtaatcccagcactttgggaggctgaggcgggtagatcacccaaggtcgggagttcgagaccagcctggccaacgtggtgaaactccgtctctcctaaaaatacaaaattagccgggcgtggtagcgcatgcttgtaatcccagctactcgggaggctgaggcaggagaatcgtttgaacctgggaggcggaggttgctgtgagctgagatcatgccactgcactacagcctgggcagcaagagcgagataccatctcaaaaaaaaagatggcactcctgatgccatggtcgcactcaggatttaaaaagatggcactcctgatgccatggtcgcactcaggaatttgttgctcggttagagtcctgaggggcaacattgcctccggttcgtgaagggcagttggagggcaccgtctgtgcagagggtcactgtggtgggagagaggcccaggcactggagatgcaccttccctcagggccgcttccacctgggcctcagagaatgtggccccctacgtgttagttaccttgagggaaaaggctcagtggctctgatctgtggctcctcctggaacctgtagctggaggctgctggaggatgcgtttgtgactgtgccttcttttttacgttattaggcttgcgataggcttttggctcatcgagtggaaaccaaaatgaagggaaataaagtgaatgaggtgctgaatagactgcacctggctatcccaaccaggagggacgataaggtaagacggcccctgggacagccgtgggctcacagtactgtcagcaggtgctgtctgcgtgccttttccagaagcctcccatccagcttcacacactcgcaggtggatattgtgggtgggcctcagtttcaccttcttgcttacataaaggatcgagaaggtgaagaaagtgcagaacgccacatggcacccgtttcccactgcatgacgtggtcactgttagtttatccttccagaaatgtttctgatatagaagattagtttctaaaaagttctttaaacacagatggaaatctgtttcattctttaaattttcatttttttggctgggggaagtagctcacgcctgtaatcccagcactttgggaggccaaggtgggaagattgcttaagcccaggagttcttgaccagcctgggcaacatagtgggaccctgtctctataaaaaataaataaaataaattttcattgttttgtccattgtgaatgggcacacatcgttacgctgtgtcttcatgttttactgcaaatgtgtctgcacttcaccatgtggtgttgacaacgttcctgtcccacagacgccttcctggtgtgtgctgcactgacgctggaggctgtgtccttccctctgtctttccttgtgtcctcggcgtggtcgggcactgactgtcagtcttgtgtaaagatgattttattgttgtgtgtttatgtaatgctgggtgcggttgagcatgtttgtctgcttattggccttttcaaagttctttaggctgtttatctttttctcgctgatttgttacttttgtattacaaaggttggattcttgtcagatacattgcaaatttttttctctttttgtcacttgcctttttaacttcaaatgtgctgtacatttttgaactattaacatatattaatttttttttctgggtgttcaggtttgcattgtacatagaaaggcttaccattcattccaaagtcattttaaaagtatcttttcttgctgggtgcagtggctcacgtctgtaatcccagcactctgggaggccgaggcgggtggatcacctgaggtcaagagtctgagaccagcctggcaatcatggtgaaaccccatctctgctaaaactacgaaaattagtcgggcgcgcacctataattctacctattcaggaggctgaggcgggagaatcgtttgaacctgggaggtggaggttgcagtgagccgagatcactccactgtactccagcctgggtgacaagagtgagactctgtcaaaaaaaaaaaattatcttttatactagcattaaaaattagcttttttggatagtcttcaccgtgtcttgagttggttatgttgtgagggtggaggttgcactccgtttcaagtggtcggcatttctgacctgagtattggaaattttatgtttccattgaattcttatatgcacttgagtttatgtctaaatttctttcatctgttgatccagtgttatttcttaccactttcttcttccataatttttcatgataatcatgatttctgtttttcctggataaactttggaatcactttgtggagtcctcctggtctctgtgctcaaagtgaccctgaacccactcctctcccctaaaataatctgttggttgttaattggtctcggtatgaacccactcctctcccctaaaataatctgttggttgttcattggtctgggtatggttttctgttccccttgcacgtagggaatttgtttctactttttcggctttgtaagtttctcattcagcaggcatttcacataaatattttatatgggatcttctcaggagaggccccctttcatccctgaaggagtggtggctcgcaggaagaggatggaaactgaggagtccaggaagaagagggtatgctgccgaagctctcgcccagtgttctcatggggggaggcaggctgtgtgtgcccatcgtgggggcctggggcatcgaacaggagccgcgggtgcccagacactggccccgtcaggctgcggacacagcagtgagtccccctgcagaagcctctctcatggggctctttggcctgagggaagatggccgtgaaccaaatgcatgagtgggatagacagtccccagatggccagaaacagcctcttcctaccagaacctaaaggccggccccacagacagggagataagaaacagcctcttcctaccagaacccaaaggctggccccgcagacagggagataagaaacagccttcctaccagaaatggaaggtgaaccccactgatactgagaggattggagaaaagattgtttcaagtgacaaggggcagagcatttctggatctgaaaggcaaaatgaagctgatgataatttctctttctattgcaggaacgagatcttgagctggaaatgggagatgattatattttggatcttcagagtaagggccagagtgtgatcattattataaaatgccaattggacgtgaagtatttcagaaaatgggggaaagactttaataagtaataaaagtgtttcagcctatttgtcaacttttaatttcttgaagattaaaagttgcatcctgagggccaggtgcagtggctcacgcctgtaatcacagcactttggatcccttatgcccaggagtttgagaccaacctgggcaacatggcagaaccccgtctctacaaaaaatacaaagattagccgggtgtggtggcatgtgcctgtagttccagtgacacgggaggctgaggtgggaggatcacttgaccctaggaggacaaggctgcagtgggcagaaattgtacctctgccctccagcctggacgacagagtgagactctgtctcaaagaaaggtgcatgctgatagcactcagtgggggttcttccattgtttcctgttgttttgggatggtggggtgatttctgtagctttctccacgtgtgggtgttgaatgaggctgatgtgttgtttcctgttgttttgggatggtggggtgatttctgtagctttctccacgtgtgggtgttgaatgaggctgatgtgttgtttcctgttgttttgggatggtggggtgatttctgtagctttctccacgtgtgggtgttgaatgaggctgatgtgttgatgctgctgcatgtggaattgcacgtcgtgctctcttctgcagtggagtcgttgatttgccgtcagtcacaactcattttgcgcacgtagtacttgaagatattaaaaactgctgtaaacgtaaccaccttttttttaactttagagtactgggatttaatgaatttgtctgaaaaacatgataagataccagaaatctgggaaggccataatatagctgattatattgatccagccatcatgaaggtttgtgtcactttttaaattgcggattgttttcctttttattatagtagtattgctggaagatagcagcatggcttcggctcagctgggcctgtccgcttcattctgcacccctccatcctgactctgccccctgtaccacttccccaccctgagactctggtggagatactggccctggctgggctctgctatgctggcctgcccccttcccgccgcctccacccacccaccccggacactctggtggagatgctgggccccttcgttatcctgcacccctccatcctgactctgcctcctgcacctcttccctgtcccgacactggtggagatgctgggccccttcattctcctgcatccctccatcctgactctgccccctacaccaccttccccaccccgagactctggtggagatgctgggcctcttcattctcctgcacccctccatcctgactgtgcctcctgcaccaccttcccccccaccctgtgtctccgccaggccctggatgggctctgctgtgctgggcccttcattctcctgcatccctccatcctgactgtgcctcctgcacctcttccccccaccccgagactctggtggagatgctgggccccttcattctcctgcatccctccatcctgactgtgccccctgcaccaccttccccaccctgtatctccgccaggcccttaatggactctgctgtgctggaccctcttccttgggggctccgctgtgtcacatctttttcctgcctcaatcccctccctacttgctttttcttagcatataaaagtccacaagttttactcatctttttaaaaaacgaaaacatccttagaccgtgtcctccattagttgctatcctgccttcttctctcagctgagctgtctgaaacatgctaacatgcttatacaatacttgctgtcctgccttctgctctcagctgagctctctggaacatgctttttatacaatacttgctgtcctgccttcttctctcagctgagctctctggaacattctttttatacaatacttgccatctgcatgtcccatgttgccactccttggttcccacaggccctccgtcattgagttcacattttcagtctcgtggtctctgtgctccctgtgcctccatagcagattctgggatagcagattctgggggcaacaatctcaatttcgttggtgctggaggagtggcctcagggcatctgctgtcacctctgctggggccccagtccagcccgtgccctcactgtccccgcggtggccgcctgccttcccagcctcttcccctctgcagtgcgcgctcttgggcgcaagaagccttgagacttccctcctccgcacagctgtgcccgtgccatccccttccacgaggcctggcccccgtctcaccctctgcactgctggccagcatctcgtacaggcacatctgcctgctgggctcctggccgggttgcctcattggggggtgataaacgtgtgtgttttagttttcatttttgtcttatttgtagccagtgaggttgtatttggggtgacattagaacggacacgtgggatgtggcacgaaatcagtgtctcaggactgagttccttgtgtgtgtctgccgggagcattggaagtgaaggaggcggtctctgcacatttttagccttggaatttaattgttttaaaaaaaggaaatggtgcacaggggttactgacttgctggcggctggcgttcacgtggtctccattttcttcacagaaccctccctgtgaggtaaatggcacataggcagggcccaggtgggtctggaccagggcaatcgctctcctctgagtcagggaaacaaagctcccatacacactctgccacactcactgactcaggggttttctcattgttaattttgcttcattacaactccatttttaaagaaattggaagaattagaaaaagaagaagagctgagaacagctgctggagagtatgacagtgtatctgagagtgaagacgaagagatgctggaaatccgacagctggcaaagcaaattcgagagaaaaagaagttgaaaattctggagtccaaagaaaagaatacacagggacccaggatgccgcgaactgctaagaaggcaagtttgtgtctttccaaagcagtgtgatctagtttttgaaaattggattcctgtgtgatcattgctaaataacaacttttcaacccatttatggccataagattgcacattcttgttttattggtgtatggatttgcaagatcgctcacgtattgatcttttatattctttactgcgtcctttcttggtgactttcagcttcgagtttggcactactctagatccagtcattttgcagttgtacagattaaaactgtaacttatggttcacagacgttcaaggctatcagtgaacattttcctcttcttttttctctctctcttttttttaggggggagatggagtcttgctgtgtctcccaggctggagtgcaatggcgccatcttggctcactgcagcctccacctcgcgggttcaagcaattctcctgcctcagcctcccgagtagctgggattacaggcacctgccactacgcctggctaacttttgtatttttagtggagatggggtttcaccatgttggccaggctggtctcaaactccttacctcaagtgatctgcctgccttggcctcccaaagtgctgagattacaggcgtgagccaccacgcccggctggttttcttgttctttaatttctgcattaaatctggactctttaggccgggcgcagtggctcacgcctgtaatctcagcactttgggaggctgaggtgggtggatcacgaggtcaggagattgagaccatcctggctaaaacagtgaaaccccgtctctactaaaaatgcagaaaaattagctgggcgtggtggcgggcgcctgtagtcccagctactcgggaggctggggcaggaaaatggtgtgaacccgggaggcagagcttgcagtgagccgagattgtgccagtgcactccagcctgggcaacagagcaagactccatctcaaaaaataaaaaatttaaaaaaaaatctggactctttagcaatttacagaaacctgacgcagtctacaaaaggcaatttattggctctgtggcagggtgggactgggggaagaaagcccacatgcagggcagttaacatgtaaccagagaagtcacttgacattcaggatgcctctcagtgggtcttcctgtttgaatacactgttttcacatggtggcaagtgactggttatggcggacttggacatttttgtacttctccaggtggggctcagccatctctgggaggagagaggttggcgcactgcctttgtctgaggccacctcactaacctcagctttagtgtctcacctctgatggagacggtcactctctcccccgtgttgcggtgaagaatggacagacgtggaggatacgctgattcttcccacagcaactgctctgttaatgttagttttcgtgggatttaattgagctatccaaaaacatgaaagcggggcccaataaaaattacaacttctaaaataagtatattataattgttgcaaaatatgtatacatatatattgccttgaagtttttttcaacatttcatcaaactaatttaaagctaatatttctttttatccttctcaggttcagaggacagttttggagaaggagatgcgtagtcttggtgttgacatggacgataaagacgatgtgagtgtgggggcggttcatgtgtttatgtggctggatacacctttttaataaagaaaactggccgggcgtggtggctcatgcctgtaatcccagcactttgggaggccaaggcgggcagatcatgatgtcaggggttcgagaccagcctggccaacatggtgaaacccagtctgtactaaaaaaaatacaaaaaattagccgggcgtggtggcgtgtgcctgtaatcccagttactcaggatgctgaggcaggagaattgcttgaacttgggaggcagagattgcagtgagctgagatcgtgcccctgtactccagcctgggcgacagagtgagactccatctcaaaaaaaagaaagaaagaaaccagggttttggaaagccgtgggaacgtgggaaattacagcaaaaagaaatgagagcttccagtttttctcttttgagattcgctggccctgggactgacttgaagtgatgggttgaggattccctgaccctgggtctgggttgaagtggtggattgaggctgcactccagcctgggcaacagagcaagactgtgtctcaaaaaaaaaaaagctccacagccagcacgagacagcaccatgacgtgcccagggtgtggctgcagaccctgtcctctagatgtgcagtctgcagtttccgtctgatggtttctgtctgatggttgtccctttgtgttcatatcagtaacccccaaaatggggcagtgagggagagagcattgtttatatctgaaatataaattgtgatgctatactataataatcacttttaaatgagagttctaagtttctttaagtggagttaaaatcagctttcttacgtaaagcagcttccgttaagtgaataagaatatttgaccaacaactaatgtgaaattgttactaatgtgaacttgaaatggtgtcactaatatgaaaatactgcgtgtattttcaagacctttagcccatgtgttaatggttcagacgctcctctcctcccctcttgctggagtgacctcatgcctgtcgctgagcctgggtgcggggctggggtcctgagctctgagcctgggagtggacctggggtcctgagcgctgagcctgggagtggacctggggtcctgagcgctgagcctgggagtggggctggggtcctgagcgctgagcctgggagtggggctggggtcctgagctctgagcctgggagcggggctggggtcctgagcgctgagcctgggagcggggctggggtcctgagcgctgagcctgggagcggggctggggtcctgagcgctgagcctgggagtggacctggggtcctgagcgctgagcactgagcctgggagtggacctggggtcctgagcgctgagcactgagcctgggagtggacctggggtcctgagcgctgagcattgcttcccctgctttgcaggcccattacgcagtccaggcaagaagatcccggagcatcactaggaaaagaaagcgggaagactctgctcccccgtcctctgtggcccggagtgggagttgctctcgaactccacgtgacgtttctggtcttagggatgtcaaggtcagtctctgtgttgtgtaatgtaataaaatgacagtctctgttgtttattgcacagggttcagggcaaacaccagcagttgccatttgcaggaactatggcaggggttgtgtgtactgcatgccctcgttttgtggcatcctttagaggagagcacgggtcagggtgcaggtggatgcccctgacagctgccctggatggacccctccttggcactttgcttttgcggagggtggccagagcatggtctgacagcactagcagtctgggcttagaccctgctgtctgaagagggccaggaagtggccacagctgagcaccaggaggcctcaagtccagcaagccccccatgggaggaacagcagagggaactcctgggttgattggcgggtgatcctgctcatccttaggttgcaggattgttccccccaggtggagagcttgagtcacatttagtttatttgtagcgtcttttggcaaagacacttaagatggacacagtctgtcttgctgaaacgtccttttattaaacacaacaacttttagtttcagcgttgtggtaatggagatgcaggagagtctgtgtataaactgcagtctccttcatggaagcctgagcttcactcctctgtgccattgccatcttgaaacctggctgttaatattggcattgccacttgtcagtcagacctgaggaaaacaggttcatgggcctgagtccttagcttgtgtaagagggagttaaaacagatgtgtgctaaccttctaggtctaaagtgtatctagtcctgggtataaagcttgtcctgggtatgattttcatccagtctttatacaaaaatactcattgagttcctgcagataactgtgctgggcttaagagaaaagagatgtaacagggataactgtgctgggcttaagagaaaagagatgtaacaggggtaactgtgctgggcttaagagaaaagagatgtaacaggggtaactgtgctgggcttaagagaaaagagatgtaacagggataactgtgctgggcttaagagaaaagagatgtaacagggtctcttcgctgagcagacctgagccattaaacagattgttacccagtagttgaaattcagaatggaaaattggttttaagtaatgaacatactttatttttttctcctccttttagatggtgaagaaagccaagactatgatgaagaatgctcagaagaagatgaatcggttggggaagaaaggggaggcggatagacacgtgtttgatatgaagcccaagcacttgctgtctgggaagaggaaagctggtaaaaaggacaggagatagtatccgtttggttggcgtggcttcgctagagtgttgctgtttatttcctggtttggcacagtatggtttcatgaaattggagctctgtataaactgaaaaagacaaaataagtaaagcacttgttgctttgctgaaaactatggttaaccctatataggtgtgggaaatttttgtcactgcataatattacaaatattttgagtagacagtgtttccacatttaatggagtatcagttgcttcagattttcagaactgggaagatttactggtttaactaggttgtttttgatggagaaaaaccttattttcttttgtaagagctgggagcaaacacgtttatgagtgtgtcggaatcccgtgcttaaaatacgctcttaaattattttctagtcttattttacaatgtctcattgtagtctgtcttcaactattttatccaaaataaacctccagaagaaagtagttttcatttacttagctcatgttttggtttagttatagtcgctatggatttggccaaataaaaaggcaaacaacatgacatttctattttgttttaaagcaaaaatacttttgggggagtaaaatgttgctggaggcattaggcaattaaatatgggcattctcctatttctgtggcccgtccctgaagttacatgttcagtaaaacacaaaaacaccgccaatgccacctcaaaagcacctgctggggagcgttggggtgaagagctgtggggtcggagggacctgcccaggggtccgtgtgctcctggagctccaaagacacacaggggtccaagagccaccacggataagttatcaagtcacacaatcaacattatagctgaggaaaggactttagttaatcacacttctggattacatgtggcaattttaaaaatttaccagggctgggctgggcgcaggggctcaagcctgtagttccagcactttgggaggccgaggtgggcagatcaggaggtcaggagttcgagaccagcctggccaacatggtgaaaccccatctctactaaaaatacaaaaattagccatgcgtggtggtgggcatctgtaatcctagctgctcgggaggctaaggcaggagaattgcttgagcccagaggcggaggttgcagtgagccgagatcgtgccactgcactccagcctgggtgacagagagagactccgtgtgaaaaaaaaaaaaaaaataccaggtctggtttttgaaattctttctccgtattaaacaccaaaacttaacatatagtttactttgtgttaaacaacaacagtatggccgggcgcggcagctcatgcctgtaatcccagcactttgggaggccgaggcaggcggatcacgaggtcaggagatcgagaccatcctggctaacacggtgaaaccccgtctctactaaaaatacaaaaaattagctgggtgtggtggcgggcgcctgtagtcccaactacttgggaggctgaggcaggagaatggcttgaacccgggaggcggagcttgcagtgagccaagatcgcaccactgcactccagcctggtcgacagcgagactccatctcaaaaaaaaaaaaaaaataccaggtctggtttttgaaattctttctccgtattaaacaccaaaacttaacatatagtttactttgtgttaaacaacaacagtatgttttaaagcaagtatgtctttatttgtaagcatattactgaaacgatcaaatgaacagaagtggataaacgtcgagtcacttggctgagaccatacgcatcttccgtactgcttgtattaggatgcaagattgaatgtgtcttttttttaaaaatgcagccttgtgttgcactctgaaataagtgatttaaaaagaaaaacatgatacagagatcccatcctgaccttggaggcttggataaagctgtggggagacagcctcatggtccagccaggctagtccgcctgcttcaggactctcaagatctccccaagactttcaggatcagctgctgttaatcaaacaagtgcttataaaatggaaattgggacaaaggaaatgttaaatttcctccctgcaaccaggcagatgagaaatatggaaataaggaaaagggaaaatgaagatatgacaaagttgatgaaaaggttgaaatagtgatttatacatgatgggcaatcaagtgccccttttgccctgttttttggagagggtgtatcattgcctcaatggtgcgtctgcctgcactgagggcattacacatggctgactcgacctccctgcctctcacactctgtgtattttgtgaagctccacaaacggggtcacgtcatccaggtgaggccaccaccggtacagaaacctctcggcaatggttcttagccagggggtgactttgacttcacccctcgcctccctctccagcagctcccacagctcctcctgggacaggtagaggatgcttttcgtttcactgggatccgggttcagagtgacgtttttcctcacaagcagaaggtaacaaatttcatgctctccccaaattctgtctgattttgccttgtggtgatagattgtcatgaacacaatgtcctctggagaaatctattgacagaaattggtgcagtgttaacaacgctaatgtaaaacacagaatttacagaaaaatagagaaaataaacacatttgttttcctcagaaaatgaacactttctttggtaattgataatttccaaaacctcgattttagctaagtaaatttttgtggactcaagtctgaatgataaaccggctttggtttcttggttccagtaaacctgtctgtcttcatttaaagaactaaccgtgtcacacacacatcctcaacagaaaaccccgtagaaaccggctagcgttgtcaggagaacatccatcctctcttaaacgtgttcttgagtggatgaaggtaacacatgctcacaggatcctggacattctttctacacttgaatttctttcttttttttttttttgagatggagtctcgctctgtcgccaggctggagtgcagtggcacaatcccggctcactgcaacctctgactcccaagtagctgggattacaggcgtgtgccactacgcccagctaatttttgtacttttaatagagacggggtttcaccatgttggccaggatggtcttgatttcttgaccttgtgatccgcccgcctcggcctcccaaagtgatgggattacaggcgtgagccaccacgcccggcttgaatttcctcttcggtgtgtggtcgacagattcctgcacagtctcaaccctgcctgggacacatagggactcacactgccccatccacagctacattcacagccccattcacagccccattcacagctcattcacagccccatccacagccccatccttcatcctcatggtgcttcatgaggtcaatggtgtagatccagcctggactttgttcaccgtctgcccgctgccaacctggactcccgtggacacagctgagactggatgctgtgtgtacctgctccccaggaattcccagctctgcttgcagacgcctctgggctgccctcctcactccgatggcatccttttcttccagttctgctgggttgtataatgggtggctactacaggagtcggtaaaataccctggaaaaaatgcatgtgggaacatccctctttattcctgaaaagtgaatatattaaatacaaatgcagatgcttcatgtaaaaccatcatccgtcatcagcagaagacagcctggcggggggagtgggtttgtcatgggctctcagagcagcactcgcctccagcctccacggctgtgggcttggtgagggtcttccacatgaccacctggcggggctggccctgaccgctcctgcggcccttcctgcagatgtgcacacacatgtcccgtggcactatcccagtatgtcttaggagagggactggttcctactcagttttgtacccacagaggacctgagatgccatggggtggcgggaggaggtggtggggctgtgggctgggtggctgcaccagctgggctgaggaagctgggctgcactttgagggtggtgatcagtgagcatggtttcacaggaagactgctggaatacctttgaccaagtttccttactgagaggttctacttaatttacccaagtaacagcaatagcgctatgacgggaggtcacactctcctcagtaaatctctgttccctctcgttcctcagaccctcagtgcttccttcggtcactctgcaaggagtttggctgaagttgaatccactcttgcaagtacaagagctggtactcccacctgcccctatgtatcctggaggcggctaacacatgataggaaatcttagctccaggggctttatttgcaaactgttgactatgtactacagttgaccctcttaactttgcagctcctgaatttttctgaaacaaactttgcattcagctccatcaaggagcccgtgagtacaacttgaccagcaagtatggtggtgggtttgggaatgggcaggatgtacccactgcggctccgaggaagaactaagggaggagaaaacctcggccacagctggccgtgcttagccattcgctttaatggctcaggcaaggtctggttttgaaaatttgaggacagcctaggccaaaacactttaaatgaccacaattgacgtaaatgctgttcccctctaaaaaattttttggccgggcccggtggctcacgcctataatcccagcactttggaaggccaagacaggcatatcacgaggtcaggagatcgagaccatcctggctaacacggtgaaaccccgtctctactaaaaatacaaaacgttacccgggtgtggtggcgggcgcctgtagtcccagctacttgggaggctgaggcaggacaatggcgtgaacccaggaggcggggcttgcagtgagccgagatggcgccactgcactccagcctgggtgactgagccagactccatctccaaaaaaaaaaaaaaattttaagttgtaattttaagaagtacaagataattaaaactctaagacctgtaagataatttttattattattacctagttaattttatgctaaatgctattttaatcccctaaatccttaggttgataaattcctctgcatttaagtaacttgccgttgcaaagaaacaacaaaacaaaaaaacccagaaactcatatagtttcttacttttttaaaaaagaaaacccagcctactgaagagctatcagcataattagcatctgcctaagctgccgattttctgcaggatgagctgccagctcaccacagtgcggcactgagcaccagagagttcctgtcccagattcctccggtcaagtcacatgagatgctctcttcagtccggggcttggttgaacggactcaccaggaaacgtgactttcgtgtccgacctctgctgtatcaggattcgattcttggtgttaaacaagacaacgctgaaggctcggtgcagcagccctgcaaaggtaagtgccatttgtgtgagtgcatgcctggagtctgtacgattgtccttcgtgctttttgtcctcagtctgtttctcgtagaaaagcctgtgattgtggcacctgggcagggcaaaggggactgctggatgcccaaacacaacgtttcagaatctcagcggattagaacactcgggaaactaaaaatagatctaccagatgacccagaaatcccactaccagggcaaatatccaaaataaaagagatcagtctatcagagagatatcgcagcattcctgggtgctgagcaccatttacgacagccaagatatgagatcaacctgtgtccgtggaggtttgaagggttgaaaacatgagggttagatacacagtggcataccattccaccacaaaagaagaatgaaatcgggccgggtgcggtggctcacgcctgtaatctcagcactttgggaggctgaagtgggcggatcacgaggtcagaagatcgagaccaccctggctaacatggtgaaaccccgtctctactaaaaatacaaaaaaattagctgggcgtggtggcaggtgcctgtagtccaagctactcgggaggctgaggcaggagaatggcatgaacccaggaggcagagctggcagtgacctgagattgcaccactgcactccagcctgggcaatggagcaagactctgtctcaaaaaaaaaaaaaaaaagaagaatgaaatcctgtcatttgtagcaacatggatggaactggaggccattgtgttaagtggaacaaacctggcacagaaaaacaagtatcacatgttctcactgctatgtgggctctaaagaagttgatctcatggaggcagaaaacacaatgctagacaccagaggctgcgaagggcagtggggagggatgacgagagggtggttaataagtataaacataccgcgatagagaaggaataatatcagctgttcaatagcacagtagggtgactgtagttaacaacagtgtattatatgtttcaatgtggctagaacagaggatttggaatgttcccaacacaaagatatgatgaatgtttgaggtgatggatatcccaaaatgccctatttgatcattatgcatgacatggtggtatcaaactatcacatgtaccccattaatatgcataattattatgtgtttataaaaaagacacaaaaatgaaaattaaaaaataataaaatggcttaagatggtcaaagaaaaccagagctggacaggagttaaagcaggaaagtctgactttactgagaaccatttcaataggggaaagagacctccatggagaaccagcctaactgcacacaacacccaaggagcaggctggggcctatggattaaaagttactaagagaaaacatcagtgggaagggggttctggctacaccgacctaacaagacctgctgaagacaggcctgcgtgatcagacgtcacctgggagggacggggttgaggaatttaatcagatgccaaggtcagggttctcgctaaaacaacctggtagaattcttgctgaaacaggatcttacgaggaagagcacggatgcctaggagaaggtgcaggagcctgacaagggcttgaccaagcaaagacgtcatccaggtgctgctccccgagccttctaaagacggcacagcaagcacacaggtgacccagtggtcgcctcctagccggaaaggcctagactctcttcttaggttgccgtcgggtgggaaaaatgggaaaaccctgggaactggacagagaaaatgggcgggggctacctttctcaatgttttcgttcagatggcaattcctcttggtgtcggcaccaataaccttatcattctcatccacaacaatcagcatttcctccaagcgctgcaactgacgcctgtcaacccagtcaagatttatgtcagacatagctgctggctgtgacccgacctgaaatagatgcacacaaatgcctctttatgtgaaagatattgccatctcgtttttgctatgtgttaccaaccacattaggatttagcatacaccttctctacaagtgacagcaattgtgttgaagcagcacagttctgagatatggaaggtgaatcatctgtttctaatgtggtgtctctctgaacgggaaatcttgggtacatacatactcctcatgttttccaggtttcctttagtgacgagttaaagaatccccgccccaccacacacacacacacacacacacacacacacacacacacacaaaacacaccgaggtaaactgtaggtaacactctttgtacaagtttttggggaaaagtgcagccctgtgcaaaaccactggacctggatcagacgtggagaaacacacagccttgtaggaaagctacgtcacccacagaagggctatggtcctcttcagagccaagcagattcttaggtgaagatcttctcacaaaatgttttcagggccaggagcggtggctcacgtctgtaatcccagtactttgggaggccgaggtgggaggatcacttgaggtcaagagtttgagaccagcctggccaacatggtggaaccctctctctactaaaaaatacaaaaattagccaggcctggtggcacatgcctgtattcccagctactcaggaggctgaggcaggagaatcacttgaacctgggaagcagaggttgcagtgagccgagatcgtgccattgctctccagcctgggcagacagagtgagactctgtctcaaaaaaaaaaaaaaaaaatgttttcagggtcatttatcttcatgtaaaaccttctcatcatccttttctactttttaaaaaaatgcattcacgtctgtccattatcattactgttaatattttcagcaatctgctcctcctctttgcaaaaggctgtttgacttaatgcatggacatgagatacaatagaaatgcagagaaaacaattactgaatatgtacaaatttagatcataaaagaaagaattcccacaaggtaaaacatatgcactaacctctcttggaagctggagactcctgggtatcagatgtggaactcaatgtgcaagttgaaccagggcccttttataccctggggatgtagaaagatatcagctaaggcaatctgatatttttgtattcttaacaagaaaacacaccccggtctctctctatctctccatctctttctctctatctttctccctctcaattgagggataatagaaaattgttttgacacaatctcactttaaaaaatgcttttagtttttaaacctagggtaagttattttctactctatggctttctttttttttttttttttaaggtgatgtctagctctgttgcccaggccagagtgcagtggcgtgatctcggctgactgcaacctctgcctcccgggttcgggcgattctcctgcctcagcatcccgagtagctgagattacaggcgcccgccatcacgcccagctaatttttttgtatttttagtagagacgaggtttcaccatgttggccaggctggtctccatctcctgacctcaggtgatccgcccgcctcggcctcccaaagtgctgggattacaggtgtgagccacggcgccgttcgatggcatctttttaattcacttgctgtatatatcatcccagattttaaaaagaaaaaataaaggtggcaaatggaagagaaaaataataaacattgtgactaaaattactgaataaattcttaggatagctgaaaatcgataaataaatgcaagaccttggaaaccaatgtgtttggaagagctaaaaaactgtataatttcttgcctatcatattccaaatatcatctaccaactaaagctctaggccaaatagttttgcaagtagggtctcttaaaatatcaaaaaaatgtttgccatatctgtcggttctctcagggaatatgaggagagaagcacgatggacgcatgactccgctgactttggcacggataatacagaacaaaaataacacagcagcagtgatgggtaatattctataaaaagattaatgtgttttgctcttttgtctttccataagttcacctttatgcatgtaatttttagttacgtagaaaatcaaaaggctatgcctgaaatgttttccctggaaatcagttctgagactcaggaataaatggtctgtttgaaacttgtttcttttgcagtcagaagagtaagaatgggagaatgatactcttttaaagatctaaaaaataataaataagtctatgaattaggctttgaggaagaaactaatatacaataccgtacctattataatccaacaactctaatagtaataataataatagtaagacagccagacacacattgtgtccttcctttgtgccagtttctattttaagagtttaatgtatattaattcatttgatcctcacgacagctttctgagataagcgttattttttattatcacagcatcgataaggaactgaagcacagagaggtaaattacctgcccaaggcaatgtggctgcagatgcagctgagcccccagaatctgtgcagtttaacatgttgggatcgtcaccaccaaactaagcactgaaagctttagaggcaaatgttatcaaaatttcaaggaaggaattgtcattctctgtaaaatgttctaggggataaaaaaggagggaaaccctttgctaggttgatctgggtacaaggttctgacacataaagcacacaaaaaacattataaaggaaaggaaggaagacattttgattaggctatatgcggagaattttcttaagagaggttatgacaactttaagaatgacagttgatgacctataatgctgcaggtaggaggttaagaataaactctaggaatagatgattacatctgattaaggcaaattagaagcaacagaaagggctctagatatcagtgaaatatagagaaggacatggaggccaagactgggaaaagcaggtaaaaagaaatggaagtggaaagagttaaaaaggagtaggccaagtattgtaggtatgaaagagagggtaaaacaaatacagcatgtgctaaaaggggtatccttgaacaagagagccataataataaagaaaaatatcccagacacacaagatgacttaaacccacagatggaaagggcttgccatgttccagaaatactgacacattatcgtcgacactggggtaaacttctcagatctctgagaaaactgctgcatgcagaagagaacagccactcccaacaccatcactccatctcctaggcattgtacaaccctaatcctctgctttccacctagaatgatgggtgatccatgtacttaccaaaagtcacttcttgggtcaggtgtggtggctcatgcctgtaatcccagcactttgggaggctgaggcgggtggatcacctgaggtcaggagtttgagatgagcctggtcaacatggtgaaaccccatctttactaaaaatagaaaaaagggccgggtgcggtggcttatgcctgtagtcccagcactttgggaggccaaggcaggtggatcacgaggtgaggagatcgagaccatcctggctaacacggtgaaaccccgtctctactaaaaatacaaaaaaattagccgggtgtggtggtgggcgcctgtagtcccagctactcaggaggctgaagcaggagaatggtgtgaactcgggaggccgagcttgccgtgagcagagatcgctccattgcactccagcctgggcaacagagcgagactctgtctcaaaaacaaacaaaaaacaaaaaataacttcttctgcagcagattcacccacagtcacctactcaaagacatcgtccagcaattttccctttttcttctctatcatcacgttttctctctctctgttggaattctcctatcagtctgcaagcatgtgactatgatttcatttaagtaacagctagttttttagacctcatttgcccagcaagctactcctttgcaggaacactcttagaaaacttccttcatgctcactatatccagttcctttctctaatatttctcgttccttttctcacgtttaaaactatcaagtaacttaacctaaattgttaagtacaattgttgagctgttcaaattttcaactcctgtcaacaaaattccaaagaacaagcttctaagataagcacttcctgatatttgataacataggttaaaatttctgtaaatatcttaagagattatactcaaatccatatgttggaaaacggtgatgaataaaattttggcagtgaggaaaataaaaataactttccataatagggttatttttatctatataaatcaagaaagaattaacactttagcaatgatcagaaaagatgaggcccttggtattactgggaaaatttggaagagataattaatttgggagagcttctagaacaagtactcagaagtgttcaataataagtaaaatgacacatatgtaattgatgtcttaaggctgatgacagcagccctcctaaatgaatctgcagtttgctactaaatccatacaattcgcctcctctaatatatacgtattttgagacggagtctccctctgtctccaggctggagtgcaatggcatgatctcggctcactgcaacatccgcctcctgggttcaagcaattctcctgcctcagcctctcgagtagctgggactacaggtgcacgctgccacccctggttaattttttttttgtattttagtagagatggggtttcaccactttgcccaggctggtctcaaactcctgagctcaggcaatccgcctgccttggcctcccaaaatgttaggattacaggcgtgagccactgcgcctggacctcctccaatatttggccaagccacgcaatctttaagctcccatgtctgtccatgattgtaggtttataatttggaacttcggttatttaattaattaaaaatattcagatatatcctgcaaataaatacaaagtttttgtactcagcatctttagtgcactttcccacaaggagttgtatgtaaatgaaaaaaatagataaatgcaagcatgtaaatcaactcctattattaaccatttacttagctcaagtttatttacacctgaatgaaaagttccatttgcatcaaaaatacattcgtatactcttaaggcagtgtccggcgcagcggctcacgcctgtaatcctagcactttgggaggctgaggcgggtggattacttgggcccaggcatccagcctggacaacaatggcaagagccatctctacaaaaaatacaaaaacttagccaggcatggtggtgtgcacctgtagtcccagctactctggaggctgagatgggagaatcgcctgagcctcagaggtcaaggctgcagtgagctgggattgagccactgtactccagcctggattacatatatttgtatattcctaaggcacataatggacctaggtcaccaaaactaaaagatattctagaccaaaattttgaatgtaatttaataaccttgtacaaaccctctacagctgcacattaccaaagctagtatcactgtacctagtggcttactgcctcattcaattgaaaagatcaaactaattcaatcctgctctccaaagaacactttttctgaatgggctctcagacttttcctgaatgggctctcagattctgctttcctaagaaagtgtgttgaggtagttctttttctgaatgggctctcagattctgctctcctaagaaagagtgttgaggtagttctttttctgaatgggctctcagattctgctttcctaagaaagtgtgttgagctgtagttctacagcattgttcaatgcaaagatagggttggctgtaggttttcagaaggtgacctttatcaggttgaagaagttcccttctcgtcttactttcttgagattttatcatgaattgatgttgagttttgtcaaatgttttttctgcatttctactgaaatgagtcttgtgtggtcttttcccctttattctagcaatatggtgtatcatattaattgattttcagatgttaaactagccttgctttcttgaaataaatcccacttgggcatggagaatattctttttatatgttgctggtttctgttaatattttaagatttttgtatctggattcgtgattgataatagttattcttgtaatatctattataaatagttactgtgtggcttggccaaatactggaggaggtgaattgtatggattcagtagcaaattgcagattcatttgagagggctgctgtcatcagccttaagatatcaatcacactgggcgcagtggctcacacctgtaatcccagcactttgggtggccgaggtgggtggatcacaaggtcaggagttcaagaccagcctggccaacatggtgaaaccacatctctactaaaaatacaaaaattagccaggcatggtggcaggcacctgtaatcccagctactcgggaggctgaggcagagaattgcttgaactgaggaggtggaggttgcagtgagctgagatcgtgccattacactccagcctgggcaacagagcaagacaatgactcaaaaaaaaaaaatatcaatcacatatgtgtcattttacttattactgaacatttctcaatagaaatctttttgctatatttgagatatcccgttttcttctgcatatgcttttgggaggtaggataactaaaaatattatatataaaatataaaataacaatatataaaataactaatatgataactaatataactatatatagctatatatacctacatataactgcaatataaccataatatataaaataattaatataacatatagattagttataaaataatatatataaaactaataaaataacaccaatatataaaaaatataaaataactaaaatacattggtatagtttcttgtaataaccaaaagaaagtgttcctttttcctctatttcttggaagtgcttatgaaggactggtaatatttcttattttttattatttttgagacagagtttcgctcttgttgtccaggctggagtgcaatggcgcgatctcggctcactgcaacctccgcctcccagtttcaagtgattctcctgcctcagcctcctgggtagctggaattacaggcgtgtgccaccacacccggctaattttgtatttttagtagagacggggtttcaccgtgttggtcaggctggtcttgaactcctgacctcaggtgatccgcccgcttcagcctcctgaagtgttgggattacaggcgtgagccaccatgctcggccaatacttcttctttaaatgtttggtagaactcactagtgaggccactgggccttgtcttttcttcatgggaagattttaattactatgccttagctgggtaatacaaagatgtacctgcattatttcggattttcatcatttgtgcattctctctgttcttcttgatcattctagttaatggctttttccaactttgttgctcctttttttttttttttttttttttgagacagtctcactctgttgcccagggtgaagtgcagtggtgcgatcttggctcaccgcaacctctgcctcccgggttcaagcaattcttgtccctcagccccctccccctgcctgtccctccttcctcctgctgagtagctgcgattacaggcacacaccaccatgcccggctaatttttgtagagatggggtttcaccatgtcacccaggctgctctcaaactcctagcctcaagtgatctgccaatcttggcctcccaaagtgctgggatcactagaagcttttcaatttttttattccaaagcaatctgatgcagtttttgctatatttgagatatctcattttcttctgcatatgctattgggagataggaaagattttggaaaatgtgtaagaaaaaggaagatactaaaaacatactaagattgtatgtagggaaaggttacaactctaactttgataatgtgcattaaatcgacaaatccttgaaaagcacagctcgataaatccaacaaaaggagaaaaagaacatgtgaagagttgaatatatgtgaaagaaatgtaagttcatttttctttttttttttgagatggagtctcgctctgtcgcccaggctggagtgcagtggggcgatctcggctcactgcaagctccgcctcccgggttcacgccattctcctgcctcagcctcccgagtagctgggactacaggcgcctgacactccgcctggctaaatttttgtattttttagtagagacggggtttcaccgtgttagccaggatggtctcgatctcctgaccttgtgatctgcccgcctcggcctcccaaagtgctgggattacaggcgtgagccgccgcacccggtcgtaagttcattattaaaatgggccccatatccacgtgaataggggtcagtctcagacttagctttaattttcagccatgagaagactactgctcttcctccaacactcacttctctattttctctatcgtttgatcctgtctcctgtacaactgggtggtatttaaccatgtttaggctcaggtataacccaagctctgaaactgtaatagaaaattaagtaaatgaaaggcaaaaaatgaaagacttaataaggtttaagctgttattcatctaggaggctgaataacaatacatatacatgtttttgttgtttatgtgtatatattttttatgaatagagttgttcctattatgttgtatcttgtaataattactaatgacaaggttcataaatagctagatgttaacataactggccaaactccagtgacaagggccctgttacaatcagtaggaccaacctgctaagacctgagctcagagctcagggatggccaaggtcaaggcccagtggttgtgacgagatgccaggaaaccttacccactgcatgcctgtgttgtgccatggtgctgtaagtagtctctttgggtacactgccagtaggcttttggcatacatgtatgggctagtattttcaggccaaaaaactatccctgtctcattgtttactatttttgtgcagcaatttggttttactgttggttcttactctggtcttgccccaagttcaatactttggttcttctcttctccctaaactttccctgtcctgattccctgagaacaattcccttttctctgaattgggatcctatttctaccccttgcatacatacccctcctaattcttctgggtaaatttctatgcccattaactctagacatacatttgtaaattactgagaccctaaattgagaattatgtttgccattacttttaaaagtgtaatctgaatcccagcactttgggaggccgaggcgggcggatcacgaggtcaggagatccagaccatccagactaacacggtgaaaccccgtctctactaaaaatacaaaaaaattagccgggcgtggtggcgggcgcctgtagtcccagctactcagaggctgaggcaggagaatggcgtgaacccgggaggcggagcttgcagtgagccgagatcgcaccactggactccagcctgggcgaaggagcgagactccgtctcaaaaaaaaaaaaaaaagtgtaatctgtttttttgcctcctgaaatcacttatgtataaacacattaaagtgggtcaccgtgtcacgtcttgggcttcctgggacaagaatcaaatggcacatgcctggccaaagtgctcagatcaatctgcaaaccatggtcacagagccagtcacagagtcttacggctttcattgtagcttctctgtggaatatcttcaaggacatgtgtgtgctttaggatgttcacgtgtcatgattaagttgtaaatttcaaaaattctaagaatgcctattgttggccagaagtataaaaattggaaagattttaataaaatcatctttcaatcttacttaaataggtctatgaagtctgcatctcttcctctggaaagtaacgtaagggctgtgaagaacattgtccataatgaaactgagaagggctgttctccctgggaacagaaaggtcactgtctttgctcaacaaacagcctaaagccaggaacgcaggcctccccaggcctcttggccgcctctcaagcttcctcaataaaaaattcacatggaagacattctagtctatcttctcttccttctttcttccctttagctaataattattgagtgctgattatgttctggacacagttctagaatttctgtgataagaaacagagaccccagcagtgattctctgctggggccgatggctctcagggacatccttcaaaacagggcccatttggttctttaaaaaaaataatgtccagtttctctaaaaattctgtcatgacttttatttctttgatgttaagctttgtgtcttaggtttcagcgtgctgacgttctctgggccctgaagtcactgctgctggctggtgtgctggccacttggtcgtgctggcctgtctcccaccgggtggatgcccagcgagctctggatgctgtgtatgacaaagacatgggggttgtttggagtctgtgatg

SEQ ID NO: 84 - DNA, 194007 bp, Homo sapiens
  source 1..194007: mol_type = genomic DNA
cagacggtctgggtttggttattaggataactctattccttagaaacccttaaattgaaaacatggggttgggcatggtggctcacatctgtaatcccagcactttgggaagccatggtggaaggatcacttgaggccaggagttccagaccagcctgggcaacatagtgcaaccccatttctgttaaaaaatgtaaatattggccgggcacggtggctcttgcctgtaatcctagcactttgcactttgggaggcggaggcaggcagatcacgaggtcaggagatcgagaccatcctggctaacacggtgaaaccccatctctactaaaaatacaaaatattagccaggcttggtggcgggcgcctgtagtcccagctactcgggaggctgaggcaggagaatggcgtgaacccgggaggcggagcttgcagtgagccgagatcgtgccactgcatccagcctgcgcgacacagtgaacctctgtctcaaaaaaaaaaaaaaaaaaaaaagtaaatatttagccgggcatgatgctgtgcacctgtagttccagctactctggaggctgaggcaggagaataacttgaacccaggaggctgaggctgcagtgagctatgattgcaccgctgcactccagcctgagtgacagagcaagaccctgtctaaaaaaataaaacatagagtgttcacaatagaaaaatatagcaagaaagagagtagatttgtgattgtccacagctggggatttagaagtaaatgtgtagtgactgctaatgggtacagggtttatttttcagtgatgaaaatattttataatcaaatgtaagtgttccacaactttgtgaatatactaaaaaccactaaattgcataattggagtggattaattgtacatatgtgaattatatatcaataaagttgttattttaaaaaccaagaggatattgattgttcccaacacaaagaaatgataaatgtttcagatgatggatatgctaattacctaatttgctcactatacattatatgtgttgtaacatcactgtgtaccccatacatattacaatcattatgtgtcaatataaagtacttatttatttatttatttattattttttgagacagagtctcaccatgttgcccaggctggagtgccatagctggctaattttttttgtatttttagtagagacaaggttttgccatgttggccaggctggtcttgaacccctggcctcaagtgatccacctgccctggcctcccaaagtgctgggactgcatgcctgcaatttatgtatgcccagactagtctgggcaacatagtgagaccctatctctacaaaaaatttaaaaattagctgggcatggtggcatgtgcacccagtcaaaaaaaaatttttttaatcactgaatttgaagataggtcaattgagattatccagtctctctttccagaacaaaaagaaaaaaggtgaaaataaggaacagaatctcagagacctgtgggaaacctttaaacataccaatgatgcataacaacaaggggaggagagagagaaaaatagataaataaatttgaatccataatggccaaaaatttccaaaatttgctaagagaaaccaatctacatatccaggaagctcaaaaactaacagtaaggtaaattcaaaaggatacaaaatgtagacatataataatcaaactgctggaagtcaaagacaaaaagaaaatctgggccaggcatggtggctcatgcctgtaatcccagcactttgggaggccaaggcgggcggatcacctgaggtcgggagttcgagaccagcctgatcaacatggagaaaccccgtctctactaaaaatacaaaattacccgggcttggtgacacatacctgtaatcccggctactcgggaggctgaggcaggagagtcgcttgaactcgggaggcggaggttgtggtgagctgagatcatgtcattgcactccagccagggcaacaagagtgaaactccgtctcaaaaaaaaaaaaaaaaaaaaaaaaaagaaagaaagaaagaaagaaaaaagaaaagaaaatctggaaagcagcaagacagaagcaactcatcacatacaagagatcttcaataaaattaacagctaatttatcagaaatcatagaggcagccaggtacagtgcctcatgcctgtaatcccagcactttggcagggcaaggcaggaggattgcctgagtccaggagttcaagaccagcctgggcaacatagtgagaccttgtctctacaaaaaataatttttaaaaattagcatgcacctttagtcccagctactcaggaggctgaggtggggggattgcttgagcccgggaggtcaaggctccagtgaactgagattacaccactgcactccagcttggatgacagagcgagactctgtctcaaaaacaaaacaaaacgaaacaaaacaagaaaacaggccaaacatggtggctcacacctgtaatcccagcactttgggaggctgagatgggcagatcacctgaggtcaggagtttgagaccagcctggccaacatggtgaaaccctgtctctactaaaaatacaaagattagccgggcatggtgatgcacgcctgtaatcccagctacttgggaggctgaggtaggagaattgcttgaacctgggaggcagaggttgcagtgagccaagattgtgccactgcactccagcctgggtgacagagtgagactctgtctcaaaaaaaaaaaaaaaggaaaagaaaagaaattatagaggctcaaaaggcagtggggcaaaaactggcaaccaaagtttctacatccagcaaagcaattctttaaaaattaagggccggagccaggcatgatggctcaggcctataaacccagcactttgggagatttaggtgggcagattgctggagctcaggagttggagaccagcctgggcaacatgggtgaagccccgtcttactttattaaaaaaaaaaaaaattaagggttagatgtggttgctgacacctataatcccagcactttggaaggccaaggcaggaggtttgtttaagcccaggagttcaagactagtctagttaacatagatgagaccctatctctacaaacaagttaaaaattagctaggcgtggtggcatgcatctgtagtcccagcatcttcgtaggctgaggtgggaagatatttgaaccgaagaggttggggctgcagtgaaccatgataaggagaactaaacagaaatttgcacaccaatagtcatagcagcattatttacgatagccgaaaggtggaaacaaccagagtgtctatcaacagacaaatggaccaacaaaatgtgatatattaatatactggaatattattcagctgtaaaaatgaatgaaattctgagacatgctacaacatggatgaaccttgagaacattatgctaagggaagtaagccagtcacaaaaagacaaatactgtccactttatggggtacctaaagtagttaaattcatagagatagaaagtagaatggggttgccagggctcagaggagagagaactaggaagctaatctttaatgggcatggggtttttaattagagaagatgaaaaatttctagagatggaaggcagtgatggtagcacaacaatgtgaacgtactcagtgccccagaactgtacatttaaaactggttgaaatgaagcatacaaatatgcacttagaagacacaagacctggctgggcctggtggctcatacctgtaatcccagcactttgggaggccgaagccagcagatcatgaagtcaggagttcaagatcagcctggccaacatggtgaaaccctgtctctactaaaaaaaaaatacacacacacgaagacacaagaccgctcagcgtgatgacctatgcctgtaatcccagcactttaggaggtggaggcaggtggatcacttgaaggagctcaagaccagcctgaccaacatggtgaaaccccatctctactaaaaatacaaaattagccgggcgtggtggctcacgcctgtaatcccagcactttgggaggcagaggcgggtggatcacctgagatcgggagttcgagaccagcctgaccaacatagagtaacccggtctctactaaaaatacaaaattaggtgggcatggtggtgcatgcctgtaatcccagctactcaggaggctgaggcaggagaatcacttgaacccgggaggcggaagttgtggtatgccaagatcaaaccattgcactccagcctgggcaataagaacgaaactcggtctcaaaaaaaaaaaaaaaaaaaggccagtcaccgtgactcacacctgtaatcccagcactttgagaggccaaggcagggaaatcacttgaggccagttcagtaccagcctagccaacatggtgaaaccccatctctactaaaaatacaaaaaattagccaagtatggtggcatgcacctgtagtcccagctacttaggaggctaaggcacaagaattggttgaacctgggaggcagaggttgcagtgaaccaagatcatgtcactgtactccagcctgaatgacagagactctgctcaaaaaaaaaaagaaagaaagaaagaaagaagaaatagataaaaacaacaaatgtttaaaggttaaaatggtaaattttctgttatgtgtattttaccacaacaagaaaagataaaatgttaaataaaaagagcaactaaagagaatttaactctagcacatccatttttcaggctgaaatgaaagaacaggtgacactaactcaaatccacatgaagtggagagcattggaaaaggtaactaaataaaggcaaatataaaagacagtatagatgtatgttttgtttgtgactctttttctctcctgtcttacttcagacaactgcataaagcactaatataaaacatgaaatatatattgagggtcatatattctataaacatgcatttgcttggcaataatagtacaaagaaggttgagggaatggtcctttgtaggagcaagttttgtacactattgaaattaaattggcatggttccaaattgtattgttttaagatgttaatggcaaccactaagaaaataactaaaaatatatagtaaaagaatgacaatgcaataactatagtatactagaaaatatttacttaacagaaaagaaggcagtaatggagtattaaataagacttaaaatgtattaaaaatagcaaaatggcagatatatatcctatgttatctgtaattaaatgtaaatggactaaacacttcaatcaataggcagagattttcagaatggattttaaaaataaaactacatgctatttacaagagacaaaattcagattcaaagacacagatagagttaaaagaacagagatggtccaagtgtggtggttcatgcctgtaatcccagcactttgggaggccaagacaggcagattgcttgagcccaggagttcaagaccagcctgggcaacatgatgaaaccctgtctctacaaaaaatacaaaaattggccaggcaaaatggtgtgtgcctgtagtcttagtagtcttagttacgcaagaggctgaggcaaaaggattgattgagcccaggaggtggaggctgcagtgagctctgatcacatcactgcactccagcctaggtaacagagggagattccatctctaaaaaaaataataataattgaagacaatagaatcaaacctttcagctttgccaagtctcatgatttttcatttgtctcagatcagttttttaaaacaaaacatgcaaaatttattgcaatctatcccactcactcccaacagccagagataattactatcctaaatttggtgttgaccattcccttatgtttttatacttttactatatatataatacatgtattttactatatataatatatattttactatatataatatatattatactatatattatatttgtaattatactttataatatattatatattatactataaaatatattacatttgtgggccgggtgcggtggctcacgcctgtaatcccagcactttgggaggccaaggcaggtggatcacgaagtcaggagtttaagaccagcctagccaacatggtgaaaccctgtctctactaaaaatacaaaaatgagctgggcgtggtggcaggtgcctgcagtcccagctacttgagagggtgaggcagagaattgcttggacccgggaggcagaggttgcagtgagccgggatcgcgccactgtactccagcctggaggacagagtgagactccatctcaagaaaaaaaaatatatataaaatatttgtaattatactatataaaatattatatagtatatatattttaagtatagtaaaagttttttatactttacacatagtaaaagtataaaaacataagggggccgggcacagtggctcatgcctgtaatcctagcactttaagaggccaaggcgggtggattacctgaggttaagagttcaagaccagcctggccaaaatggtgaaaccctgtctctactaaaactacaaaaattagctgcgcgtggtggcatgtgcctgtagtcccagctactcgggaggctgaggcaggagaatagcttgaacccaggaggcagaggttgcagtgagctgagatggtaccactgcactccagcttgggcagcagagtaagactccatctcaaaaataaataaataaataaaaataaggcaatgattatatatatagtattgttttacatcttaaaactttatgtagatgatatcataccataaacatccttctgcaacatgattttcttgggtaacattatgattttgagattcagccatgtttgttcactctgagcatctggaatgcatcaataaacaaagctgacaaagatccctgccttcacaaaaggagatcaggctagaaaaaaaggaaaacaggaccgggtaggtgagctagtgaccatcaagagaaggagcctttgcaactataaacaaagtgtgtgtcaggtaatgtcagaaaaataattgggtaggtgagggtggattgggggatgttggccacagagagggttgtaggccattgaggccattgtgaggattttgctttcactgaaatgaaatgaagagttttgagcagagtagagatatgacctgacttacatttttgaaatgctgatacatatagctctggttcattaattttaacttttgcatagtggtctattgtaggatcatacattaaagtattgattcattctcctattagtggtcaattaagttattttcatattcattatatataatgctgcagtggacacttttgtatttgtcctttagggcacttgcgggagaattttcctaagaaggaaatctttggatcggagggcatttgcctttttaatattatttgtaataactattattactaattattagtaatattatcagtaataactaataattgccaaactgctctagaaagaggatgtcccactttacactggcaccagcatttatagaagtttcatttgccgcccagtctcaccagccctttttttttttttgagacaaggtctcgctctgtcgcccaggctggagtgcactggcgtgatctcggctcactgcaacctcctacctcccaggttcaagcaattctcctgtctcagcctcccaagtagctggaattacaggctcacaccatcatgcccggctaatttttgtatttttagtagagacggggtttcgccacgttggccaggctggtatcgaactcatgacctcaagtgattcgaatcccagcactttgggaggccaaggtgggcagatcacttgaggtcaggagtttgagaccagcctaaccaacatggtgaaaccccatctctactaaaaatacaaaaaaaaaattagccgggtgttgtggcaggcacctgtaatcccaactgctcggtaggctgaggcaggagaatcgcttgagccaggaggtggaggttgcagtgagtggagatcgcgccgctgcacttcagcttaggcgataaagagaggctccttctcaataagaaacaaacaaaaataaaaacaaagtgctgggattacaggcttgagccaccaccacatgtctgcccctcacccgcccttgaaatagctctttgtggttttaatttgcatttccccatccctggtgaagttcagcacctttttcatgtttatttgtggtttggtcttttcttctctgattgcctcttgatgttctttatccttattctatggagctatttctccaccaccccccttttttttgagacagagtccccttctgtctcgcaggctagagtgcagtagtgtgatctctgatcactgcaacctccgcctcccaggttcaagcagttctaatgtctcatcctccttagttgggattacaagcctgcgctaccacgcctgactaagcctggataattttttgtatttttagtagagacagggttttgccatgttgtccaagctggtcttgaactatttctcacttaaaaaaaatttttttttttttgttttgagatgggcgctctgttgcccaggctggagtgcagtggcacgatctcagctcactgcaacctccccttccctggttcaagaaacgatcctcccacctcaacctcttgagtagctgggattacaagtgtgcaccatcacgcctgactaatttttgtatttttagtagagacggatttcaccaagttggccaggctagtcttgaactcctggcctcaagtgatcctcagcctcccaaagtgctgggattacaggcatgagccacctcacccagcctaaaagttgatttttagatattctgtatatattctagatactgatattttgttaattatacacaatccattgctgattatatgtaacacaaacatcttctccccttctctgtcttgtcttttttcttttctttttttttttttttttttttttttttttttgagatggagtctcgccctgtcgcccaggcttgagtgcaatggcaccatctcggcttactgcaacctgtgcctcccgggttcaagcaattctgtctcagcctcctgagtagctgggattacagacatgcatcaccacgcctggctaatttttgtatttttagcagagatagggtttcaccatgttggccaggctggtcttgaactcctggcctcaagtgatccacccgtcttggcctcccaaagcgctgggattgcaagcttgagccactgcgcccggccgtcttcattttttaaaactgacatcttttgttgcacagaaccctttcatttttttatgcagttgaatatttgaatctttttctttcaaggcttgtgatttttgtgttttgtttaagaaatgttcctctacaccaaggtcataacattttctcatattcattcctcctttaaatttgttaatacgatcaatctggattatgtcgagagggaaggggaagtctgatctgtccctttagaggtgactttgcatatctcaccaggattctttggtgttgacttcatggcttaactctgtagatagtcctgttctccttatttacaggttgcaaggaaagctttattgaaatgtccaaatcttaggcagatttttatttaatggacctgtggcagggcccaagaacctgcatttttatttgcaacccaggtgattttgatgaaagaggtttccttttaaattattgatagtgctgaagccatcttctcaggtgtccagcaacttggaaatgaacctactctttgttggctggtgattgagccttgctctgccttggttcctctttggtaaaagtggatggccaaagtccctcctgggagatggggagtcccatgatgagtgggatgactctcacatataaaagtttagcccgccttgcatttgtcagacactcagtaaacagtggaccttccttaactcctgaggtcccaagctcagggttgagcctgccctgcctcccttctagaccatctcccaccatgcacccaacttgggcaagtcccataacccctcacagcctcaatgccatcatctgtaaattcattaatttgctggctgggcacagtggctcacatctataaacctagcactttgggagtctgaggctggaggattgcttgagcccaagggtttgagaccagcctgggcaacatagtgagacgctatctctacaaaaaacttttaaaaattagcaaagtgtggtgatacacatctgtagtcccagctaccgcagagggtgaagtgggaggatcacttgaacccaggaggtcaagactgcaataagccatgactgcgccactgcagtccagcctgggtgacagagtgagaccctttctcaaaacaaacaaacgaacaaacaatagtctttgcgttacaaggttgttgtaaggattggagtggcatataaacacccaggacagtgccagaatgcagtatcactacaagagactgtggaagctgagcagttgtgtttttaatcctggagaatctgaaagattcctggagcatctcccatgttgcttcccaatgcctagaacaatatcggacattctgtaaagatttggtaaattcatgttctttccattgcaggacacaattctcacattccatcagtgtctccaaagaacctacaaaactggaaaaatatattcgatcattttatttaacaggtgtttatatagggcttgcagtacatcaggccctgctgtaagtgctttataataattaactcatttaatcttcataacaactctatgagggagatactattattattatcattttgcagatgaggaactgagatgaggagcagccctggactgagtgaattgaaccctctgggtgtgttacattcaggatggtggaacaagacccctgggaagaaggtaattcaaaccctggttcttctggatgctttctgtttcagatgagggaagcctttggaattgaaaatcaattcaaactgagcaatattagttgtaatttttgtattttaaaaccatcctaccacggcatccccatttggatggttactatcaaaaaataaaaacagggctgggcgtggtggctcatgactgtaatcccagcactttgggaggccgaggcaggcggatcacaaggccagtagttcgagaccagcctggccaatatggtgaaaccccatctctattaaaaacacaaaaattagccgggtgtggtggcgggtgcctatagtcccagctacacaggaggctgaggcaggaaaatcacttgaacctgggaggcggaggttgcagtgaaccgagattacgccactgcactccagcctgggtgacagagagagagagactctgtctcaaaaaataaataaataaataaataaataaaaataaaaataggccgggcgcagtggctcatgcctgtaatcccagcactttgggaggccgaggcaggtggatcatgaggtcaggaattcaagaccagcctggccaagatggtgaaaccccatctctactaaaaatacaaaaattagccaggcgtggtggcaggcgcctgtaatcccagctactcgggaggctgaggcaggagaatcgcttgaacccggggggcggaggttgcagtgagccgagatcgtgacactgcacttcagcttgggcaacagagtgagactctatctcaaataataataataataataataataaaaacaaaacagaaaataacaagtgttggcaaggatgtgaagaaactgaaaacttgtgcactgctggtgggaatataaaatggtatagcctcttggaagacagtatggcagttcctcaaaaaattaaaaatagaattagcacatgacccagcaattctacttctgtgtatatacccaaaaacacttgaaagcagggattggaggatatacttgtattcctatgtgtacagcagcattattcataatagtcaaaagtggaaacaacccaagtgtccattggtggatgaatagataaagaaaacatggtatattcacacaatggaaatgactcatccttaaaaggaaggaaattctgacacacggtataacatagatgaatgttgaggacgctgtgccaagtgaaataagccagtcacaaagataaacactgtacgattccacttacgtgaggcacctagagtagtcaaattcatagagacagaaagtagaatactggctgccagaaacagtgggcagggctggagggggagttcttgtttaattggtatagagtttctgtcttgcaagatgaaaagagttctatggatggatggcagtaacagtagcacgatgtgaatgtacttaatgccgcagaactgtactcttaaaaatggttaagggccaggcatggtggcataaacctgtcatcctggcactttgggaggccaaattgggagtatgccagttagaatggctattattatttttatttttttttgaggcacagtcttgttctgtcacccagtctggagatcagtggtgcaatcttggctcactgcaacccccgcctcccatgttcaagcaattctcctgcctcagtccctcgagtatgggactacaggcgtgcgccaccatgcccagctaatttttgtaatttcagtagagacagggtttcaccatgttggctaggctggtcttgagttcctgacctcagctgatctgcccgccttggcctcccaaagtgctgggattacaggcgtgacccaccatacctggccagaatggctattattaaaaagacaaaaaacaacagatgttggtgaggatgcagggtaaagggaatacttccacactgttggtaagaatgtaaattagcatagacactatgaaaaacagtatggctgggcatgatggctcacacctgtaatcccagcactttgggaggatgagatgggtggattgcttgaggccaggagttcgaaaccagcctggccaacaaggtgaaaccccatctctactaaaaatacaaaaaattagtcgggctgctgggtgtgatggctcatgcctgtaatcccagcactttgggaggccgaggtgggtggatcacctgaggtcaagagtttgagaccagcctgaccaacatggagaaaccccgtctctactaaaaatacaaaatgagccgggtatggtggcgtatgcctgtaatcccagctattcgggaggctgaggcaggagaatcgcttgaacccgggaggcagaggttgcggtgagccgagatcacgccattgcactccggcctgggcaacaagagcgaaactccatctaaaaaaaaaaaaattagctgggcatggtggtgtgtgcctgtaatcccagctactcaggaggctgaggcaggagaattgcttgaacccgggagggagaggttgcagtgagccgagatcacaccactgtactccagcctgagcaacaagagcaaaactccatctcaaaaaaaaaagaaaaaaagaaaaatagtatggagatttcctgaaaaactaaaaatattaatagaactaccatacaatccagtaattctactacttgttatttatccaaaggaaaagaaatcagtacatcaaagggatatctgcacccccatgtttgttgtagcaatattcacaatagcaaagatatggaatcaacctaagtgtccatcaatggactaatagataaagaaaatatgacatatatacacaacggaatagtattcagccataaaaaggaatgaatgaaatcacatcatttgcagcaacatgggtggaactggaggtcattatgttaagtgaaataggtcaggcacagaaagacaaatatcacatgttttcactcatatgtgggagctaaaaaaaagttaacatcatggaggcagagagtagaataatagatactagaggctgcaaaggatgtgtgggtgcgaggaagggatgaagaaagattggtcaatgggtacaaacatacagttggttagaaggtgtaagttctagtatttgacagtaaagtgagatgactagttagcaacaatgtattatatatttcaaaatggctagaagcaaggacttgaaatgctcccaacatatagaaacgataaatactcaagttgatggacacccctaataccctgacttgatttttacccattccatgcatgtgacaaaatatcacatgtaccccataactgtgtaaaatatgaggtatcaataaatattattattattattttagagacaaggtcttgctctgtcaccctggctggagtgcagtggcatgatcttggctcactgaagcctcaaacttctgaactcaagtgatcctcccacctcagcttcctgagtagctgggattaccagcatgcaccaccatgcctgactaattaaaaaaaaatttttttttgtaaagaagcggtctcaccatgttacccaggctggtttcaaatgatcctggtctcaagtgatcctcctccctttgcctcccaaagtgctgagattacagatgtgagccaccatgtcaaacaattttttttttttttgagacagggtggagtgcagttgtgtgatcatagctcattgcagcctccaactcctgggctcaagcaatcctcctgcctccacctcctaagtagctgaaactacaggtgcatgccatcacacttgactaatttttacattgtttgtaacaacgaggtcttgccatgttgcgcaggcttgtctcaaattcctggcctcaagtgatccaactgccttggccttcttaagtgttgggattacaggtgtgagccaccatgtccagccccttttgctgctttttttttttttcttgagacagagtttcgctcttgttgcgcaggcaggagtgcaatggcgcaatcttggctcaccccaacctctgcctcccaggttcaagcgattctcctgcctcagccacccaagtagctgggatcacaggcatgcaccattatgccgtctaattttgtatttttagtagagatgaagtttctccatgttggtcaggctggtctcgaactcccgacctcaggtgatccgcccgcctcagcatcctaaagtgctgagattacaggtgtgagccactggacctggcctcctttttctgatttttaagtaatgtttctttttttttttttttttaaacggagtctcactctgtcactcaggctggagtgcagtggcgtgatctcggctcactgcaacctccgcctccgggttcaagcaattctcctgcctcagcctctccagtagctgggtttacaggcatgcaccaccatgcccagctaatttttgtagttttagtagagacagggtttcaccatcttggccaggctggtcttgaactcctcacctcaggtgatctgcccacctcagcctcccaaggtgctgggattacaggtgtgagccaccacacccagccagattttgaaataatgtttccgataaaactttcaaacatcgcaaatgttttgaacaaagaacgtgagtgcttcccataacctcatattctctttttttttttttttttttttgagacctggctggtctcaaactcctagcctcaagcaatccttctgcctcagttggttctttcagtgaaagaaatgtgctgtgcattttttttttttttttgagatggagtctcactctgtcacccaggctagagagcaatggcgtggtcttggctcactgcaacctccgcctcccaagttcaagcaattctcccacctcagcctctcaagtagctgggactacaggtgcatgccaccacacccggctaatttttgtatttttactagagacaaggtttcactatgttggccaggctggtgtcaaactcctgacctcgtgatccgcccacgtcggcctccccaagtgctggggttaaaggtataagccaccatgcccagcttgtgcatatattaacccataaagtaattaatattttcacaatattaataaccatgtctaatctattttgacagcacagagccagccttttccttcatttctgggagaagtccttccccaggaaagccaagcttccactttccaccttcaaatcaaatgcaccagtgctcaaatggggttccaggcaaagatggtgggcttgaggctcactggaagatggagaaatattattagaagcaattttgccagcctgcacaacatagggagactacgtttctactaaataagtaaataaatatataggctgggtgtggtggttcatgccgtaatcctagcacttttagaggcagatgcaggagaatcgcttgaggccaggagttcaagatgagcctgggcaacagggccaggtcctgtctcaatttaaaaatatataaatatatatatatttttttttaaaaaagaaaacattgaaaaaaagaataaaaattagctgggtgtagtggcacatgcctgtggtctcacatacttgggaggctgaggtgggaggatcacttgaggcagggatgttgaggctgctgtgagctatgatcatgccattgcactctagcactccagcctgagtgacaaagcgaaaccctgcctcaaaaaaaaaaaattttttttttttgtaaaaatgtaatacctgggccgggcgcagtggttcacacctgtaatcccagcattttgggaggccaaggtgggcagatcacttaaggtcaggagtttgagaccagcctggccaacatagtgaaatcccgtctctactaaaaatacaaaaattagccaggcgtggtggcgggcgcctgtaatcccaggtacttgggaggctgaggtaggagaatcacttgaacccgggtggcagaagttgcaataagcagaggttgcagtgagccgagatcacgccactgtgctctccagcccggctgacagagcaagactctgcctcaaaaaaataaataaataatggccaggcctcccagggaggcagaggtgggtggatcacctgaggtctggagttcgagaccagcctgaccaacatggagaaaccccttctctactaaaaatacaaaatttagccaggtgtggtggcacatgcctgtaatcccagtttactcaggaggctgagacaggagaatcacgtgaaccagggaggtggaagttgcggtgagccgagattgcaccattgcactctggcctgggcaacaaaagcgaaactccgtctcaaaaaatgaatgaataaataaataaataaataaataaataatgtggcctggcgcggtggctcacgcctgtaatcccagcactttgggaagctgaggcgggtggatcacgaggtcaggagttcgagaccagcctgaccaacatggtgaaaccccgtctctactaaaaatacaaaaattagccaggcgtggtggcacgcctgtaatcccagctactcaggaggctgaggcaggagaatcgcttgaacccagaaggaggaggttgcagtgagtcaagattgcaccactgctctccatcctgggcgacagggcgagactccgtctcaaaaaaaaaaaaaaaagtaatacctgaattcctatacttctcagtatgtacagtgattaatattaacctaaactattccctgaataagacctcaattcagaaaattcagggtgtttggatgctgtattcattcattcagtcaatcaattcagaaatcaatgtttccccaatgcttcttaagccatgccagatttgttgctagacatagaatcccacagaaaacaaaaagagacttggtttggggggaaaacaacttatttaatttcttattcttagagacagtgtatcactctattgcccaggctggagtgcggtggcgtgatcttggctcactgcaacatatgcctcccaggctcaggagatcttcccacctcagcctcctgagtagctgggactacaggtgtgcaacaccacgcccgcctagttttggtattttttttgtagatacagggtttcaccttcaaaaaatttgctgggcatagtggcgcatgtctgtagtcccagctactcaggaggctgaggtgggaggatcacctgaacctgggaggttgaggctgcaatgagccataattgtaccactgcattccagccttcgcaacagagggagatcctgtctcaaaaaaaaaagtattttatcaaaaatgcagccgggcgctgtggctcacgcctgtaatctcagtactttgggaggccgaggcaggcagatcacatgaggtcaggagttagagaccagcctggctaacatggtgaaaccctgtctctactaaaacgcaaaattagctaggcagggtggcgtgcacatgtaatcccagctactcaggaggctaaagcacgagaattgcttgaacctgggaagcagagtactgtagtgagccaaaattgcaccactgcactccagcctgggcaacagggtgagactccatctccagaaaaaaaacaaaagcatgaccaggtattgtgtggctcatgcttgtaatcctagcactttgggaagatgagacaggtggatcacttgaggctaggagtttgagaccaccctggccaacatggcaaaaccccatctctactaaaaatacaaaaattagccaggcattgtggtgtatgcctgtaatcccagctacttgggaggctgaggcacgagaatcacttgaatccaggagtcagagagtgcagtgagcagagaccacgccactacactccagcctgggtgctgggtgatagaggaagactctgtctcaaaaaaaaaaaaaaaaaaaaaagcgtaacctaaatcaaatcataaggaaacatcagacaaacccaaactaaagggaattctacaaaatgacttgcctgaaacctttaaaaacatcaagttcatgaagactaggaaaggctgaggaactcttccagattaagaaggaaattaagcaaacaggacaaataaatgcaacatgtgatcctggactggctcctggtctggaaaagagaaagctataaaggcctttaattggacaattagtgaaatttgaatatgaatttcagcttagataacagcaatttaacaatgttaaattttctgcatttgataattgtacagtgattatttaagaggatgtccttcatgttagcagtgaagatggaaatatttaagggtaaaaatctatgatttgctctcaaatgttcatttaaactataattttaggctgggcacagtggttcacgcctgtaatcccaacactttgggaggctgaggtgggcggaacacctgagatcaggagtttgagaccagcctagccaacatggtgaaaccccatctctactaaaaatacaaaaattagccaggcgtggtggcacgcgcctgtaatcccagctactcaggaggctgaagtaggagaatagcttgaacctgggaggtagaggttgcagtgagccgagatcctgccactgccctccagcctgggacagtgcaagactgtctcaaaaaaaaaaaaaaaaaaaaaccccaaaactacccgaacatggtggcgggtacctgtaaacccagctactcaggaggctgaggcaggagaatcgcttgaacccaggaggtggaggttgcagtgagccgagatcgcgccattgcattccagcctgggcaacaagagtgagattttatttcgaaaaaaaagtgaaaaataaaaaataatttggtaagcaggttgataaaaaaaaaaataatagcgatatatattgtatacagaatgctgaagtaaatgcagcaaaaatatgaattggtgaacataggtgaggcgtgtatgggagttccttaaggtgtttttgcaacttttctgtaaatttgacatgcttttcaaaataaaaatttaaaattaagaaagcctgttaagatatgtaaaggaagggtaggggtgattgctgaaaggggctccatcgaggactaaccctgccaatagaatggtactgtatgccagagcacagccacactgatgtccctccagtgccacactgatgtccctcactcctggaaagggcctctgtagaagatgatactgggccaggtgtggtggctcccgcctataatcccagcactttgggaggctgaggcaggtggatcacctgaggtcgggagttcaagaccagcctgaccaacttggagaaaccttgtttctactaaaaatacaaaattagccaggcgtggtggcgcacgcctgtagtcccagctacttgggaggctgagacagaatcgcttgaacccgggaggtggaggttgcagtgaaccgagattgccattgcactccagcctgggcaacaggagtgaaattccgtctcaaaaaaaaaaaaaaaaaaaaaaaaagatgataccaatggctgggctccaaaacgaaatcagtgtgggggacaagggttcaccttgtactttgtcccaaatttgcccctaaacatcaagcaacatatgagaacatatgagaccgtgtcagcaatgcctggtctgaccctcctctgttagaagctggaagttattctgtaccttcttgctttaccttttcttttcttttttttttttttggtttgtttgtttcttgctgttgaggccaggaatactctaacgtttccacagatgagttaacatttgcataacaatctgggtgaccctgttctttcctgttggaaagggacttttcttgactcctgagaggataagttgagggtcttttgaagctgcccaggccctatgggtggggacgtgcctgtcagcccaccagtggagagctggagcccagtgagtctcaggggttggaggtgtggcgggccaggagagtgtgttgaatatgggggctaggaagtagggttgggcccagccaaggttgggggtaaaattgtccacactcactcatgtccccttgaaacctattatataaggctagggtaatactttgaaaattcactacattttgtcaccagttgaacacgactgtttcgtggcagaacttgatagaatacaagaatgttttctccttgtgtactatgcagatttgcctaggagaccagaagttcttggcactcacttacaaaatggaagtgcagtcacgaagtatctgttgggtgtctgctggagttcaaatggtaaactaggttgtcaaggttcctgccctcaaggaggtagagagcaagaaaggtcaatggattaccacaatagagtctaaggacagaacgagaaattacctaggccctagacaatagtattttgagttaaaatttttttcttggccatgtctggtggctcatgcccgtaattccagcactttgggaggctgaggtgggagtattgcttgagcccaggagttccagaccagcctgggcaacatagcaagacttcatctccacttaaataaataaaaaaataaaataaaaaagaaaaaatatgtatttttttcttgattaaaaaaaccttggaggccgggcatggtggctcatgcctgtaatcccagcactttgggaggccgaggtgggcagatcacctcaggtcaggagttcaagaccagcctggccaacatggtgaaaccccgtctctactaaaaaatacaaaaattagctgggcatgatggcgcatgcctgtaatccctcggaagtctgaggcaggagaattgcttgaaccaggaggcagaggttgcagtgagccgagattgcgcccctgtgctccagcctgggtgaaacagtaagactctgtctcagaaaaaaaaaacaaaaaaccttagcaaaaattgaccaaaaagtcaaaagacaagtgctcaagtgggaaaaaaaaattgcatatgtgctagctgaagggctaagtcaattaaaaattagactcggccaggcgtggtggctcacacctgtaatcccagcactttgggaggccaagggaggcagatcatctgaggtcaggagtttgagaccagcccggccaacatggcgaaaccccatctctactaaaaatacaaaaattagcagggcatggtggcaggtgcctgtaatcccagctactcgggaggctgaggcaggagaatcacttgaacctgggaggcggaggttgcagtgagccaaaatcgtgccattgcacttcagcctgggcgaggatagtgaaagtctatctcaaaaaaaaaaaaaaagaaagaaaaatgcaaattgaaatttcaacaggatactactttcacattggccaagagcaaaatgttgataatgtttgcggaaggctggggaaacaggctctgccctatatctgagggaagtgtgcattgggccagcctccatgcagggcaagttggctacagctgtcaagatctaaaatgcacatcttatgacccaacaactccaatgctaggaacttatcctacagacacagtaaaaacttgcaacatgtcacactgttaagtgaaaaaagcaagctacaaagcagtgtatatcatatgctatccattgaatgtatatgtaaaatcccatggttaagccataattttcttaactttctcctgttgctgggtatgttgttttcgtgtttttgtgattatattgtaatgctgtgatagacatcttttgtgcatgaatttctgtctacacctaaagctgtttacttgggacagtccagattactgggccaaggagatagcaaaatgaatttacaatagcaaccattgcagcaaccatcaccatctgttaagtgggctgttttgttttgttttgtttcttcatcttctcaacagtcctgtgaggtagggaggagcacctccgttttgtagttgaggaaaggggtttaaaggaggtgaagtgacttgttccagggcacacagctggagtggtgagagcagacctggatctgcttggctctgttgatgaaatgggtcaaattccttaaaatatttggatttattctgagccaaatatgagtgaccatggtccgtgacacagccctcaggaggtcctgagaacatgtgcccaaggtgatcggggcgcagtttggtttaatacattttagggaggcatgaaacatcaatcaaatacatttaagaaatatactggtttggtccagaaaggccagacaattcaaagcgaggggtgggggtagatggggtacttccaggctgtaggtaaatttaaacattttctggttgacaattggttgagtttttctgaagtcctgggatcaggccgggtgcagtggctcacacctgtaatcccagcactttgggaggccgaggtgggcagatcacctgaggttgggagttcgagaccaccctggccaatatgatgacaccccatccctactaaaaatacaaaaattagtcgggcgtggtagcagatgcctgtgattccagctactggagaggctgaggcaggagaatggcttagatccgggaggtggagtttgcagtgagcggagatagcaccattgcactccagcccaggcgacagagcgaaactctgtctaaaagaaaaaaaaaaaaaaaaaaaggctgggcacagtggctcacacctgtaatcccagcactttgggaggccgaggcgggcagatcacctcaggtcggagttccagaccagcctgaccaacatggagaaatcccgtctctactaaaaatacaaaattagcctggcatggtggcacacacctgtaatccaagccacttgggagggtgaggcaggagaattgtttgaatctaggaggcggaggttatggtgagccgagatcatgccattgcactccagcctgggcaacaagagcgaaactccgtctcaaaaaaaaaaaaattatttttggtttacagctcccaaacccctgctttagaggcccttcatctattcggggctttctttttttgagagagagagggtctggctctgttgcacaggttggagtgcagtggcgatcatggctcactgcagcctctgtctcctgtgctcaagtgatcctgctacctgggcctcccaaagtgctgggattactggcataagccaccgcacagggcctacttggtgtattttttaagggtcttggtggctgagcatggtggctcacgcctgcaatccctgcactttgggaggctgaggtgggtggaccacctggggtcaagagttcgacagcagcctggccaacatcatgaaaccccgtctctactaaaaatacaaaaaaattgggcgggcacagtggctcacgcctgtaatcccagcactttgggaggccgaggtgggtggatcatgaggtcaggagttcaagaccagcctggccaacatagtgaaaccctgtctctacttaaaatacaaaaattagccaagcatggtggcatgactctgtagtcccagctacttgggaggttgaggcagcagaatcgcatcgcttgaacctgggaggcagaggttgtggtgagccaaaattgcaccactgcactccagcctgggcaacagagcgagagactctgtctcaaaaaaaaaaaaaaagaaagaaaaaagaaaacaccgaaaaaattagctgggcgtagtggcacgcacctgtaatcccagctactcaggaggctgaggcaggagaatcacttgaacccaggaggtggaggttgcagtgagccgagattgtgtgcgccactgcactccacctgggtaacaagagcaaaactcggtctcaaaaaaaaaaaaaaaaaaaaaaaaaaaagcgggggggctcttcataaacaatgtcaaattactctccagaaacctagtatcagtttatgctcctcacactcccactgagattgccaaactctccacactcaggtcagtgtggagaatggcaatattttcattttgccaactgggagggaaaaaaatagcctctcatagttttgatgatcatgtctttggtaactaatgaatctgaccatttttcatatgtttattcgctgtttgtacttttattaactgttcatgttggactacgtatttttaaaatatgcaaaacattctgaaaactgtaacatgtcgattctttttcttttcttttctttttttttgagacagtctcgctctgtcgcccaggctggagtgcagtggtgcgatcttgctcactgcagcctccgcctcccaggttcaagcagttatcgtgtctcagcctcctgagtagctgggactgcaggtgtgcaccaccacacccagctaatttttgtatttttagtagagacggggtttcaccatgttggccaggctggtctcgaactcctgagctccagcaatcctcctgcctcggcctcccaaagtgctgggattacaggcatgggccaccgcgccaggtaaactgttgattcttaataaatcccagtagagacgtgcgcttgcgtgggcaaaagctcctgccgaggccatcagacgcgttgttgaggctccgggtccttggctttaccctggagacccaagtccaggggccttgggtgcactcagatggagaaaggtggcagcaaggagttggatgtgccactgagacaaaaaccaacgctaatactcaccatccgtgcattgccttctgtaagcgtaacaaatgcctggggccacggtcaccggaaagcccctctccttgtccgcgcctggggtggcttcggggctcgccgctgagacgcggggccaggagcgagtctggcaacttccagagccctccgcccgcctcccctgcctcctgcttaggtcgctgctccggcggggtgaggccgggcgggagcgggcaggctgggcatggcccgcgaggcagggtagccggcttggagcgcggggtccgggaggcaggcgcggggaaggaggccgagcgcgcctgccgggagggcgagcaggaggcggcgggcaaagcctacttcgcttagttttgtgcgcctgacagcagcccttcagcaaggtgaattctttgaggaagggtctcattcacaagctgccaagacatccgcgacctattcttgaattcacacaaaaattaaaggaaaaacaacagcccaactaatttagcaacttgcaagaggcagctggtgctcctttccgcgcccctggggcccagtcttcccctccccaccgcctcccaccccgcccccacccccgcctcgcctctgagaggtctccccagagttattttgtatcctgcagctccaggcctcattgtgacagctgagtgacttagctggcaccgtgggatgcggaatgacaaaggcgcagagcatcggaggcccggtggcagcaggggatggcaagggatggcggaggcttgcagctctgaggaccccccatccagcagccgcctgaggtgcccagtcgcccattccacctccctctaaaataatgcttctatgaattaagtgagaggcttttgcagtccaaaaattggtacttccagtgtcctcgcaggctggagatggtggggtctcaggcttctgcatgtcctggccctgacagttctttttctgtcgctgccagtagcaccttctctctatctcatccattaagtgccaggtctcctgccttctgtccccgaggccacttcgctctccctggcttccccatctttgtgcctccttggtggtgccagcttcctctccagcctgggagaggtcatgggttccaaaggcctgtcctggcagtgccggcctggactcctgaaccgcccccaagggccatccttacagaacagtgacttcaggcctggactctgaattcagacctcactgaggggcaagtggagtgcaatgatcagctgctcagttgggaattctgacctccctgaaactgcttaacacctcagagcacagttttcttgtctgtaaaatggggcataatagcaatatttaaagagaatggttatgaggattacatgagccaattcagggaactcacttaggttgtaagtgctccaaaagtgttagctattattaataatattgttctaccaaacactaaagacatgttcagcaaatatgctccctcagtccacttcagcatcttgagttcccacactatcttcctcagaggttttgagtggagccacagaattacacaacactatccccaatatcagtccccaactcctttaattggcaggaataaagtgttctttccctagccaccctgtaaatcagctcataggtcattaactgttactaagagctccagactaggctgaggaagctgcaaagaggccactgaacagatactgggcagaatttctttctcttcagatacagctgtactcccaagcaacatccttgtttccaaaaaattctacttacacttatgagaaagctaattatttggaagccaataagccaatttctgtcttagtccattttgtgttgctataagaaaatatccaggactgggtaatttatacagaacagaaatttatttctcacagttctggaggctgggaagtccaagatcaaggtgctggcatctggtgaggactgctctctgcttccaagatgaagccttggtcgggtgaggtggctcatgcctgtaatcccagcactttggcaggccgagggcagcggatcacctgaggtgaggagttcgagatcagcctgaccaacatggtgaaaccctgtctctactaaaaatacaacaattagctgggcatggtggtgcatgcccgtaatcccagctactcgggaagctgaggcaggagtatcacttcaatctgggaggtggaggttgctatgagccaagatcacaccactgcactccagcctgggcaacagagcaagactccatctcaaaaataaaataaaataaaataaaataaaataaaataaaataaaataaaataaaataaagatgaaggcttgaatgctgcatcttctgcaggggaggagcactacgtcctcacatggcagacggcagaagggcagaaaggtatggctttaagaaaaatatttgggtcgggtgcagtggctcacccctgtaatcccagcattttgggagccgaggcaaacggatcacctgaggtcaggagttcaagaccagcctggccaaactggcgaaaccctgtctctactaaaaatacaaaaaattagccaggtgtggtggagggtgcctgtaatcccaactacttgggaggctgaggcagaacaatcactggaacctgggaggtggagttgcagtgagtcgagatcacaccactgcactccagtctgggtgacagagtgagactgcatctcaaaaaaatgaaaaaggaagatatttgggtcgtattgcatttagggaacacagtggttctccctgccatccatggctttgctttctgcagtttcagttacctgaagtcaatgtggtctaaaaatattaaatgaaaaattccagaaataaacaagtagcatgatgaaatctcacaccatccctccatcctttcttcatcacaagaagggtacaataagatattttgagagggagactacattcccataacttttagtacagtatattattatattttttctgtttttaaattattaataattattttgagatagagtctcactctgtcacccaggctggagtgcagtggcatgatcatgctcaccacagcctcaaccttccaggctcaagctgtcctcccaactcagcctgctaagtagctgggattacaggcatgtgaacagctaatttttaaattttttgtagagatgctacaataaattttgttgccctggctctattttattattaattgttgttgctaatcttttactgtgcctaatttatagattaaactttatcatagatatgtatatatagaaaaaaaaccatagtatatataggattcagtactatctgtggtttcaggcatccactgggaatcttggaacatatcccctgaacactactgtttgttaatttaggttaagcaataccacctgctatagcagaaaaacttcagcatctcttcggcttaacacaataaggtgtatttctcctgttacatatcagaacaagtgggaggagtctgctccatgcagttacttaggggtccacgctaatggcagctctgctaacttgtagctcatcatctggaacacatggcttctgagatactaccgaaggggaagagaggaatggagaatgactcactctggttcttaactctttgaaccagaagtaacacatatcatttcagcttctcatccattggctgaaactagccacatggttctaacctaatggaggggaaggctatgaaatgcaggggtgcacagggactatttggtgaacactaatttttctgctacagagaaagatattacaaattacaaataagctgaacttagagttatttcatgtcatcagttgcaattcaggaaacgaaatctaggaattattacagactgtttaccacaggttatgactccatgtgtggcattggaattggtagaaaacagatctcagtctcggtaacagatatgccaagtcacattggccatggaagtgaggcacatggagcagatgaataggctgcaaacaccagaaggggcagctcagataagaggtcctcaaaatatgatacttgattttggaaagagaaaaggtacaatgggaacagttccaagactatgtatgtacatatataccacagaaaaaaatagcaaatgtagtacatgtaataaaaatagaacactccattggtcaaatgctaagatgctacgtgtttaaagtcactcttcaacaaacacacacagagtagaaaaagtggttttagactgggtaacaggaagtactactttacggtagttaggaaatatattcatgcaggcttcatgtatttaatgaatgtctatgatgtgtttgacatttacaagaaatctgtaagcatatgaagtttacagtctaatttctgaatttagacagatagatcttagataaacagataacagatccttaaccttttattttacttaacattatttattactactatgtgcaagacactttggagaatataaagatgaaccaaccccaatcccaaccctgaagcaatttataggcaaggttgtaggctgagtgcggtggctcactcctgtaatcccagcactttgggaggccaaggtgggcggatcacttgaggtcaggagttcaagaccagcctggccagcatggtgaaaccccatctctactaaaaacacaaaaattagccgggtatggtggtgcacgcctgtagtcccagctactcaggaggctgaggcagaagaattgcttgagtctgggaggctgatctgagattgcaccactgcattccagcctgaatgacagagcaagactctgtctcaaaaaaaaaaaaaaaaaaaaaaaaaaggctcaggtgtggtggcttacgtctgtaatcccagcactttgggaggctgaggtgggtggatcacgaggtcaggagttcaagaccagcctggccaagatgttgaaaccctgtctctactgaaagtacaaaaattagctgggtatggcggtaggtgcctgtaatcccagctatttgggaggctgaggcaaagaattgcttgaacccgggaggtggaggttgcagtgagccgagatcgtgccactgcgctccagcctgggcaacagagcaagactcagtctcaaaaaaaaaaacaaggctgtatgaagctgagctatgccctcttacaagcagtctcgttactgataccagtaggtatcagagaggtatcaagctggtgaaatggttcaccagactgatccccttggccttccttgggatgcaacttgaaagatgaactttaacctgaagttcaataatgaacctgccactttgggaggccaaagcgggaagttcgcttgagctcaagagttcaagaccagcctggataatatagtgagaccttatctcattttttttttaagccggagtcttgctctgtcacccagtctggcatgcaatggcctgatcttggctcactgcaaactccgcctcccaggttcacaccattctcctgcctcagcctcccaagtagctgggactataggcacccgccaccacgcccagctaatttttttgtatttttagtagagacagggttcaccaggttagccaggatggtctcaatctcctgacctcgtgatccgcccgccttggcctcccaaagtgctgggattacaggagtgagccaccgcgcccagccaactttatctcatttttaaaaaatacatttaaagaggaaataatgaacttgccaacttgaatgacctgatgctgtctgcattggttaccttatagctggaaaggcaaattcagggcccctgtctgcaattatggtgaaaaattggccaggcgcagtggctcatgcttgtaatcccagcactttgggaggctgaggcgggcggatcacctgaggtcaggagttcaagatcagcctggccaacatggcaaaaccccgtctctactaaaaatacaaaaaagttagccgaatgtggtggctcacgcctgtaatcccagcactttaggaggctgaggcggccgaggaaggtggatcactttgagctcaggagtttgagaccaacttcggcaacatggcgaaacctcatctctactaagaatacaaaaattagccaggcatggtgacatgggcctgcagtcccagctacttgggaggctgaggcaggagaatcacttgaaccgaggaggcagagattccagtgagctgagatcgtaccactgcactccagcttgggcgacagagtgagactctgtctcgaaaaaaaaaaaaaaaagaataagaaaaaaaacctctttccagttagatgcgcacattaggttgcaaaaactggagaaaattgttagtagttaaattaaacttgacttatacttccttacccctgtaaatttataaagtagtccagtgattcttaaatgtactctggtcagttaaccagatacgaagatagtttcattgtctatattgaaatagaaaataaaaaaagaagaaaaaagtgagaaaatgaacatattgatataaagttgcccactcttttttcatgggaagggctatcttttattcagggagtatgttcttcttactattttgggggataaaatgtcctttattctgtgaaatgatgctgatagtagatagccattagttctttttaaaaatgtccttattatcaaaattaaaagttggtggccgggcacggtggctcgcgcctgtaatcccagcactttgggaggccaaggcgggcagatcacttgaggtcaggagttcaagatcagcctgactgacatggagaaaccctgtttctactaaaaatacaaaattagccaggcatggtggtgcatgcctgtaatcccagctacttgggaggctgaggcatgagaattgcttgaaaccaggaggcagaggttgtggtgagccgagattgtgccattgtactccagcctgggcaacaagagcgaaactccatctcaaaaaaaaaaaaaaagttggcaactctcagtttcctcaaattctttttgaagtgttactctcctacaaaatccaaaagactgtgaatcgcaaagttaaacactggggtggttcaaatttttgttttttagagacagggttctactctgtcacccaggctggagtgcagtgatggagtcatagctcactgtagcctccaactcctgggctcaagtgatcctcccacgtcagcctccccagtagctgagactacaggtgtgtgtcaccatgtctggctaatatttaaattttttatagagataggggtctggctatcttgcctaggctggtgtcaaactcctggcctccagccatcctcccatctcagcctcccaaagcattgggaatacaggtgtgagtcaccataccctgtccaaattttctttggtatagcctggtgctaaaaactgtctttattaagactatttggacatcactaattgatatgattagtgaaaggccacctcacctttgagtctcaaaacaaaaaccaaaagatccccgacaactttgttcttcaacaatctttagctaattctacaatctcttatcactctcctgtcttcctcagaatctctcatttgaggctgaggcatgtttctggtttatagaaatcaatggtcgggctagtcttgacctcctgggctcaagcggcctcccaaagtgctgggattacgggccctgtaattccagtacttttggaggctgtttgaacccaggagttcaagaccagcctgggcaacatggtgaaaccctgtctctattaaaaatacaaaaaattagccgggtgtgatggcatactcctgtagtcccagctaaccggaggctgaggtgggaggatcgcctgagcctgggaagttgaggctgcagtgaggcatgattgtgccactgcactccagcatgggcaacaggaacaagaccctgtcttaagataaataaataaataagaaataaatcaatggttgttcaccctgactgcacagggtgatttggaaaaatgctgatgaagggcccctctccccaaatattctaatttaattggccttacgtgggacttaggctctaggctggttcaagagctcctcaggtgattgctacgtgtggccagggaggcaaaccacaggtatgaatggtgtgtcttcattaagtagcttttatggcactagggcagttacacagatgaacaaactggtccatgcagtagaaaagctaattaggaaaacaggcaaaatatgacaagagagtagggtaaatgcttttatttattccataattcaacaaatattagctaagcacttaacaagcgccagtgctggagtgaagccaggctctcagtcctgtgggctacctgcaaaaaccaggaaaacttcacagaggaggcagcagccaagcaggaattgggaggagtgcttagccaaggtctttatcagataaggcagggagtgagggcatcgcagtgaggacagggtgtgctgggcacagacaagtggcaggctcgggaagctggagatgagatactagtgaggtgcagatatgcatacctttagaggactaaggggtttaggcttggtccagaacgcatttaaaagacgttaaaggttttaaagcaggaatgcataaattagatgtgggtacagaatactggtatttgagataaccccagctgttcataaaggcagctgtagctagaatttcctaaccagtttaatgctttgactgatcatcccccatcccctctgcccttgactgaagtaaccagacattgtgaccttgtggggtcagtttctagtcaatgaagggagaggattccatgtggcagttggaagggaggtgtagatcaatgttttttaagtgactaattgaatgtaaatagaattcaccatgggctgggccctggacaaatacgtttagcgtccttgcctgtgcctccttacccaatttcctttagaaggacttggtagtgcctctgtggatgtggtacctcttatcaggctgtttgtctgacttgcttcagagcaagtaaacaaacccaaaagatcaaaccatctgggttcccagaggttcctgcagctcctctgcactttattattcttgttcagaactcaaggacaaataggtcagatcatgaaatcagcccagtactagggactataaccttttggctaagacactcacagaagaagtaacttcctcggttggggaagaagaagatttagcctaggccagtggttctcaaatttagtgactgtaagcttcaagactagtcatgagctaaaaatatatttttgggagactcgcttcagacttactgaatcagaatctctggggttgggccaaggaaactgtctttcaaacactcattcccagatcattctgattccagtgatctgtagattgcatggagcagtataactagtcagtggttctggtctgtggtggtggctggcagctgttttggggttgtgggggacaggtcagataagcttctccattcataatcctccagcccagtaggcttgcaaaatttgcaccatgcttggttttcaattcaggctatttctaggttaatttcttaattgagctatttagctcagcagaggacctgagataccacagataagagagcggtttaggagtaagcattaaatatctctgactgtgtctcttattatcctttccagtcccacttatctgaagagccagatttctcaaaggacaagtaaccctagaggggagtatcaatgggaaagctatggattccttgccacatccccgttacagaactatgcttgttaagaacagaatctcaagaaaacatatcaagaggttgaatgaagacatttctctcttctgtattcctgatctcctggggttacaagagcacaggtttaggcaaacatagccgatttctctctaaggtgtctcttcacttcttgatgcactggagatccttgtggaataatacattagtgataatgagtgttgggtgctcacaaatcacccacaattcattggctgaaggcatcttaaacgtggactttttggcttttattgtctttagctgcttcttttaacatactttagtttgagtgtacagatttggggttttcaaacttgtttttaattaaggcatggtttatttttattgcttgagataaaatgcagtctgagggtcacaaatgtaatttacaaaataaagtgcatctgggcagaccataagaaaaaaaaagaacagaaagcctaaataaagagtgggccaggattcttaagtttatttagtaacttcttggagaataaaaatcccagcacctgcattataaaaaagcacaccttataagtgtccttctcttcgaaacacctaagtgaactacactgaattatgaactaactaatggtttgtaaaaattcgccttgagcaagctattgaagatactaaataaacgaggctgagacagagtctgaggaaacccaacctgctgtttgttttatcagtaatgtaactcaaaagtagccaagcggatggctggagttttctctgtgttttgtttccctgggctgagcctgtgaatgccaagatttaatctaaagaggtttgtgttttaaaaaactaacaaccaagtaataaaacacctataaaaactgtttataatggaaccggtgacagtttgtagtgtagtattacaattcttctgctccccctcgacctttctctatcctttcatccaactctgtgccctttgtctaagttcctttctcaccttgctgccaagaagctcaggaggagagggagctcacaccccaaagcagcagaccatctttaaaaaatgaagtgtgtgttgtggtctgcatttgaagacagggctgcgtgtgctgcttgttttgtctgagataaggacgaagataagttgtcctaacaaagtacctacctagttgtacagtggtttctaatgggaaggtgaagatgccgctgcagtgtcagtggcatgaggctgcaggagtcaaccagggcaggaagcctggggcctcccctccctggcacccggcatagccatgcccaggcccaagatggccctgactccagggacagacttcaggcaacaggtggttttccacccaggccaccatgcctgaaacttggttcttttgcaaagccatagttctcctccccctctcaaagaaatggcgcctgggagggaaacttcgtgctcaaactctctaggagccatttctcagcccacctttcctattttctgaagtctcccttgccagcatcccattcacctccggaaagaaccaggggcgctctcttcagagtccagagagctctgggaggcatgtgggcagcgtcagagtggcctcgcctgggcggccagaggagcccccagtctccctcaagtgggcctcaggaactcggggggcccaggggaagcctggaaaaccgaacttcgccatcagccttccttacagcgctggctaaaagagagggggggaagggccccccagcggtcttccccgcccccctcccgcctcagcccctctgccatccgcctgcaccgcccaagaaagcacccagaacgcggctgagctcgccagctcctcgcaggcagggagagagcatcctggggggcagcttccccctccagcccgcgtctgacatccccactcccacacaaggatgccgccgccgtgccctgtccgcagtcgctgaatgtcactgctccctcttcctcccgatcagggtagacacagctcccgaggcgtcccccaccccaaaactgccgcgatcgcccgaaggcgcaaagcctgggcgaaggacgaagtttggggcccacagcgacgggagtggggacgcgttggcgaggaccgcacctcagtcccagccctggcgggcacactccccgccccaaacggcccaggcgtccccatcctcccgcggacaccagcgtctccgccctcccccgagggcggcgagaggagccccccggggcggaggcaggtacccccggggcggagactggggcgggcggggtccgggctgcgcccccggccaggccgggcgggctggcgggcggcgcggggggagcggggctgggcggcgctgcctcgggctctgtgcgctgcagcccggagccgaggaggaggaggcggaggaggagaaggaggcggcggcggtgggtcccgggcggggggagcgcggcgctgcggacccgggcggctggcaaaggacgaggcggaggctgaggaaggcagcggggagacccaggctgcagcaacaaagggcagcgagcgattggccgggctgcaggcgaggttagccggggacccgggtggccggaggcagcggcgagcggtgcacgtgcttgcagacacgggcgagtgtggagccggggggtgcacgcccggtgggtaggggcttgctcccccgaggcatgggatggcgaggaggctgcagcgacatcgttctgcctgcacccggcctggggctggcagggtaggggtgtgttggggggggaaggatgcgagccagggggcgggcgagtagtcgcccgggacgggacgggacgggagagagggtggaggagggggcgggatggaacgctccgggcggcgcgcccgtccgcacactccaccgaaggagctggcgactgagaacctcgaattttaacttcgcgtgcccgcccgcgcgcgcccgcccgcgcccacccctaaatcctgcggccgccgccagcgatcagctctcacacaaactttagctgcgggctagggggtttggggttgagtgggggaggggagagggaaaaggcctcctgattggcgtcgtctgcagccaataaggctacgctcctctgctgcgagtagacccaatcctttcctagaggtggagggggcgggtaggtggaagtagaggtggcgcggtatctaggagagagaaaaagggctggaccaataggtgcccggaagaggcggacccagcggtctgttgattggtattggcagtggaccctcccccggggtggtgccggagggggggatgatgggtcgaggggtgtgtttatgtggaagcgagatgaccggcaggaacctgccccaatgggctgcagagtggttagtgagtgggtgacagacagacccgtaggccaacgggtggccttaagtgtctttggtctcctccaatggagcagcggcggggcgggaccgcgactcgggtttaatgagactccattgggctgtaatcagtgtcatgtcggattcatgtcaacgacaacaacagggggacacaaaatggcggcggcttagctcctacccctggcggcggcggcagcggtggcggaggcgacggcacctcctccaggcggcagccgcagtttctcaggcagcggcagcgcccccggcaggcgcggtggcggtggcgcgcagccaggtctgtcacccaccccgcgcgttcccagggggaggagactgggcgggaggggggaacagacggggggggattcaggggcttgcgacgcccctcccacaggcctctgcgcgagggtcaccgcggggccgctcggggtcaggctgcccctgagcgtgacggtagggggcgggggaaaggggaggagggacaggccccgcccctcggcagggctctagggcaagggggcggggctcgagggcggaggggggcggggcgggatcgggtgggggcggggttcggggagtcggaaggcgggggctgagagggaatttctgagtgggagtgaactggtaggagcggtggggggccggcgagggtgtgaggaagactagtgagggttgggtgggaggagaagctgaaggtgtagaagcaggtgcagagggagagttagggagggatgcaatttgagagaagtggaaggcggaccgaggggtgtgtgagggcaggtgagatgataccgaaggcgagattgcagttgtctgggcgcagagtaggtgggtttgggtgtggtggatgtggagtagagttgaagcggtgcagagtgttgggtttggggaggcgttgaggggtttggggaggcattgaggcgcatgtgaggagcaggtacgattgcagtgatgggaaagaggtatctgggtggatcgcatgttggaataagaaggaggtttgctagctttggggtatgaagtattttttaaaaacgtggaaggatgggatggttgtgcttgggagagtttctgaaagatgatgctaagacagcagagcaaacttaaatatgaaggaaggggagagaggctgcttagaacttgcaaaatctgtggcagaaaatctcctggggacaagggattggtaggggtgggacaaggcggcaggtgtgaagaaagtgggtggagctgtacagtaattttcggtgaatgtgatttggtggactgtgccaggggtgaggatggggcagagaaaggtgttagtttgggagacaagttgtttgataggctgtatttattattttttataaaaatgagaaaagggtctcactatgttgcccaggctggtctcgaactcctggcctcaagtgatctgcccacctctgcctgactgatgggattacagacgtgagctatggcgacccgtgatacgctggattcattatgttaaacttgatctggagtcttcaagggagtgtccggcagcagggtatcccaggaagagacatgcaccataccttgggataggacattttgcatagctttgaatttgctagtactttgctgtgggcagagtgcagggagtggtaggagatgaccaggcaaaggcagaggaggggttagattacaaatggtgtcctatgccccatgaaggagtttaagccctgtaattggtagaaggtgttgggacgtgttaaagagagtgttagacagaagttgtgaaggggtagtgataaagaattacagatgtgggaaataggaaatgaagaccaacgaaccaagtatgtttggggttggaggtaccaaggaaattcagggtagagcatatgagggcccctcctatatggacagaaggtggaaatagcaaatggaaattagttgtgttcgaacagtcttagttctatggggccccaagaaggttttttgtgtttttttttttttaaagtgcattcttcctgtcttacttgtataccctagattttttggcatagccttgaaataaaacactccatttttttcttactcataagttctttttttttttttttttttttttgagacggagtctcagtctgtcgcccaggctggagtgcagtggcgccatctcggctcactgcaagctccgcctcccgggttcacgccattgtcctgcctcagcctccggagtagctgggactacaggcgcctgccaccacgccccgctaattttttgtatatttagtagagacggggtttcaccgtgttagccaggatggtctcgaactcttgaccttgtgatctgcccgcctcggcctcccaaagtgctgggattacaggcgtgagccaccgcgcccggccattcataagttctttacacatttatcagaatgaatttggacagtattttatgtttttaagaaggaaaggataatgcacatgttttttcttttccgagaacttctactgagagttaaaggttggagtggtgaagtgatggtttaaaaaaaaaaaaaaagaaaagaaaagagagagacagaggaagattttaacattaaaagaggaatttagggaatggctgatggtcatgacacggtcggcagaggaagttttgcttactagccacacttaggcttctgagtagagtggatattatgtcattgctattatagcatgtgtttatttcacacactgcttttgaagattgggtggaaactgtcagatgtgaggcatagcatgaatgaaaggtaaatagcatgagtattagaaagtagatgaggaagtttaataattttaatgtgcttcataagctctcatggactttcacgtatcaattagtaaaagacgtaactaagtgatctggctttcagtctcctagttctctacagtgtaccctcagttttccacgtgcttacacatgcctacatttgtactgagagaaaaggaaatagttttttttttttttttgagacagtcttgctctgttgcccaggctggagtgcagtggcacgatctcggctcactgcaacctccacctcctggattcaggtgattctcctgcctcagcttcccgggtagctaggattacagacatgtgcccagctaatttttgtatttttagtagaggtggggtttcgccatgttggccaggctggtctcaaactcctgacctcaggtgatccactcacctcggcctcccagagtgctgggattaaataaatagttttatgtggctgggtgtggtggctcacgcctgtaatcccagcactttgggaggccgaggtggatggatcacgaggtcaagaaatcaagaccatcctggccaacatggtgaaaccccatctctactaaaaatacaaaaaattagctgggcatggtggcgggcgcctgtagtcccagctgctcaggaggttgaggcaggcgaatcacttgaacctgggaggcggaggttgcagtgagctgagattgcaccactgcactccagcctggcgacagagcgagactctgtctcaaaaaaaaaaaaacaaaaaaaaaagaaaaatattttatgtaagtagggatgtgtaagctgtagtgatcagtctttgttgcagaatggtaaatgatgcgtggatgagagaagtggggtgatgggatatttcttccctttaatgccttaatttgcatttccaaagcacctttaagcatctttttatagaactcccatgatcttctgatacctgtcttctcgcagaccccagaaagagaatacaccaattttcgtatcatctattccattgttgccgaatatttgagttgtttcaagtttggggcaattgtgaacaaagctgctatgagcattcctatacctgtcatctggtgcccatgtgcacaagtttctctaaggtatacacctaggaatgaaattgccggtttatagctagggtgaccatttgtcctggtttttgcttattttcccagcgtaactgtaacacttttagttttcaaaagtatctagggttagatgatgaattgtatggtcacctagtcataaggtatgcttgtcttcatctttactaagtaccaaactcttctaaagtattgtaccaggttacactccctccagcaatatatgaattcccttgcttctcgccctctccaatctcagcctttttagcttttatgattttagccaatatggtaaattttgcgtttacctgattagtaatcagattgcacagctcttcatatatatatatatatatatatatatatatatatatattttttttttttttttttttttttttttttttttttgagacggagttttgcttttgtcacccaggctggagtgcagtggcgtgatcttggctcactgcaacctctgcttcctgggttcaagcgattctcctgcctcagcctcctgagtagctgggattacaggtgcccactaccacaaccagctaattttttgtatttttagtagagatggggttttgccatgttgggcaggcttgtttcaaactcctgatctcagttgacccgcccgtcttggcctcccaaagtgctgggattacaggcgtgagcctctgcacccggccagctcttcatatacttttttagccatttagatagcctcatttataaagttctgttcaagtctttcccaccctgcttttaaaagttgggccttgtatcttttattgctatttagaagttctttatttactgtgaatacaagtcctttgtcatgtgtgtgtgttgcaaatactgtggcttgccttttcactctctttatggtgtcttttaatgaacagaagttcttaattttaatggagtcaaatttattggtctttactttatggttagtgccttttgtgtcttgttttaagacttttcctaccctgaggtcaataagatattctcctatgcagtactatctttttaaagctttgttgaccttaaacaatgtataactatgagtaaaatacactcttcttgaccccagcctcaccattacaatctatttttgctttccttcacttttttctgttctctgtcttgaatttttacttctctgcagctataactaagagccaggtgctgacttctcctgtctcttaggagaaaatggtcatatagacagaagttcagccagattagattttacaggtctccagctgactgtattgccctttttccttttatgagctagcattttattgtgttcctgctatgtgtctgccatcatccttgctgctttcatatttgttatctcagtgattcctcttaacggttctgtaaaacagagaagtattctcatttttacagaagagaaaacagagacttagattgatttagtagcatgtccaatatcccctagcctaggtagctagcagaatggggactggatccctgactctgatacttcccatcacagcacacctacttgttgattaaaatgtcagaaacctgttttttgataacatccaaaaccaaaaagaataactttcttactcttgatgtaacatgccttaagtaaagcacacaaagctaactattgtgaaactggataaaatacctctctgtatatagccagtggaccttaagtggtccatggctggatgacagaaggtctgttaacccttaaaaatgtataccagtgtatatgggtacatgtgcttattttttagagtagagctataatatttatgaaactctcaaaagggaacctgaatttttcagggtatctggatatctggtctgaagacatctgtaatacagttaacaaagaatcctgtaataatctctctttcaaaagaatcataaaaaagttaagatgtcagatttttctcagccaggtgcagtggctcatgcctgtaatcccactactttgggaggctacagtgaaaggatcccttgagccctggagttcaagacatgcctgggcaacatagggagacccccgcctctatttttatttatttatttagattttttggtatcttcattttatcttatttattttgttgagatagagttttgctcttgttgcccaggctggagtgcaatggcgtaatcttggctcactgcaacctccacctcctgggttcaagcaattttcctgcctcagcctcccaaagagctgggattacaggcatgcgccaccacgcctgctaattttttgtatttagtagagatggggtttcaccatgttggccgggctggtctcaaactcctgacctcaggtgatccacctgccttggcctgtcgaagtgctgggattataggcataagccaccaagcctggccttgtatctctattttaaaaagttttttaaaaatcacattttttggccgggcatgatggctcatgcctgtaatcccagcactttgggaggctcaggcagctggatcacaaggtcaggagctcgagaccagcctggccaacatggtaaaaccccgtctctactaaaaataaaaacaacaacaacaaacaaacaatggcatggtggcatgtgcctgtaatcccagctactcagaaggctggggcaggagagtcgtttgaacccgggaggcggaggttgcagtgagccgagatcacgccattgcactccagcctgggcaacagggcaagactctgtctcaaaaaaaaaaaaaaaaaaaaaaaaatcacattttttcccttaatacattattctcggtctttgtcatcaaaaaccaactaaagctaatttgtaattagggagaaatctaggattgaataggaatttttaaatgccaaaaaaagacactctaaatttagttgattatttcttaagtgaaagtgcttagttataatacatcattactaatcagtgtaccctggctccaaagacctgatgacttcaaatgacttttcatcttgtctctaaattcctctgttttacaagggatcaaatttcctgtgaggttcctaacagtgtgattaaattttagagactgaaactattgagcacttaaatgcagggataactatgcaaacctaattcatgggtttcaccaggagatttgggacctgtctctactaatttatgatgatgatgttgaaactaatctttgctagggattatggaaaccataatagtttattgatggttcagttattgtttgttgaagcacatttacacaattatagtttaatgacataacaaggatattgtcaactaggagagcatgacatgaaaaattaaacttgcaattaatataatatgtattagttgaaatgataatttttatggtgatttagcctcttagaaatccttggaaaacattattagcttatgaattgaaaactctctttgttaatgagtagtgggaaagaacttagtgttactctaaaaagatggggaattaaatattcagttcaaccagcgttttattgagtgcctgctctgggcttgctgctgagttaggctcataaatataagttgaacaagattgatgtttgcagagatgaaatactggttgcttttgttttttctttcaatcacccttccctccagagtagatggctactattgccagagtgattcaaacattcaacaggtttgtgtgtgtatgtgcatgcccttccctgtgcattatggtgtcacctgctcctgcagtggcttcctattcatctgtcacgttcacacaccacagcttggcttttttcacagccaactttatttctgttttttttttttttgagatggattctggctctgttgccaggctggagtgcagtggcgcgatctcggctcactgcatccaccacctccggggttcaagcaattcccctgcctcagccttccgagtagctgggaccacaggcatgcaccaccacgcctggctaattttttgtattttagtagagatggagtttcaccatgttggccaggatggtctcaatctcctgacctcgtgatctgcccgccttggcctcccaaagtgctaggattacaggtgtgagccactgtgcctggcctatttctgtttttcatttttaaattatatttgtcttttttagagacagagtcttgctctattgcctaggctggagagcagtggcacaatcatagcccactgtggcctcaacctcctgggcggctcaagagatcctcttgcctcggtctcccgagtagctgggtctacaggtgtacaccaccacagccacctaattttttatttttgtagaggtagggtcttgttgtgttgcctaggcttgtctcgagctcctggcctcaagtaatcctccttccttgacctcccaaagtgctgggattagaggcatgagccattgtgcctggcccaacttaatttctttatcccttttgagcatatacctgttctagtcaggcacatggacttggtgtcccttttgtttgacagctcattcttagcttctgttatttcactttgatttccttcattcattccccgatacatttatttagcaaataggcattgaaaccctcttatgatcaagttgtggtcttgggaaatcttagggtatacaaagatgaatcaagcatgaatcctgtttttaagaattttatagtctagtaggggtgacaaggttaatacacaagtaagcataatactaagtgggaaatgaatgtcaaaacagtaaaaaagctaaaagcttcctgttagacaaagatgtttggggcttttgagaagttgtttgcactgggccatgaaggatttgaatttgggcagagggacggtggggcacttatccaggctcagcattatctttcaaggttcagtttcagtcccatccatccaagagatgttcatccatcctccacgtggtttcagcaaggtagtatagtcacagttgtttccagacttcttccttctgtaatcagaggaacacttcctttaaagcgaatcttatggggaagacaaatatatgtaaaacagttaaagtggagctgcactgttgggttcaaggtgctgcaatggcccaaagtttaacccacaaggggtacctgaaggtaatacccgaagtaactccttgtcacagagatctaaagagcctagtttgaaaacctctggagagacagaaagagtttgggctttggcatctgaattaaaatccttcatgacttaatggctctgagatcttggctaagtcaagcctgttttccttttgtaaaaacaacaatgctaccttacagagttgttttaaagtttactgataatctatgtaaagtacctggaccacagtaggtgtcaggaaatggttggtattattattattattatagtttagtgctttgttatttctttttttttaaacaatttattgaggtgaaactcacataacataaaatgaaaaaaccattaaaaagtgaacaaatcagtggcatttagtacattcagtgttgtgtcaccactgccactatcaagttccaaaacatttttattgatcccaaataaaaccccttacccattaagcagtttctctagatatgtccctgagactccaccaatctgtgttttgtctatggatttatctattctggatgtctcatatgaatgaaattatatgatgtgtggccttttgtgtctggcttctttcacagcataacgtgtttgaggtccatctacattgtagtagcatgtatcgaaacttcattgctttttatagttgtatagtattctagtgtatggatataccacagtttatctgttcatctgttgatggacatttgggctgtttacaccttttggctactgtgaatagttttgttatgaacatgggtgtacgtgtacttatttgagtatctgttctcaattcttttgagtctatacctagaaatggaattacagaaccatatggtaattctgtgtttaactttttgaggaaccgccaaacagtgctttgctatttcttaattgcttcttatatgttctgtctctagctttgctttgtattccccatagtacctaccacagggctgcatgcagggagcatcagctcgctaaatatttgttggtttttctttgattagtatttataacctcacctcccagttcacatgttttgggcctgaagcattgatttcagaggaaatagatgcatccaggatttgaaagataagaaatatcaccatatggatggcgtttcatgttgtcagacaacagatatttgttaaccaaggacactattttgagcaactctgccaataacctgagctgggtgctgatagaagaaaaataagtcaaggtcccttcccctaaacagttctgttctgtttcggaagatactgcttagatttgtggatgctcactcagttacacaatgggctttgaaaaaatccaggttttccaacagtgatccctttggggaaaaaaaagaaagaaaaagccaggacttatgaaagtaaaatagttaaaaataactgttagcaagtaaaactcaggatgacaaaagtgtaaactctattattaatctttgtttttttctaccactgttttttgcctcatccataatctcatgacttgagtgttatgacattgattttgaaacaacacacacagctttagtaaaagcttagaggaggcctcgcataatacttatgatccaggatattttgactcttcttatgctgacatgaatatttctgaatagtgttgatgtttatgtaataccagtgaagctaaaagctcagtgctggactaagcatttctctagatatgtttagaatatttgtaatgaatgatgtaaatagtgttatattataagaccgtatgatacaaccatataatttactgatattttgtagttaaaaataaaatgattcacaaccttagaaaatagaataatttaatttgatgtagcacaaatccccagaattaatttaggatgatttgctacctttttgatagccttttagtccaaccttcaagtttttatagaaaaaaaatgaaaagagaataatgattttagggttttcgcttgtgatagaatgtcctatctacatgtgaagcaaatccccatgctctgaaaaagagaaatagtgtggataattccaaatcaggaaaaaaaaaatcatttctatttggcttttgaatgaattatgcatttttttttcctgtggatttgtctttccagttagatactgcttaggctaaaatgaaattggttttcaatctattctcttgcttatatgaatttacagtggggccagtgggatgttggaaacaaatcagcctaagattaaaaaatttgcggtggataatatacaaagtggataatatacatgtgtttagttgagaattggctacagataagagacttctgattttgttcctctcctagctgtgtattttttttttttttttgaacactgtgattctgcttgtagcaaagagctgctgagttacatctgcttctgcctaattaactctgttggttggtgtcagatgagagctaattttgagattaaatcgaggagtggggtgtgtgtcgtggctgggggaggggagaaggaggatccaaggttgcttgattgttttacgtaagatcaaaatgcagttattcacaattgttcttttaaatttattttttgcttttcaagtaaaaataatcactgctgtcctaaaatgtgacttgtgtcaatacatatttactattatgtaaactggtacgtttttcttgtaggtgagcttattggtcatatctgggtagtccattcagtacctaggtgcctggtggcctttgggacaaacagcgaatgctgcccaggaatgtgaatgctgaccttaaaacaacttttgactgtctttttttctgataaatgttatatctgtttggctatttgagtagtagtgggtttttgtttttgttttgtttttccatgatgagattttttcttaggaatctatcacaaacctgatttttaaaatttgaacaggtctgggcttagggatgaaatttacttctataggcacttggctgggtccttggggcttcattttctgtctcaagtttcatatttataagaatccttcagtggtctaaaagaattattatatcaccaaatgtagtataataactcattggagctgtttgtcttgaatggttgtggagatacacggatggttgctgaatttaaggatgtccttatgtccaaatgaacatttccttttttcttttggcagatttgcctgaagacctggataatctccatttttgtcatggactgttaaaacgtttgaagttccaattctggtactttcccttattttattacatttttaaggtataaaatgacaatcttattgaaatgtgttggtaatggatataaacaattgttttatggatataaatgattgtgggtaaagatttgtgggctgggtgcagtggctcacgcctgtaatcccagcactttgggaggccgaagtgggcggatcacgagatcaggagtttgagtccagcctggccaacatggcaaaaccctgtctctactaaaaattcaaaaattagctgggcgtggtggtgggcacctgtaatcccagctacttgggaggctgaggcaggagaattgcttgaatctgggcggtggagattgcagtgagccgagatcatgccattgcactccagcctgggcgacaagagcaagactctgtgccccccaaaaaaaaaaaaatgattgtggtaaaagcttgtcatgaaggtatattttaggtatctattagttatgaaacacattttttttttttttttgagatggagtttcgctcttgttgccgaggctggagtacaatggcgcaatctcgactcactgcaacctctgcctcctgggttcaagcgattctcctgccttagcctcctgagtagctgggattacaggcgcatgccaccatgcttggctaattttttgtatttttagtagagacggggtttcaccatgttggccaggctggtcttgaactcctgaccttgggtgatccacccgccttggcctcccaaagtgctgggattacgggtgtgagccaccacgcccggctatgcattttgttttaatgtacgttcgtttgcttgtgtaacaaaacacctaaaagcaacttggcaatattgggcacttttcctgtgacctcttctactttctgcagttgtattttgtgcaatcaaattaaattagttgtgattcatcctgaataaatgatgaaagattaaataattacttggatacagtgaaatatcttctaatgaaattttgcccgaaaccattttacttgggaaagatcaatttcctgttctaaactaactgacagagaatgattctgtgttctatcctgaaagtggttgcactgtgaaagccagtgatttcattcctaaacacactgtgttccaagtctaacatttttgtcaagggtttatataatgaaacaaaagtgagtacttattagatttgtagatgacatagatgacagaatcaagattcaaaacaatctttagcaggttggaagataggcttaaatcaacgagatgaaattgaacggtaataaacgttaaattgcagcatttcaatttgcagaaggaaaggggtggaaagactcaacttgacagcactttttgaaaaaagatctgggatttttagttggactgcatgctcaccatgaccacttgtgtggcaggggtattgaggaagttcctgtaatttgggttgcatttataattggataatgcctgaactgtcatattttaagatggccaatagccaaactagtgagcaaccaagagaaagtggtgctttgaaacaatgtgatatgtggaagggttaagaaactgggatatgagtggtctaagttatggctggaggtagcatggggttttgtcgttagtggttttcaaaaggtacttgtttttggacatttgaaggcctctcatactgaagaaatactaagaattgtcttgggatccttccagggaataggactagttaggaataggaatagggtcgaagttatggggtggcagatttttgcttctctgagcaagaaatttagctagagctgtgcaacagtggggtgagctgcctcaaaaagtgacaaattatcaatcactggaagtattttaaaaatgtaaagactcattgcccatctatttgggatattgggcagggatcttttattggataactagaggttggactggatgaccttcagccccaagtttctgaatctgaggggagaatgagtagagtgaatttacagcttactgatcacagggacaatcttgtttaaattgcctcctttaaggtggcattttgggttggcatttaaaactgtactgtttgaacaagtatagttcaatgacccagctgtttttcagcaacattccaggatctctgagagcaaatactatattcttcagtatgtctggctaaagtttttaaggaaagatattattttcttctcttaggtatagtctgtctaaataaataaccagagataactttaattttgtattttgttataaaaatttcaaagtatatagatgttgcatttgatgaaagtgataactatatattgaatattagataatgtgtttatttaatcctctcagtagtcctgtaagggatataccagtattgcctacaagtaaagtgatggaagcttaagttatccagggttcctccactggacattgtggtagggctggggttcagacccaggttggtctctttgcagaggcagaactagctagagcaggcagttgtggctcaggtgagaacagtgatggacttagttggattttagaattggctgggcacagtggcttacacctataatcctagcacttttgagaggccgaggtgggctgaggtcaggagtttgagaccagcctggccaaaatggcaaaactccatctctactaaaaatacaaacattagctgggtgtggtggcacattcctgtaatcccagccacttgggaggctgtgcaggagaatcgcttgaacccagaaggcagagattacagtgagctgagattgcgctattgcactccagcctgggtgacagagcgagactctatctcaaaaaaaaaaaattaataaaaaaaattaatgatgttcgaccctttaatctgttattgactcttcccttgggtgaattccatcttctcccgagcctcagtttacccacaaagttctgcagtttaagtgacaagttatatgtgagcacactctgtacagtttaaactataaaaagaattaagaagtggatgttatcattggacaccaagattagagctcaggtttggcccaattcccaggccaaggctctttctccttgtagcctctttgtagatgtactcaataccagattggagatctagggtggtttttgtatataccaagcatctctcagaacaaatgccactgtccacctggaatcagatttgtatatatcttctttgtactgagctgtttaatgagctaactgggtattaagataactagaatgctctactacttaaaggtgaagggttatgttactgtattattttcagttttccaatttgtgggttagagggtatcatagacctctgttaaagggatggggatgtgattccatagaagtagctagatgggaagtttttttacgtatgagacttgggaaatacaatacctagctgaaagctggattatttactcttttttttaagtttaagattttttgaaataagtttaatgtactttcatcagattttttatatcatagacttattctttgatgtgtattttatgtttatggcagacatatacctcaaaccactttcatataattttgttaatttcaataaatataattaaatgtataatttagatgtgattatgcctcataaatgacttcatatagagaagtgaaacattctaaaaacaatttcttctcagactgtgacccaatttcttgttgaaaaatatagtcactgtggctgtgttatgtaatacctgcctgtcattacttcttgtggtcattctgtgtctgaaaaagtcatgctaaagaatcttttagtttatttgtgtaagcttcattattaagagactttcccctctttttatcctttaaggtcttgatttcccagttaaagatgttcttcacccgaatgcagtctttcctgttggtaaaataagacaaccatcaacattgcctgtttgtctgcttttgaatctcttaaggatggatgtttgtaagatgttgcttaatacagtctggaatactctgtccatttgttgaattgtaaatgactttcaaatgtgcaagttctgttaaatacaaagagaacctctatgggtaacttttgtgttgaagaagtcatttgtcaaccatggtaaaacttgcaaacccactttatacagagtggattcttgaagctatacagaaaataaaaaagcaaaagcaaaggccctctgaagagagaatctgccatgcggtcagtacttcccatgggttggataagaagacagtctctgaacagctggaactcagtgttcaggatggctcagttctcaaagtcaccaacaaaggccttgcctcctataaggacccagacaaccctgggcgcttttcatcagttaaaccaggcacttttcctaagtcagccaaggggtctagaggatcatgtaatgatctccgcaatgtggattggaataaacttttaaggagagcaattgaaggacttgaggagccgaatggctcctccctgaagaacatagagaagtatctcagaagtcaaagtgatctcacaagcaccaccaacaacccagcctttcagcagcggctgcgactgggggccaaacgcgctgtgaataatgggaggttactgaaagacggaccgcagtacagggtcaattatgggagcttagatggcaaaggggcacctcagtatcccagtgcattcccatcctcgctcccacctgtcagccttctaccccatgagaaagaccaggtaagcgaaggagtaatgttcgtgcattctcactactgtccttttgtcttttacggtttcacttaagttttatgtggacaaaagttctgaataaagtttgataaaattgaatgttttgccttagagcaggcttttgtattttaaaatgtatatattgtactgcattgtgtggaggacttcctcactggttggccaagaatttaatggaagagtcatgtggtttgtttttaagctctaattgctaactggttggtgtctgaagggaccaggaaggataatattgatctttcttcatccaggcagggtcatatatatttcagaaatctacgaaaaggccatcgtatatttttctctttattactattttcaaagaagaatctacagacttcttattttactattattatttttttgagacagaatctagctctgtcgcctaggctggagtgcagtggcgcagtcttgactcactgcaacctctgcctcccaggtttaagcgattctcctgcctcagcctcccaagtagctgggattacaggcacctgctaccacacctggctaatttttgtatttttaatagagacaggacttcaccatcttggccaggctggtctcaagctcctgacctcaagtgatgcgcccgcctcggcctcccaaagcgctgggattagaggcgtgagccaccatgcccagctagacttcttattttaatggtgataatctatgcttttttttttgagatggagttttgctcttgttgcccaggctggagtgcagtggcacaatctcggctcactgcaacctctgcctcccgggttcaagtgattcttctgcctcagcctacctagtagctgggattacaggcacatgccaccatgcccagctaatttttgtatttttagtagagaccaggtttcaccatgttggccgggctagtctcgaactcctgacttcaggtgatccacccgctttggtctcccaaagtgttgggattacaggcgtgagacaccatgcctggctgataatctatgcatgtaagaagttattttaatacgtcacctaaatccctcatttcaataaaaagtcattttttattgtccacttctctgtgttgtaggtgaatgtttattttgtctcatacagtatctttttaaaatactctgatttcttgggccttatgttatttctatagtatttataaatatatggcagaattctccttacattactgctaccactttaagtttttggttgagtaagatttgtctttgtttcaaagctacagtatttacttcccaaactaaacacaaagtagagcagcagaaagttatttatagttcatgtctagttttggggtttattctctgtcttttgggtgagcagatatattgatatcagttaattttattaatacatgttataaaacattaatcattgttgatagaaaggtggttttggctgggcagggtggctcctgcctgtagtcccagcaccttgggaggccagggtgggaggatcacttgagcccaggagttcaagactagcctgggcaacatagtaagacccctgtctctacaaaaaaatcaaagaattagccaggcttggtgaagcacatgtgtagtcccagctacttgggaggctgaggtgggaggatcacttgagcatgggaggtagaggctgcagtgagccttgattgtactccagcctgggtgatagagtgagatcctgtcccaaagataaagaaaggaagaaagaaaaggtggttttggccaggcacagtggctcatgcctgtaatcccagcactttgggaggctgaggtgggccaattgcctgagtttgagaccagcctggccaacatggtgaaaccccatctctactaaatatacaaaaaaattaggcaggcgtggtggggggcacctgtagtcccagctatttgggaggctgaggcaggagaatcccttaaacccgggaggcagacgttgcagtgagctgagattgtgccactgcactccagcctgggtgacagagcgagactctgtctcaaaaaaaaaaaaaaaaacaaaaaaaaaaagaaggaaagaaatggtggttttattcatggtttactgcagccttgaccttttgggatcaagtgttcctcccaagtaactgggaatacaggtgtatgccaccatgcccagctaagtttttaaattttttgtagagatggggttttgccatgttgcctgggctaagtacagtttagaaacaattgaaacatgcatgttaggaaaagttatgctcctcttgtttggataccatgaacccttgaaatggaacctgttttcctcaatgctttagatcagatcagcccatggaaaggcaaaccacctggtcctacaaattggataggaccaggtggtttgcctttccatgggctgatctaaaaggctggagtgcagtggtgtcacctcggctcactgcaacctccacctcccgggttcaagtgatgctctcacctcagccacccgagcagctgggactacaggtgcacaccaccacgcccggctaatttttgtactttttgtaaagatgaggtttctcgatgttgcccaggctggtctcgatctcctgggctcaagacatccttccgcctcggcctcccaaggtgctgggattataggcatgagccactgtgcctggccaacatttatttgttaactatatttttattttgttagtcttctgccacatttatttgatccttaggtggttgttgtgtttgtgtaaccaacctctagttctctgtggcagaatgtgggcataaagaaagaagtaaagttatgaaattttcttcttaataacatttgtttaaaagaaaatacaaaaagccacttaaatcctaattcatatgtctgacacagccaaatcagggacctctgtttttaattaaatacatatgtatatatatatttttgttttgtttttttgttttttttgagatggagtcttgctctgtcaccaggctggagtacagtggcatgatcttggctcactgcagcctctgcctcccaggttcaagtgatttccttgccttaacttcccgagtagctgggactacaggagcgtgccaccatgcctggccaattttttgtattttagtagagacggggtttcaccatgttggccaggatggcctcaatctcctgacctcatggtccacctgccttagcctcccaaaatgctgggattacaggcgtgagccactgtgcccagccttaattaaatattttttataaaagcttatactgtgaagaaattccttaagggactatagagccatttcttgatggatttggatatctttgtttttaaaaatatgtacactaccctaaggtatgttaaggttttataatgaacaggtacgtggactaattcaggtagctttaggcaatttaatagtatgtttcaataattttgtgatccaggggatactttttacttgtgatggaagagtcagtacaaattttccacagtatcttctgatccttcgctttaaccttgcccgtcatttcttgccaaccttatcatatttttttcaggcagcatctgtacagaagtatttttagtctaaaggaaaattcatgtctgaaagtgtctaggattgagagcagagtaatttattgcttagcaggcaattgttactgctctttttatgatgctgatctttaaattgtttagttagcatcatgctataatgaggaaagctgagaaatgttttctagaatttttacttgatgaaatttggagactaattctattaagtaatcatttgattcttaaaaaacaaaaataaataaaaatcagtttaaacaaagttggcaacatgtttgtattctttaatgaaatagcatttttttccagctgggtgcagtggctcatgcctgtaatcccagcactttgggaggccgaggtgggtggatcacctgaggtcagcagttcaagaccagcctgaccaacatggagaaacctcgtctctattaaaaaaatacaaaagtagccgggcatggtggtgcatgcctgtaatcccagctgctggggaggctgaggcaggagaattgcttgaacttgggaggcagagattgcagtgagccgagattgcgccattgcattccagcctgggcaacaaaagcgaaactccatctcaaaaaaaaaaataaataaataaaatagcatttttccttaaaaaatgtgagaaaattacaacataatatattaccctttgaaattaaaagtgatttaatagtttaaaaccatgtaaactcgctaagtaaatttaatagaaattcttagcccgggatccacaaatgaacttgggtgggtatcccacaaatcctctgaaatagagtgtgaagtcatgtgtgtgtatccatgtttttctttttttttctttttctttttctttttttttttttttgagacatagtttcactcttgtcacccaggctggagtacaatggcacaatcatggcccactgcaacctctgtctcccaggttcaagtgactcttctgcctcagcctccctagtagctgggattacaggcgtgcgccaccatgcctggctaatttttgcattttcagtagagacggggtttcaccatgttggccaggctggtcttgaactcctgacctcaggtgatccacccacctcagcctcccaaagtgctgggattataggcatgagcctctgtgcctggcctccacatgtttttctatggctagggtctatagcaagcttgtccaacccatggcccatgggctagatgcggccctgaatggctttgaatgcagcccaacacaaattcgtaaactttcttaaaacataaagagatttttggcttgcggcgtggtggcacacgcctataatcccagctactcaggaggctgaggcacaagaattgtttgaacctgggaggcggaggttgcagttagctgagattgaggcactgcactccagcctgggcgacagagcaacacttcgtttcaacaacaacaacaagaacaacaacaacaacaacaacatttttttgtggtttttaatttttttttttttaagctcactagctattgttagtgtattttatatgtggccctagacaattcttcttccagtgtggcccagggaagccaaaagattggacactcctggtctacatcttttgtcaaaggcacccaaaatgcctagtagccattttaaaatagtttgagtttcttatactaaatcatagtatgctaattgtcgacctatgatgattcttcctttggctgctgaacttggattcatatgtagattgattgtactataatttcctatatataagactttttctaatatatttgaaaagattatcattgttcttgatgtgcttgaagtcataggatttgccttgcattgtgggaggaaatttatgatataagtgaaaacagttcagaaatggagtgatctcaattacaatctagtcaactaatgccttttttttgagacagagtgtcactgtgtcacccagtctggagtgcagtggcatgatcttggctccctgcaacctcagcatcccaggttcaaacaattcttgtgcctcagcctcccgagtagctgggattacaggtgtgtgccaccacactgggctaatttttgtattttagtagagatggggtttcattaatgttggccaggctggccttgaactcctggcctcaagtgatccgcctgccttggcctcccaaaatgctgggattatagacgtgagctactatgccccatgcctggcctaactaatgacttttttttttttgagatggaatctcactctgtcatccagactggagtacgctggtgccatctcagctcactgcaacctccgcctcccagttcaagtgattctcctgcatcagcctcccaagtagctgggattacaggcacgcaccaccaagcccggctaattttagtatttttagtagagacagggtttcaccatgttgaccaggctggtctcgaactcgtgatctcaagtgatccgcctgccttggcatctcaaagtgctaggtaggattacaggcttgtgagccaccgtgcctggccatgactttcaagaagctgtttattctggttacttttttgagcagttacattaaatgtaaaacaaaataaaaatagtaagaataataactaacgttttgtaagtgttaaatgctggcactattccaagtgctttacatttattatctccttgacttgtcacaataactgcaagggaggtagattattacccttattttacagatgaaaaaatgaggctgaaagcttaagtgatttgcccaaggtcactgatagagctagtgagtggtgaagccaagattctgacgagacagtctgacctcagagctctttaccactgggcagtacactggtcaacagtggtggctttttttttttttttgagacagagtctcgctctgtcgcccaggctggagtgcagtggcatgatctcgcctcactgcaagctccgccttccgggttcacgccattctcctgcctcagcctcctgagtagctgggactacaggcgcccaccaccacgcccggctaattttttgtatttttagtagagacggggtttcaccgtgttagccaggatggtctcaatctcctgacctcgtgatccacctgcctcggcctgtggtggctttttattaacagtaaaagtatctcttccagttcttcaaatgattagaagcagttttgccccaacaaatagatttccagcattttaaatttggtagatgcaatgagcttattatagtttttaaagtagatactatttataatattagcaatatggaaaggcagtagagaaagtagtaagtctgtgtctaattagattgaacatcatcatcattccgatgcatgactgctaggaggaatacaatgcaagttaaaatagaagggctccttcctttctgaaatgtaattgcacatcttctgatagtctggaattcaaattgggtattaccacactggcttcttagcataaattctttgtatttatttaagaaagctctcttcggtgaggtgatatggaaatgaattaaaccactgaagataaaactttatctttgacttggtgagggaactcctaaaggatagtattaatgtttctcattaaaagtagtaaagctcaattaggtcagattatgaggactttggaaagtcacatattctaagagagacttccattatcactgcgcactttgtagcattaagattccatttgaacatttgagctttagcatttttataaaatcagtttagttccatttaaaataaattccatagtatttcactttagtgagaatgtcttcataaaatttattaagtgtcaagtcttggtctgtttccagtgtagtacataatgtgggaattctcattctaggttggcatcgtaattggaaggtgggacactttcagtatcaagtagggcttctgatgttttttctgttgaagaaatatttgtattagaatcttacaaaaagccttcaaacataaacaaaattacaaaaacagtgatactgtcaataagaaaaaaatcaaaatgatttttttttttttggatacagagtcttgctctgttgcccaggccggagtgcagtggcgcaatctcggctcactgcagctgccgcctctcgggttcaagcgattctcctgcctcagcctcctgagtagttggggattacaggcatgtgccaccatgcccggctaatttttgtatttttagtagagacagggtttcaccatgttggtcaggctgataagaatgattttttttttttttttttggagatggagtcttgctatgttgccaggctggagtgcagtggcgcgatctcggctcactacaacctccgcctccctggttcaagcaattctcctgcctcagcctctggagtagctagactacagacgtgcaccaccacgcccagctaatttttgtatttttagtagaaacggggtttcaccatattggccaggatggtctcaatctcttgacctagtgatccacctgcctcggcctcccaaagtgctgggattacaggcatgagccactgtgtctggccacaaaatgatttttaaaaggagttcagatgatcagaaatggggttgaaagacaaacgtaggacccttgttatgtgtggtcttggcttattcagttgtttattctatttctcctgccccttttagagagatacgttgttagggtttttggcactgttattaatatgaaatatttctacaaatagaagataaatgtacatcctacagcagttgcttgagttgtttacacacatgaattagataagtttatttttagattttcttttcttctgttttctccattctgttttctcctcttcagtccccttaaccctgccctagagcagaccctcctcatctgttctgggacttttccaatagcctgtactttatgaaggactattcattagtccatattgttctttgatgtggcaggcttccagaagtctctcagccctaggggaattgttcatagtctcaggcaactctggatcttttttggcagaaatgtgtatattttttatctgctaattatagagcctgaatgtcctcctctctgttgaccttcttagttttcctttgaattggtatcctttgtgttgcagatgtcatctttcttgaagagtgcttgattatgtgtatttaactgaaaatcgaataaatctctaaatattgtaaaatatgctcttcaaaataacctgcattttggaattggtatggataaagtcagttttagaatcactaaagtcagacagaaacctattgtaatgtgaaagacgaggtggatcaaatacttgctgttccagggtcatggaaggaaaaaaattgcagttcatgttcttcttataattaagcttcagaagttcttcacaatagcagtgtctgaggactgcttttgtgagcaggtagtaccagttgttgagacattgttgagagagcacatgaattgtctcaaactagttagttgggtcaagggaaagataaaatgaagggtgaatgagtctttctattgtactctgaggcatgacagcgtgttccacttttgagcttttatcaagatgggacttgtctagacttctaatgaaatgggcttcaggtaaagtagaaacattatgtcaagaggatttttggttgttcaaatgaatgttaaacattcttttaactctttggatcttagatagatttgatagttgtgatacctttactgtatgtaacacatgatcctgtcctgaatgatcagcagctttcaggagttactcttgtattcccagctacatttgtgatactttcagtgctaagaaaatctatattctgtagctttgaagttatttaacagttaagtactatttgctggtttattctgattttgtcttaaatgacaaatattttattcatcctttctcttcaaacattatttaacaaatgtacgttttaatgtttctcaaaaatgaaggtctatattctttttatatgttttatctttgtatgttatttctttcatctttttttttttttttttttttctgagacagggtctcactctgttacccaggctggagtgcagtggtttgatcatggctcactgcagcctcgacctcccgggctcaagtgatccttgatcctcccacctcagcctcctgagtaactgggactacaggtgtgcaccaccttgtctggctaatttttttttttcttttttttgagacagtcttactctgttgcccaggctggagtgcagccgtgtaatcatggttcactgcagccttgaccttcccaggctcaaatgatccatcctcccacctcagccccccaagtagcttggactacaggcacacaccactacacccagctaatttttgtattttttgtagagatagggtttcgccacgttgcccaggctggtcttgaacgcctgagctcaagcagttcacacacctcggcctcccaaagtactggggttataggcgtgagccaccgtgctcagccttttatttttaatatataagaaatgccttttttttttttttttttttaatttgagatggagtcttgctgtcttgcccaggctggagtgtagtggcatggtctcggctcactgcaacctccgcctcccaggttaaagcaattctcctgtcttggcctcccgagtagctgggattacaggcatgtgccaccactcctggctaatttttttgtatttttagtagagacgggggtttcaccatattggccaggctggtctcgaactcctgaccttgtgatctgcccacctcggcctcccaaagtgctgggattagaggcatgccccaccacgcccagcccattgttttatcatgacagtagcaatgtgttttaattgtaaaattcttgactttttgttttgtttataaacttccttttcttggccctgtgccttaaactacagtagattaggtgaaactgttctctgatcacactagcatttaaaatatgaacctgaatcttctcaggtactttgatctctccaatctattaatgtttctgagtacataaacatcaattagctcaccaaattaaagttagcaaatgcgtcagccatgtaatttgcatgtgacattttgagttagcagggccaagagggaagtatgtttttgtgagtgggtgtgcttatctctctgtcttcaggtggtgatggaaagttgtacatgtaagagaaggagttgtggcagtggatatgtgaaatgctaactgtacatatgcctctgcttggggcagaagcactttaccagagaagtctccaacagttgcaaactacatattctttttccttatataagtgaatcttttaattagtgtaatattatgtagagtgtatgttttttctgtttttttttaatgaaaggtgatattttgataaatctgcaaaatgagcaatatagacaacattttagagtgaatgatactagatttaaactatgaggctggtctctgcaaagatacaaagtaaatactaatcactggtctaagcaaaatccaggaaggatttttgttaatttgacaagtgggtttagaattctttagccactattttttagaaaccagctttgttcatacatcctttctctaatttgcctcacttttgatctgtgataaaccagctgcaatttggtttcattaacaaacttaactggtcaacagatgttttggctctattttgtcctttctattagaaacagcataggcgtacacagaaaccatgctgggccttttcctgtctgtagctcgacaggcgttacagaagagcaacctaactttacttacaagttcaatttttcttcctcagtatttttattataggtatacaaacattgtagttttgtctcccccatcaagtcggtcttttgttgttaatcttccatctgttagtccagtatacacttctcaccctgctttttagcattgcaaaatcttagcatgcagggaaaaaggtactattgcaggagaggtaattgagatatcagcgactcttccacaattcaagggaaggagtggaactagcctggtgaatttagataatttcttccgtcttctttgatgtcagtgagctgccatatggagagcagtgaggcctgcaggaaggaggtgagccttggtctgggctgcctagggtgttcagagtgacatgggctgagagccagaggcagagcttgactgtttctgttagtagtttctgatgtgaccagccctgctttttgtccaaggtttccctgtcatgcttgccaccctatgggtatgatgaagtttaagaaacagatcataaacattatcttgggaaagagaaacataagaacatattaaaatctagtaataaggccattaaaagatgactcccatttgatatttgaccaacttgttttcaaaattagtattgtaaacacttctgtcttataacaaaacccagctttagctgttgagccttgagttgtgagtaaagcagcagaaaacaggatctgctagtggaagagtattggctgtttgaagaacatcagctgttccaggtagactcctggcagtgtgtgagcagacctgggaaaggcaggcatggagggagctaggaaaatacttctctcctaacctttataatttataaaattagagtatttcataaatattaaaagagtagtacagtaaacactctatttctttcacatagattcaccaattttaacattttgccacattctttctcttcctatatgtgtgtatatgtatatgtttttatacatgggtgtgcgtatatatacagcacatttatatattcacaattttgactaaactgttggaaactaaattacaaatattatatttcacccctaaatacttaataatatatcaaaaatgttctcttatatactatactattacgcaaaaaattcggcagtggaatgagtgttaactgacagtccatatttccccaaatggccccaaaatctcatttataacttttgactttttttgagatggagtctcgctctgttgcccaggctggggtgcagtggtatgatcttagctcactgcaacctccacctcccaggttcaagcaattctcttgcctcagcctcccgagcagctgggactacaggtgcgtgccaccatgcccggctaactttttttatttttagtagtgatggggtttcgccaggttggccaggctggtcttgaactcctgacatcaggtgatctacccgcctaggcctcccaaagtgctgggattaaaggtgtgagccactgcgcctggccaacttttgacttttcatccaggatccaaccaaagatcatatattgcatttggctgtcatgtcacctttaatagagaacagttttccctcctttttgcttctgaagacattgacatttttgaagagtctagggtagttgtcttgtaggatgtcccacaattagtatttgtctgactgtatcctcatgattagattcagagtaaacatttttgacaagaatagcgtgtgggggtctgggagtggtggctcacacctataatcccagcactttgggaggctaagatgggtggactgattgagctcagaagtttgagaccagcctgggaaacatggtgaaaccccgtttctacagaaaatacaaaaaaatcagctgggcgtggtggcatgtgcctgtagtcccagctacttgggagactgaggtagaaggattgcttgaatccaggagatggaggttgcagtaagccaaggtcacaccactgcgctccagcctgggtgacagagtgagactctgtctcaaaaagaaaaaagaaaagaaaaaatactgtatgggggatgttgtatatttcttcttgtgagataccaggagataaataatttcagcttgtctcattactggtggtgcttagtttatcagttggttaaggtggcatctgctagatcttcgtttataaaggcgccttttcccttttgtaattaacaagtaatctgtgcaatgatactttgaaagcatgtgagtaacctttcacccagtgtgtattagttttctattgctgctgtaacaaattacagcaacttaatggtttaacacaacacaaatgtattgtcttacagttcggtaggtcagaagtccaacatgggtttcttaggttaaaatgaaggtgagggcaaggtaatgttcttttctggaggctctaggagagaatcttttcccttgcttttttgagcttctagaggctgcgcatattccttgactcatgatcccttcctccatcttcaaagccagcaatgttgcatctctctgactgttctttcacagtcacatctgcctcttaccacagcctggacagtttttcagcttttaaaggatgcatattattagattgagcccatttggataatccagataatgcccttatctcacagtccttaactttatcatatctgcaaggttattttgccaggtaaggttctgggcattaggaagtagacatttttgggggagcccattattttgcctgccacacagggtttagtattgtcacctaaatcaaattttgcattgggggttgcaaatcattgaaggttttgggctatggtgaaccatgatcaagtctgtttagaaaggaaagagggccaggtgcaggtagctcacatctataatcccaatgctttgggaggccaaggcaggtggatcacttgaggccaggagtttgagatcagcctggacaacatagtgagatcccatctctagaaaaaatttttaaaaattatccaagtgtgatggcacagaactgtagtcctaactacttgggaggctgaggtgggaggattgcctgagtccagaagtttgaggctgtaagtgagctatgatcgtgccactgcactctagcctgggcgactgagcaggactctatttcttaattaaaaaaaaaaaggaaaaaataaccagaaaggaattaatcacagtttatgggagtaatgctagctgaaggccgggggtcaagaggcctgagttttgagtctcatggtacatcctgagtcatttccaggagagcaggaacgggggcgtgcactcttgcctccacttcatgtccctttactcactagttgaagaactgaagaatggatttggcactaatagcttcagagtttttaacaatagaagtttggatgggcaatttttttttttttttttttgagacagggtctcactttgttgcccaggctggaatgcagcggtgtgatcatggctcactgcagccttgacctcctaggctcaagcactcctcccacctcagggtcctggaactacaggggcgtgtgccaccatgcccagctaatttttgtatatttgataggcatgggttttgccattttgcccgggctggtctcgaactccttggctcaagcaatctacccaccttggcctcccaaagttctgggattacaagtgagagccgctatgcctggcccaaaatgatttttgagaagtacatttaaagttgtagagaagggtctttcatttaaatgcccacagggtgcatgaaaaatacaaggtgatttatcaagataggctctttggctcatgcctgtaatcccagcattttgggaggccgaggtgcatggatcacttgaggtccagagttcgagaccagcctgggcaacatggcgaaaccccatctctactaaaaatgtaaaaattagctgggcatggtggctcacgcctgtagtcccagctactcaggaggctgaggcaggagaatcgcttgaaccttggaggtggagattgcggtgagccaatattgtgccactatactccagcctgggcaacagagcaagactccatctctggaactcctgatctcaagtgatctacccaccttggcctcccagagtgctgggattataggcataagccagtgtgccctgcctttgatgatatttcaaagactaagtaacatctgaagaattttatgtcttttatttatttatttagacaacgtcttgctctgttgctcaggctggagtgcagtggcacgatcttggctcactacagcctccacctcccaggttcaagcaattctcatgcctcagcctcctgagtagctggaattacaggtgcctgctaccatgcccagctaattttgtattttttttttagtagagatggggtttcactgtgttgatcaggctggttttgaacccctggcctcaagagatccagccacctcagcctcccaaagtgctgggattataggcgtgagccactgtgcccagcatatatctataatttaaattagaaccctcaatcagagaagtctaaataggctgaaaaagaaactcatttatttaaaaaagaaaaatgacatgcagatggatgtatattatattcttttagtttttagtaaaaattcagaaaaataaacatgaacttgaggtaacgagcctctagaattcttcattttatttcatttcacaatgtttcagcagtcttctgcagttagttggaaggttttggaaattctgactaatccagttgttgaagaataactagttagcttaataaatatgttttctagagctgataaaaaagatgattttttcatctgatgagctctgaccctctataaaccttctaacttaactcattttccaccagctacagaaatgtaacaagatgccaacaattacatcctcatggagcatgtatactagcttataaaatcacccctttgttggaaaattgtgtaatatcttgatttcaatttagcatggcatgttggttagcagtaaatcttgctagtgtatgaacacaagcctgcaggcagtttggagaacattgatcaggtgtaaattgtatgtatttttctcgcttctaaaaattttatagcagaatgaaataaagagctagcattgagaacactttttcagttgttttttattttttatttttatttatttttattatactttaagttctagggaacatgtgcacaagtgcaagtttgttacatatatatacatgtgccatgctggtttgtaggttgttttttattttgacatgtatcttgtggaaagtgccttctctctcctgaaatccatgatttgtgtctctgaccacttaggttccccatttagtatgtgacacatagcaaaagcaaacaagcatagttaaaacgtgtatttgtgccttgtgaaatgtgcattataagcagttaatactagatttgaaggctgtacaaaaaacatgcaaaaagatattaatattaaatacttagtgcttattgtgtatattaagcatttaatatatacaatataattttgcatgaactctgaaagataagtactgttattaactgaattttacagatgaagaaacaggccaaataaggtgacttgcccaagagtacacaggaagtattggagctggtgtttcaatcctggtgcacaggcagagtgtagtgtagtcactttatcaccttctgcctctcatttcttcgggcgaaatcaacacatacctagtgaattcttgcaatatataaaacactgtattaggcacataatatggaagttaccacatatctaaatggtaataaaagtgatcagttgaggctaggcatggtggctcacgcctgtaaccccagcactttgggaggccaaggcaggaggatcacttgaggccaggagttcgagaccagcctgggaaacatgacaaaaccccatctgtaccaaaaatacaaaaattagctgggccaggcgcagtggctcacacctgtaatcctagcactttgggaggctgaggcgagtggatcacctgaggtcaggagttcgagaccagcctgaccaacatggagaaaccccgtctctactaaaaatgcaaaattagccgggcgtggtggcacatgcctgtaatcccagctactcgggaggctgaggcgggagaatcacttgaacccgggaggtggaggttgcgggagctgagatcgtgccattgcactccatcctgggcaacaagagtgaacctccgtctcaaaaaaaaaaaaaacattagccgggtgtggtgacacacacctgtaatcccaactcctcaggaggctgaggcaggagaatcacttgaatgccggaggccgaaggtgcagtgagcagagatcacaccactgcattccagcttgggtgacagagcgagactctgtctcaaaggtaaaaaaaaagaaacatgctaatacatacagctgttattccttttcaaacgatcattggagtgatcatcacttttagagcaattgaaattttaagaatgaataataacaaccaacatttataaaatgctttactatgaggcaggcactacttcaagtgctttgtgtataacctgtttgtaaggtaggactattcattcttcgtttacaaaggaagaagctgaggcatgtcaggtgaaaggacttgcccaagattacctagctattaatgtggtagagctggagccaggatttagacccaggcatccaagctccttgatctgtacatgtaaccattatactacattacctctcattttcctgatgaagaaaacttcttttaatgagaaggtattgaaaatagtttcatattaggttcttataaacatgagcctttaagtgcctttttactgtttataatagacgtcactgagaagattgttaaaatttataatatgatatcattaaagtagcttttcccaaatgatgttctgaggaagaaggaagtactctacaagaaattaatgatgctaataatagtctgagatttacagtacctgagtagttctaaaatttaccttgcctaacccaagatgatttgacgatgggcctctctcctctttgtcttcatagcagccattcacttgtctagaaatctttgcatttggttaagcagtttggatagtgctgatgtaaggttatagtgctaattcctttgcttatttcttctaaatacacatcccaagggaaaccattgattaattaaacttggagtttgtccttcagaatagaaaaccaaaaatcatcaaattcaccccttgtctctattaatgtattgatttagtaatatttatgtaattctttaaatgtagtataaaactttagagttgcaggagatctttgagatcaccaagtccagggttttaaggctaaggttcaaggagcccttttttctggggtttgtagacctctgaaattatatgcaaaaagagtatttttctggagcttcttgcccctcctctccttcagcaggtcatttgacctaggccagtggttcccaaactttgctgcacattagaattactggaggagcttttaaacgttagatgcccagatcacacctccatgctgcttaaataaaaatgttggagtgggagtcaggcattagaactttttgaagtttccttgtgatgccagcatgcatcacatgctttcttctttaatagatgaacaagtaggatctacttatgtggctgaggaagcaatctagagatgttaattggtcagggctctgcttcctgctaaaagagattttagagatcgttctgaaggagtcttgtggggaagtggctctggagctagaatgcttaggttcaaatcccaagttttcctcagctgactaatagggatgataatatagcactgaccacactgggatagtcgctgcctgagctacagaggtggtgagcttgtcctcagcctcaacagaaaggtcagctgaacagactccaaggcagtggagggacggcagcccccagcactccactctgccatactgtttgggaaggaaaagctgtaaaccgatgtcctcattaccttctaacgaagacctcctctcctcttgctctcttacgccaagaatggctagaatccgtttctctttgtggctccttccaccccacctcatgttatttaagtaatcagaaaaggagtctattattttcagagtaacacatgctccttgtacagactttgaaaaacagaaagatttggagatgatacattatcactgcaaatttgactataaagataactactgttgaaagtgtgtattttcttccagtcttttttccttttttcctacatgtaaatatgtatgctatatttaaataaaaagaagactgtgtgagctatataattttgtatcttcctttctaaatttaaaatctgttgtgagccttttcccatattcttgattattctttgaagctgactaaatagctgcatagtatttatgtctttatccttcaaaatttaaggtgctcctaaatcttctgctattacaaataataccgctactaaaaatttgtgcatgtgtggataattatttcccatagaatagattactaaaggaggtaatactgaggcatgactatgaattctttttctaaagctttggaagcatattatcaaaaactgttccaaaaagatagtaccaatttatacttatgggcagagtataagggagtgtgggcatctaattgattcttaatgcttaccttttgtcatgttaatgtagtagagggaagaatggatccttaggagttactttgcatttctttgattactaatgacttggacattttaaaatgattaatggccattgctaaataacagtgttgtggttatttccccatccttattcctatgccctgcagataagcatcttcaactctttcaaccacatttagtctggcttcttagggaagttggaggtctgtaatattcttacgctgttgtttcttatttttaaattgtagacattatctgttgacttcttgcgagtgtagataaggataaaggtccctcatacacatacacttttctctttccctttgcccctcttatctcaatatacactacttttatgtaggtaagtatatgtattcagtgcttatatttttatgagtttgtaaatattattcacacttgagccatcaaaattttttgttgttgtttttttgagacagggtctctctctttcagccaggctggagtgcagtggcgcgatctcagcccactgcaacctccacctcctgggttcaagtgattctcttgcctcagcctccaaagtagctaggactacaggtgcacaccaccatgcccagctaatttttgtattttttgtatttttttgagatggagtctcactgtcgcctaggttggagtgcagtggcgcgatctcggctcactgcaacgctccatctcccaggttcaggcgattctcctgcctcagcctcctgaatagctgggattacaggcgtgctccactacgcccggctaattttgtgttttttagtagagacggggtttcaccatgttggccaggctggtctcgaactcctgacctcaagtctgtataaaaaagcctgtatatgttctgtaaagacgcaaccatccacttttttcccctcaggtattttatttatatatttggagacagggtctttctctgttgcccaggctggtgtgcagtagtgtgatttcagctcactgcaacttccgcctcctgggttcaagtgattcttccccctcagcctcctgagtagctgggattataggcatgggcaccaccccaaccctcgactaccccaggtgttttgaattgaggttagttgactccacacatacagaggtccaactgtatataaagtaaagagtaaaagttttacctcattggccctgtgtgttcttctctgaaaacagctttccaaaggcagccacacttggtggtttgtatgtattcttacagggctttttaaagcacttgtaagctaatattatacctacgtttatgtatttcttgtaacagaaattgggatcggactttggtattttttcttttgaaaagtttttagatatataagacatatatgagtacattcttcttgaaaaagttctaatagcagaaagaaagtgtcacacaaactccctgagtctcacttaccttatctgtaaaatgggaaggattatatattcttcatagggttgttaattagaatttaatgaaattatgcatttaggtggcctaacacagtgcctattcaataacaaaaatgagctagttattttgaacatgtatcagctttggaatttttaatgaagagcattttggcatattactgtatagtttgacagtggtcttttgatttgctcagtcctttttcagggtcttacagaagaaaaggagagtcttacatgttttccttcatagctttgtatgctgtaaatatgagtttagtttaatagcagagtttttctttcttttttgaattaattatttggattgcttcctctctactgccttcaagccaaaagctcagagtttcccaaaccaaagtgtgcctcaatcacaatttttaccagttttatacaatctgtattaattattttatcttttttttttttttgagatggagtcttactctgtcacccaggctggagtgcagtggcacaatctcagcttactgtaatctccacctcccaggctcaagcgattctcctggctcagtctcccaagtagctgagattacaggcgtgcaccaccacgcctggctaatttttatatttttagtagagagggagtttcactgtgttgcccaggctggtcttgaactgctgaccttaagtgatcctcgtgccttggcctcccacaagtgctgggtttacaggcatgagccactgcacccagcccctgtattattttcttaatacttgctttcacattaccgcactaaagaggcataataaccaaatgccgtgcatggaaaacagtacagttgacccttgaacaacacaggtttgtgctgcgctggtcaacttacgtgctgatttttttcaaccaaatctaatacagtattcatggatgcaaaatgcacacatacagagggctgattttttgtctctgtgggttcttcagggccagctgcaggacttgagtatgtgtggattttgttatagtctgaggtcttggaactgatccctcatgtataacaagggatgacaatattaaaaaattacttatttgggggataattggatacatttgaatttggattacatattaagggaacttaatggcattaatgttattgttcttcaatatgataatggcattttgattatctaggatgtctttatgagttgggagatgccttcggaagtatttaatggtgaagtgtcttgatgtttgcagcttactttcaaatggttcagcaaaaatcatactaaaatatgtatgtataaatatatgtgtgaatatagacagatatagataaagatatgaggcaaaagataggacccctaattgttgaatctaggtgaagggcataccagtgttcattatgctacttcaacttttctgtagggctgaaagtttttcaaagtgtaaacttggaaaaataaatgtaattagaatatttacttaaaattaaattgcctcattttctttatcttagtagatttactaaaaaaaaggagtctatatcattattgtaagtggaaaacaagcattccttgccataaatagaagataactgtaaaagttattattttaaaaagtttcagctggatattgttgtctgccaaggctctgagcctgaggcctgctctctcaaaagaagattaacaagcattagaggcgttaaacacaatattagcaccaaaatgagactttcttcttgacttaatgggaaggtatgaaagaaaattgaaaagggaacaagtttctcattctgtgtgattcagctcacctcataacatctcaagtctcacctcaaggcatcttgagtaccactagtgatagaatcccacacttggggaaatactgtatcaggtgatttcagtgtaatgtgttagaatgaaagtaaatttttatattaaatactgtttatagtgcccattatgtcttttttaaaccttgtatgttggtttatcatcatcattattattatttggtagtctcgataactagagctagctgcatggttagctgcgtgatgtcctggcttagggcagatgtcagatattgcagtctaaattattattggggtatacttattctattttatgatatgcagtgttgcctgactctcgaagcataataaagccaattgagatctttaaaaaattaattattattgatttcttactctgaagttgctcttgtagtgggtttttgctatatatattttttctttccttctttttttcttgctacattgttcctgctgttatttggaaggcactaggacattttgcctcttgaacaatgaaaggatccagatcgtgtctgtctcacattttgttatcccagtacaagactcaattgaataaaacatattacccatctggcctggaaatctcagtggcactcaaaataacttactaacaagttgttggatcatgatatcttgagattttctgaaagttcagcttctttttagctgttgctaagagagaaatttcattgacatgagggacacgaggacatgtctgcacactgccagttgttttagaggcatttggctctgccgccttgcagatggttagactctgggtggtgggtgaatgtatgctgattatcttattgaattaaggtaaccttttgtcattcattgaattctgcagaccagttggtcagtgagcagctgctccatgtggcttggtttgggttttgaagtacacaaaaactatcttaaagggtggtcagtctaatccaggtattcaacaaagcaatattgaaagccttcttccccttttgacactgttttctgttctgatggaagtgaatgagcaaaaatatttttactttttgctcaattaactaaatgattgaagcaaaggtttatggaatggccgaataagaattttttaacctagtgctttaagttgaagaaaatacactttcataatatttggtgtcagaaacattctacttttatggcatggtcttatgtttgaagatacgtggtagagtttttaaagtttatttttacaaatatctagaaactaaaaagcattcttttttatcatgcatgcttaataacatcatcttgacaaatactagctgcataacttttggtttgtagggttgttttaagatcagttttttgtttgtttattatattttaagagacggtgtccctgtcttgcccaggctcgtcttgaactcctgagctcaagcaatcctcctgcttcagcttcccaaataactggaataaatctgccatattttttctatatggcttccatttcagtttctagaaactctttcaggaggcttcattttaaataaagaggttcttaattgtttttagtaaattgctgaaattgtatggctcatttctcttctcagagatttttatcttgagctgatccttttggttttactgaaggtgcaatataggtaacctcagagaaagtgactttagccactagttgatttgcttattgtcagagagaaatcatttaacagtgattgatgaggaactgtttaatttctccagtttagtcacctgttgggccctagagcctttcgattcagagctcactgtttcatttgcatttatatcctagtaactatcataatgtctaccagtatttattaagcacatattctgtgctgggtgtcgccgtttatatatgctctttcattttgtcctcaccacaactttatgaggcaggtcttgttagctccatgttagagatgatacagcagcctcccagggatgttcattcacttgtctggtatcatgcagatagttaatggctgggccatattggagtccagggccttcagactctcaggctcatgctcccttctgccctgctgctgttttaatgaaaatcagccttgttctgaaccacagttttacaatgaagcttaagattaaactgaaaatgctcaagttctctgttagggcttcagattctatgtctatacttgtcttattaatggtaaaaataatgtaacaacattaaagaaaaattttgaagggtgaaacactgtttagactcttgccaccttaatacaaccgttttgtttttgcttatttccttccagatttgtttatgcgcgtgtcctttcacacaactataatcaaagcatatatacagctatgcagttttttttttaaacatagtgttattttatacatattttctttttaaatgttcttttttgtttttgagatggagtctcactctgttgcccacccagactggagtgcagcggtgcgatctcccctcagtgcaacctctgtctcctgagttcaggtgattctcctgcttcagcctcccttgtagctgggattggccatgcctggctaatttttgtatttttagtagatacagggtttcgccatgttggccaggctggtctcgaactcctggcctcaagcaatctgcctgcctgggcctcccaaagtgctgagattacaggcgtgagccaccacgcctggctttaaatgttgttctttaaaaagacttttcccacctctttgaatttcccaatctcaacgaggtcccttttataattcgaacaaaggaccatatgctttttcttattagcctttattatagtctaattatgtatttatttgtctggctattttgtaacttaagttgtcccctctaaatggaaaagcttcatgaagacagggaccttatttctgctgtatggatgcaagcagttatttattaactaagattaagcttctgtttatctgttacctcatctgtcagaaacagttggacagattttcaccaaacttagaaggtttttgaagggcatctgtggtgatcaggagacacatgacatatattttctgatcctgtgtctgagataacatacagagatttcaaacatgagacctggctgggtgcagtggctcatgcctataatcacagcaatttgggaggctgaggcaggaggatcagttgagtccgggagtttgagaacagcttgggcaacttagcgagaccccacctctacaaaaatacaaaaattagacaggtgtgatggcatgcccctgtagtcccagcgacttgggggtgctgaggcaggaggatcaatcacttgagcctgggaggttgagtctgttgagtctgcagtgagccatgatcacaccactgcattccagcctgggagacagaacaagactctgtctcaaaagacaaaaaaccccacgaaaaaccaaatatgagaccatgagacctatattgaagggcccaagggcagattgtcaagatggcagaccttggtttgcactttagagttgggtagcttcttaacttgggctgttccacatcttaatctaggatgagcagcaacaaggatgtctttatttaataatgaccaacaagtctcccagtcacatactgactaatttcaaataaatgcatttgatcttttcattttcattttgcttgtttaaatataaattgtctattgaaagagtttttttttctttttgagacagagttttgctcttgctgtccaggctggagtgcaatggtggatcttggctcattgcagcctccgcctcctgggttcaggcgattctcctgcctcagcctcctgagtagctgggattacaggcatgcgccaccacgcccagctaattttgtatttttagtagagacggggttttccatgttggtcaggctggcctcaaactcctcacctcaggtgatctgcctgcctcggcctcccaaattgctgggatgacagatgtgagccaccatgcctggcgtttttttgtttttttttttgatatggagtcttactctgtcacccaggctggagtgctatggcacgatctcggctcactgcaacctctgcctcccgggttcaagtaattctcctgcctcagcctcccaagtagctgggattacaggtgcccagcaccacgcccaactaatttttttgtgtgtttttagtagagacggggttccaccatgttggccgggctggtctcaaactcctgacctcacgtgatccacctgcctgcctcagcctcccaaagtgctgggatgacaggtgtgagccaccaagcctggcctttttttttttttttttttttttttgatatggagtcttactctgtcacccaggctggagtgctatggtgccatctcagctcactgcaagccctgccttctgggtccaagtgattctcctgcctcaacctcccaagtaactgggattacaggcacacaccgtcatacccggctgatttttgtatttttagtagagatggggtttcaccatgttggccagactggtctcgaactcctgacctcaagtgatccacctgccttggcttcccaaagtgttgggattacaggcgtgagccaccatgcctagccctcatatggtttatgagtacttaagacatgtttgattcaatttaaaaaataattacaagctgggcatggtggctaatgcctataatcccagcacttagggaggctaagacaggaggattgcttgagcccaggagtttgaaagcagcctgagcaatatagagatactctgtctctacaagaaatttaagaataggctgcaacactcactctaaggggagcattgtgaggtataccaagatgagtaagaacaatatggtttagcatgccagaacaaggaagtttcaggtgctagaaacacagacatcctcagctcaaacaggaacgcccagaacagtatacaagaaagcctggagctggagtcagaagactggctcccatgtgtggtgtcctaactctctctagacctcaatttcctcatatgtttaataaggataacaacctactcttcagcccacctgagaggacaggatgcttcaagaaagacagtgagcagcaggtcctttaaaaatcaaaggaaaacaggctcctggataggtgtgagatagaagtgaattatggcacatacgagagcaacaataaattatcctttactaacagtaacctaagggaaatgcccggcattgtgtctggcacagactagatactcagtagttcccttctcacacttgctcagccctgtttgaacccagacagagagcagctcaaaatatgcaagtattacatactcacagaacctggagacaagagaagcggcttctaggcacatgggctcccatccttgcagcagctggtatagaggttgcatgacaacttgtgaggattctgcagtagcgtgggctcagctacatgacctaaataaaggtctctttcaaccctgagattctgtaagtttctttttctttagacagagtctcactctgtcacccaggctggagtgcagtgacacgatctcggctcagcgcaacctctgcctccaaggctcaagtgatccttccacctcagcctcccgagtaggtgggactacagttgtgtaccaccatggctggcaaagttttaaagtttttttgtagtgacagggtctcactatgttacccaggctgattttgaactcctaagctcaagcgatcctcccacctcaggctcctgagtagctgggactacagtcttgtgccaccactcctggctaattaattttttttttttttgtagagagggggttctgctatgttgcccaggctgggtgaactcctgggttcaagtgatcctcccactttggtcttccaaagtgttggggttacaggcatgagccactgtacctgtcttagtttatgttttaaagtcatcgagagacatgaaaactaaatggtcctaggttggaggaagaaaacttactgtaaaggacagtattggggaaaactggcaaatttggaatatgtactgactgttagatgatactcttatatcaatgttaagtgtcctaagtctgataatacattatggaaatgaagagaatgaccttgttcttaagcggggtgaatgatcatggtctttacaacttattctcaaatgattcacaaaagagagataaagcaaaagtggccagttttaaagggcatatgggtgtttattgaattattcctgcaacttttctataggtttgaaattttttcaaaataaaacttttttgcccaggcatggtggctcacggctataatttcagtgctttgggaggctgaggtggaagtatcgcttgaggccaggaattggagaccagcctgggcaacatagagagatcccatctctacaaaaaatgaaaaaaaaaaaaagccagatgtgatggcatgtgcctgtggttccagctgctcaggaggctgaggcaggaggatcgcttgagcccaggaatacaaggctgcagtgagctatgatcatgccactgcactttagtctgagcagcagcaaaataaataaataaataaataaataaataaaataaaactttttaaaggtcaccgaggctgctgtgtggccaggggagctatagaggagcaagggtagaggagggcaagcctgggaggaggcctttgtgaggatggaggcatagactggggttttgacagtggggatggagagatgaggacagatctgaaatatgttttgaagaacatatttaacagaacttgctcatggattggaagagattttaggggagagagagggaggtagatgttccccacttggtgcaccctgatggttgcagactgaattccaatagaatcttctccccaaggtctttttattccctctctcttttcctcaattcagccactctatgagtagttaatacaggtatttatttcacagatgaggtgagactcagggagatgaaatgactcatttagagttatcaggtgcagacagaaattttactctacccagaaaaccaaaatataggcatgaaatcagtgttcttcaaactgaattgtctctcattaattgattgtgaaatcaacataatgagttcctatcagcattaaagaaaaaaaaaagagaaacagaataaaaatatagcatgccttgtgtaaaagggtaagtaatgtttcatgaaacttctattttagtttaatattcacatatgtgtatagtaggtcatgatgtgaacgtatttcttacttgaagttatgaaaaattggaaaggcacatacaggatcattgtagaaggaacttatgttatcacagaggtcctgtagtccccatgggaataagaaagcaaaagacaaattcacttgggtggttactgtaggttgtcatatgttgtttatttcttcagtgactgataggctgtaagtctgtcagtttcttagttgttttcttagttgatttttcttttcttttcttttctttttccgagacagagtcttgctctgtcgctcaggctggagtgcagtggcgcaatctcggcacactgcaacctctgcctcctagttcaagggattctcctgcctcagtctcccgagtagccaggattacagccatgcgccaccacacccagctaattttttgtagttttagtagagacagggtttctaccatgttggccaggctggtctcaaactcctgacctcaagtgatccacctgcctcggcctcccaaagtgctgggattataagcgtgagccaccatgcccagcctttcttagttgatttcatagtcatcctgtacttccagtcttgccattagcaaatattgagtacttgctgtgtgcagggttagaagttacttctttgtgtgagatctatgttttgtgtgtgggtggtgtgtgtggggtgtgtgtgtgtgtgtatgtgtgtgtgtgtttgtgtgtttaaaagtagacttttttttgaagagcaattttagatttacagcaaaattgagtggaaggggcagagatttctcatgtactccctacccctacacatgcacaattttccccattatcaacctcccccaccagaatggttgttacatctgatgacacattgtaattgcacagccttatcacccaaagcccatagtttacattagggtttactcctggtgttgtatattctatgggtgtgagatacatgtttaaaaatattttgtattagataaattggggataatagtcatttcaagaacaaaatgttggataaattaaattagctaataaacacagagtgctttaaacattcctagtgcaaaataagatcttgttgtttgtggtggtggtggctattcaggcttaaggtctagattccacttagtatgtaagtaaataatagcaatcctggctgtcatctgtatgtgtaatgtagtaatcagttttgtttagctagttcttatgtgtagcacattaaagcaatcttgaatagtgaggggacctcattactagattaccattaaatggtaatgttaagtgaccctgaaaccaaagtaatggaaaattgtcttcctttttttctttttttttttttttcccttgagatggagtcttgcactgtcacccaggctggagtgcagtggctcatggcaacctccacttcttgggttcacgagattctcctgcctcagccacccaagtagctgggattacagatgtacgccaccacacccggctaatttttgtatttttagtagagatgaggtttcaccatgccggccaggctgatctcgaactcctgagctcaagtgacctgcccacctcagcctcccagagtgctgggattacaggcatgagccactgtgcccagcctgtcttcctttttctcaaacatttaatttgctgtttcttgatcacatatcatccttctttcctttcaaggtcaggggagataattttttactgtatgtactgctgcatcttcacacaaattatcatctgaaaagccttctcagatttgacaaatgaagtctcttttcattcccaggaggaacttgttaaaccaatgaagttcaaaattctaattcctgttcctttctagtgtgcaccactttattcatcttgaataaacatacaacctcaagcatcctacaaggcaaatagattcctttttaattagtggctctatacacagagttttatcatcatgaaatttataaaccaggaagggaacaaatatttacacttgcaacttcatgtcaacattgcctactatttgaagagctctgaaattgtaaatgtatcaccccctccttcttcccccactccccacccctgccggcttttaaactatggcagtagaaaaataggtttcaactttctaggagcacatctctcctatgtggggaatgtggcagattctttatataagtgctctttctttgtgactggcattacttttttttctcacaaagatttgtttcagaagctaatcttcatttttttggttgttgctttttgtagtactatttctaaggcatctccaagtagaaaggcaaaattttattttgagaagttactgctttcatagttacacagaattatttctcaatttaagtaggccttttattccaggacaaaattaagccagtcagaaggtttctgggagaaaaataatgaagagctgaggttttgtatgttaatgtgggcagtctaatgcttgataaaagaaaacttttggctgggtgtggtggctcatgcctgtaatcccagcactttgggaggccgaggtggtcggatcacctgaggtcaggagtttgacaccagcctggccaacatggtgaaactccatctctactaaaaatacaaaattagctgggcatggtggcgcatgcgtgtagtctcagctactcgggaggctgaggcaggagaatcgcttgaacctgggagactgaggctgcagtgagctcagatcgcaccattgcactccagcctgagtgacagagtgagactccatctcaaaaataaaataaataaaataaagaaaactttttttttgtttgtttggcccttgtcagggacagattccgtctcagaaaagtctcgctctgttgctcaggctggagcgcaatggtgcaatctcggctcactgcaacctctacctgccggttcaagcgattctcctgcctcagccttcccagtagctgggattacaggcatgcgccaccacgcctggctaatttttgtatttttagtggagacagggtttcaccatgttggccaggctggtgtcaaactcctgacctcagataatctgcccacctccgtctcccaaagtgctgggattacaggcatgagccaccacacccagccaagaaaacttttaaagatgtgtaaatatgcagtgatttaaaaatctcagttgaagcttgttaaaatgtatcaaaataatttaggaaaaggggggctgattttgccaaaatttgggagatgcatactttttttcaaggctttactgcagttttaaaaaatattttattgttttgtaggcagcttctgaaccagagtaggctcagagactccctttattgcagttttgatgctgcagaaagtgactgcttaatttcagctgttgaggatgttggttatactatgcctggatcaaaaaaatgattttacattgcttagtttgttaaaatatgtttaataggttaatctttttttcaaagcatcaaaaataattaagatgaaatatcagataaaccctatgtctagaatgaataatttagttctaaacatcctggatgctaaggagaaaagaacaagatgttggtttataaaattcttattgtcaaataaagaagcatagaagtttgaagaaagataatttttttgtttttattttttctctctgaatttaggagtaatttatgtttgggttctaatcctatgttatcatcaaagagtaataacattggcaatcttccctcccattctgcttcatcctccccactaaagggaaataccagattgtaaaagaaaaaaaaaaagcatgctggttgtataaaaagaaacattttaaacaaataagaaatatatatattgaaatgcagtctccctgaatgatgctaaacccctgtccaagtaggcatttctcagcccacagaaagggatggcattaaatcacagctcaatggagacatttttatgaggagctgtgatggtttgtgtttagcaaacatgtattgggcatctcagatttgcctgttagggatgcaacagtgagtgagatactatttgttcccttaagaaactcaaagaggaaaggggttgacttgttcagtcagtgacttatgaaatatttcatactcattcatttacagagtactttttgtaggtatagtacagcgtggtcagccagggagactatagtgggtgcattagtaactaaccatacaactaatgctaatgttgcgggctgactgggtttggggtgaacaaatgacccctaaagctcaggagttctagaccagcctgggcaacacagtgaaaccctgtctctactaaaatacaaaaaattagccgggtatggtagcatgtgcctgtaatcccagctactcgggaggctgaggcaggagaatcacttgaacccgggaggtggaggttgcagtgagccaagatggtgccgctgcactccagtctgggtgacagagcaagactccatctcaaaaaaaaaaaaaaaaaaaagacatttgttttggctggggaaggctttgcagagggaggtaacttctagattgagatttgaagtcagagtccatccagaaagtagggaagacattttatgtagagaagtaacaagctacagggatcagaggtatgaaccagggtgcatgtttgggttatggtgagtggtgtctggccaaactgtgtggctcagggtctttctgcttcaccatctttagcatagaagccttccttgtgctcacttgctcatctcattctcacaaaatagctgcttcatatctaggcaccatctctctattcccacaggggaaagagggaaagtgccaagggtaacagcggaaacgtcttcctttttattcaggaaatgagggactccccaaggcttctgcttatatttcattggcttgagctgagccgtacaaccatcactagtggcaggtagtctgggatgtcaagaaagtagcttcccagtctctttggttagaaggcaaaggagaagatggtgggaatcggtttgcatcagtcactctacacattatctgctttgttagggcagcattatcttagtattgttaccaagttcagggtcttttctggggtgatcaagcatcctgggtcgcctgggaccaagtggttttctgggttgtaggactttgagtgctatagcctggaaagccctaggaaaaccaggatggttggccatcctagtctttccccatatcctctgttgtccaaaaatatggaagcaggtcatttcttgacataggagctgccttgactgggcttaaaaaggcctgaaaggcagcttaataatttacaatgagaaataaatgatattggatcaggggaggatactggaagaagagctccatgggatttgcttggtgctcgtgagattttgactgacaagagatcttagggctactatattacccaaattcaggggactctgttcactttgccagcagcctgggattaattctgtagtgctaatgccattctgagaagcctttcaatgaatctgagctcagggttcttagtccccctgttactgaagcttctccccagacagtgtcgtttttgttttttccttcctttctaagcttctggtgctgactagtctccccttctaatggacagtgtttagatacgttattgtctaaaggtagatctggccaggcatggtggctcacacctgtaatcccagcactttgggaggccaaagctggcagatcacctgaggtcaggagtttgagaccagcctggccaacacggtgaaaccccgtctctactaaaaatacaaaaattagctggacatggtgacaggcacctatagctgagatccattgtgagtgccattgcactctagcctgggcgacagagtgagactccatctcaaaaaataataataaaaataaaggtagattaaaaaaaaagagacataatttgcgttatcgtaaaatttacttttttaaagtgtgtaattcagtggtttttagtatgttcacaaagtcattcaccactgtctaattccagaacatttttcttaccccaaaatgaaatcctatacccattagcatcactgcccatttcctgcttcctttagactgtggcaaccactcatctattttctgtctctataactttgcgtattttagacatgtcatataaatggaatcctatggtatgtggccttttttaaaaatcactggcttctttcactgagcataatttttcaagttcttttaagctgtagtatgtatcagtacttcattctttataactgccaaataatagttctttgtatggatataccacattttatttcattcattcattagacattgatggttctactttctggctattatgagtagtagtactatgaacatttgtgtacatatttttgtgtggacacgtttttacttctcttggctgtatacctagcagtggaattgctggtcttcaggtgtgtcttactgatgtttttttttgagatggagttttggtctgtcgcctgggctgaagtgcagtggcgcaatctcggctcactgcaacctccacctcccaggctcaagcaattctcctgcctcagcctcccaagtaactgggattacaggcgcacgccaccatgcccagctaattgttgtatttttagtagagacggggtttcaccatgttggccaggctggtctcgaactcctgggctcaagcaatcctcctgccttggcctcccaaagtgttgggattacaggcgtgagccactgttcctggccttatcttactctctctttttttttttgagacggactctcactctgtcttccatgctggagtgcagtggtgcagtcttggctcactgcaacctccacctcccaggttcaagccattatcctacctcagcctctggagtagctgggactacaggtgcagctaatttttgtcattttagtagagatggggtttcaccatattggtcaggctggtctccatctcctgacctcaggggatccgcctgcctcggcctcccaaagtgctgggattataggtgtgagccactgtgcccaaccatctttaagcctccttaaggaggctgtgtctctaacatgccctgttggttttatagttggactctcactggacagcctcgtttttctaagatttgggggttataaggatcagagttgtccccagttggctcctttcacctcgtccataaggttgttgtgaggcttcactgaggtaatctgtataaagtaaggtgctggcctgtaccctgtacatcactcagtagtggtgatttcactgccctttgcctcctgcctttggcttctggctatctccaaacaccccatgccttctgtgctccaccctctgttgaaacacaggaatctaaaaccattcattgatactttttgagtgattatactgaaaacaattgcatgttgtctcatgcagaattttcgtgttaaaccctgtgttgcaaggatgccattaaccagcacacagatggcggtggagattgattgattgagatggggtttcgctgtgttgcccaggctggagtgcagtggtgtaatcgtagttcactgtaactttgaactcctggactccagtgatcctcctgtgtcagttttccaagtaactgggactacagtctcatgtcactgtgcctggctaatttttaaaattattttatagagctggggtctcgctatgttgcctaggctcttctcaaactcctggcctcaaagcgatcctcctgcctcagcctcccaaagtgttgggattaccagcgtgaaccaccacacttggctggggatggagttttagacaccagaggcttccttccgaggttgacctagaaagcacccttggtgggtgccatgggatgggggaatacagtcaaaaggaacctgctcttcccgctgcgcctccacctgaggtggatgtgtctgctggggctgctggagtctccatcttccactttaacttcacttaagagctgaaagctctgccccttcttcaagattttccctgctgtctccccttccctgctcaaccagagattcctcttattcttcctcttgctattagtattaatctggctcactgactcttttccttaacctcatcctaaaactgtctgatgcatattttatattttcttgcatgtttgacttttagttagtattttacagtaatttcgttctgcagccatcctcttatctgataccctggaactcattcctgtgcctatcagttctcacctctggtaattaaactttgtaaaaaagaaatgtgacatttggacatattctcttattagtaaaggtattattgtgtatgagactaatgctgtgcatctataataagttgtttcaccttgtgaatactaatgtaatttggaaataaacctttctttgttaaagactttttctacatgggccacgtttttccagacctatttcctaataatttgtggtttttaaaggtatgtcaatagagatgctgtagccagcatggctggattctgttagataaacattttgtgagattgcttaccttaaacaattgtctttaaaagttaatttcttccctaatgtgtcagtaaggaaattctatagtatttaagaagcctgataaagtccagttaaaacattttgcattgctctttaaacatcttttctgagggttgatgtgttcgtgtttgtttggttcacatagtttcttctgaattttaagaaagctttgtcagaatcagtaacttgcctatagtgtatttttcatgaccatatggctttcttcatcaaaaacagctaagtaaaaatttcagtgaataatagtatatatatatgggaatgtattcctcatcatttgtatgctcttgagagagtgactcatgtactgttttctattgagttcccgaaagtttataaagagatgacaaacaattggctatgggattgaaataatgcacatgtaaaatggaagggaaaacatggaaacagtttcttcctttgttcttcccttaccttgatgaaatttttaccacttaacgtttttcagtaaagtcaaggtcagtatcagagcctagtacggttctgcttgccgctgtctgaggattacctgtcttattacagaatgtacatgctcccagaggagaagatacagtttgatttcaggatgacaaacagctcttctgggacaatagtgtcaagtataaaaggattataaaggttttaggaccatgggatggtttgaaggggaaagggtgaaatgacagttaaggttggcatcaccgaggtcccagttgttggctgccccctacttctcctgttcccctctggcagtattttacagatgtatttcctttgacctttcctttagtaggaagttgtaggctttaagatccagcagaaaaaaattatgagccatttgtgaccctcttgagcagtccttcaggtagaacacatttcataagagctagtgaatggtcttgggtaattaaagctcactttatgattatacagtgtggtggccagcccagagggaacatcacaaatacacattatgaatgtatagaattgagactttatacctggagactgttggatgacctggtcctctgcccccaggcctacccttctgcccatcctcatccaattctgttttgatttttaaaaagtatgtgcttcttagccctctcattgcttcactgtgaggggaaaaacttttctattgaggtgctgaagctgtgctttccaggactcatacttatgtgctgttgaatgagtctcagtgctcctaggagtctataaaaggaatagaagacttcttttctctaactcccttatggtttgtattttatctgctaagagacactggcatttcatggagatgggagagaaaaagacacagcctacttagacagttcctttattccaacatatatactcacttcacatattcatagacaccttccacctagcatcaaattctgaactcatagaagacttaggtgtttttggttttgtatgcatagcttttgaaatccctgggttgaaaattttctaggtgttgtttgtatgctctagtcaagcccaggacataaagggttatgttaaaattactttccttagtgactattaaccagaaattttatctgtcaggagaaaggattcatgcaactctaagaatgcattgccctctgcataggctattagctttggcaaccgaagatagatgagacttaggctgtgtttaaatttttcattgtgatgagacaaatctattattataaaagccctactttatcagtgagagtgtttccttatgttgttttaattaaaggagcagtgtgtttttaaatttaattatggtaccttgaagatctgatactagctgtaagctaaggattctttgggttttcaagattttttttttggagacggagtttcactctgttgcccaggctggagtgcagtggcgtgatctgggctcactgcaacacctgcttcctggtttcaagtgattcttctgcctcagcctcccaggtagctgggattacaggtgcgggccaccatgcccggctgattttttgtatttttagtagagacaggtttcaccatgttggtcaggctggtctcgaattcctgacctcaaatgatctgccatcttcagcctcccaaaatgctgggattacaggcgtgagctacagtgcccagccagttttcaagatttttaatgcatttggagcagcgctatcctaaagaaccttctttgatgatggaaattttctctatctgcaccatccaatatggtctggtaaccaccagccacatgtggctattgagcacttaaaatgtggctgagactgagaaactaaaattttaattttcttgaaaatgtaaattaattaattaattaatttatttatttatttagagacaaggtcttgctctgttacccaggccggagtgcagtggtgcaatcatagttcactgcagcctcgacctcctgggctcaagtgattctcctgccttagccttctgagtagctgggattacaggcatgtaccaccatacctggctaattaaaaaaaaaaaattttgtagatatggggtctctctatgttgcccaagctggtctggactccaggcctcagcctcccaaaggagaaaatgtaaatttatatagtcgcatgtgattagtggttattgtgttggacagcacagatttagaatctgaggaaactctccatttagtataatgccatctgaagctcttaaccagttgaggctggttaaatctgaagttgatattggataatattgctattaggccaatgagagatttctttaataaagatgcaagtttatcaaacttaaatatgctagatatgaactttgggaaggcaaaaattaattccagaaataattccaatataattaattgaacaaatatttagaaaatgttatctaggataaagaagtgtagtaaatattgtggaggactcagaggtgagtgggacttaggtgaggctgcctattttgagtcctgctggggaggccttgaaaggtcaaggagaagttcttttttttttttttttgagatggagtcttgctctgtcaccaggctggagtgcagtggcacgatctcagctcactgcaacctctgcctcccaggttcaagcgattctactgcctcagcctcccgagtagctgggactacaggtgcacgccaccacatccagctaattttttgtatttttagtggagacagggtttcaccatgttggccaggatggtcttgatctcttgaccttgtgatcctcccaccttggcctcccaatgtcctgggattacaggtgtgagccactgcgcccggccaggggaagctctttctaagggagtagcttagagcacagaatgccaactgggttatcatcaggctgtaaacagtaggatttcagtttgtgcaagcacgatggttggggctgtaacaggagaagggggagctgtttacatcaggggaacattaggttacatttggctctgacaggcaagattaattttgtctgagagaaggttgaggtgggattggaattttcccaggtatgccctgcgatgttctgctgagtttcatgtgtgttggagcaggcctctcaggccatcacagttctgggagatggactttccaaagattgggaagctggaggcagggacacctggacacagagccttcttcacccccacctgcatcccaggtgaggaggaattcttgaaaatgccgagtttgactcaccaaccaggagtatctaatgtatataaatattcctttaaacgtaagtatagtgatgagtagataagccagagtatttaaaagccacagcaaagattcagcttcctctccgctcccccgtgccccacatctgggaggaccccacctgagcttggtgttatagttggctgatgctcttaggtggaaacccaggggcaaaggacaagccacagaaacataggctgcatctgctcctactctgtacttccaccttacctgcccattaagtgctatgttcttgactaaataattcatgtatcgcagagagggaaggtatgtgttcccaccaacctctgacccatccataacccagtgtattacactgacccaggaaccagagctcacttcaccctgcttggagtcagggaactcggaacctaactgtcctgggccctctttctggtagttgggtgagtcctgagggcctgatacgtgaggtttggacaggctgggcagtaggttatggcatatcttgtaagggagaccatgtcagcagtggggagcagaatgcagaggaatcaaagacctgatctcatagtgcaggtgtgaagggagaagagccagcctttctccaccgtctctctggggacaggggactgtctcgcagggactacaccttggcatttgggcatgtcagaccaggatctagtcatcagagttacccaatgccctggggttggtttctaccaggtcagggatgcagttctgcaggcagtatgttacatctgagactacaggagagaggggtggggtgacagtctttccatagggtgtccagacactcctggcccagggactgagccatggatagtgggatgcttgcctctctgtgtggcagggctttcgtctctgttttttgtttttgagatggagtcttgctctgttgctcaggctggagtgtagtggcgcaatcttggctcactgcaacctctgcctcctgggttcaagcaattctgcctcagcctcctgagtagctgagattacaggcacatgccaccatgcccagctaatttttgtatttttagtagagatggggttttaccatgttggccaggctggtcctgaactcctgacctcaggtgatccacctgcctcagcctcccaaagtgctgagattacaagtgtgagccaccatgcccagcctggtctctggttttgagccatgatgtcaggctgaccaggctggcacatttagcctggaatgggttaggcttctggctttgatgttaagaaaggaaactagtgccaagtgcagtggctcctgcccataatctcaagactttgggaggctaagccaggaggattgcttgagcctaggagtttgagaccagcctgggcaacatagcaagaccccacctcaaaaaaaaaaaaggtagtttggtgtggggcatgcgcctataattccagtgctttgggctgaggcactttggggagattgagactgcagtaagctatgattgtgccactgcagcccagcctggttgacagagtgagatcctgtctggaaaaaaaaagagaactggctggtccttcctgaaatagtgcccacaggctggcagagcactgactgacacctgcctctttcagaggtggggtcaggatagctgtatggaaattctccaatgtgtgggttgtaggagtgtatctcatatcccttcaagcactgccaggccagaacccagtggagtttgcaaagaatgggtttcttgttagaagaaagtattacgtacatgtaagtaatcttgggtatagctgggaagtgatgaataaatttgaccattaaaagattgtaatgtctgtatcaccaaagacaaaatcacaaatataattaaaaaacaaataacagactaggagaaaatagaccatgtgcaatacacaaaggataaatacagagtatataaagaagcttctgcatattaataagaaaacactagaataaatgggcaaaagatataaaaaggcattgacagaaagggaacaaatggccaataaatacaaagagatgcttaacttcattaataattagtgaattacacattaaagcaactagatatgattttatcccatcagattggcagaaattaaagagaataatattctttggcggcaatgagaaaaaatgggtgtactttcatattctgagcatataaattgttcagacctttttggagaaggtagtttggctgtatctttgaaaataaaatcacatacttttaatttggtaattttgtgtctagtgaaatacacctgaacacatgctcattccagcactggaatggtgaaatattggaatgattaaatgtacagtggtacagccagcatatagaatgcgatacctaaaaagtgtgtaagagtgtggtatagatctttatgcagctgatgtgggaggctctctcagatacgtttttagtgagaaaaaatataaaattattacatttatatttgtaaacctcaaaatttatatgtatttgtaaattctaaaacatgcttttcagattttttaacatttctgaaatcagcgtatctaacaattggtgacatagtttactaatttaaactcttggtgaagcatagtgcacattacaagtgataagatcttagatttgatgaaggatgatatgtaaatacgtggataaaggactctaagacagacatgggacgagattgaggaagtgtcagtggagactttgtctgtgtcatctatgttgtcaaattttttttacagtgaaattatattccattattgtgtaacgaaaaattttaaaaatacatatttatattttttagacaagatataattttagacaagataaggttgcctggatgtctctgatgtctgatccatttctctacttgggtgattatgcttgatattcagctttgagaactttaaggcctggatggttgatagagcgttcagcttcattaagaagttaagtagctgtgaagattcagtgggagagaattgagaactgaggtccaagagaagggaggagccgaactccagaattcagggccagttgcctcatggggacctttgcatctgtgtaaagaggttgaaattctctccccacaaggtggtgccaggctttttatactggactgggcataccctggagcaaggctcagtggatgggaggcagaaaatagatcaaatcaaggagccttatccaatgtcattgaaaggaaaattcattgttttgggagagagctaagccctagtgggaaagagccaaaggaataaatgggcttttaaatctgaggaatttacacaaggcaggcaggagatgacctgccataggttggaggcaggctctgcttggatcctgtgtaaacagggcatagtgtgagtgtctccccataagtaaaagctgtgttgtgaagatgaactcacagtttagtagtgactttttgaccaaagatgactcttcaagaagggataaggtgtatggagtatagctcattgccaggactgtgggaggcagaggaaggagaggacacttggccaagatgccatttgagctggtcactgtaggaaagggagaatttggacatgtaattttttttttttttttaagacagagtctcactctgtcacccaggctggagtgcagtggtgtagtcttggctcaccacaacctctgcctcctgagttcaagtgattctcctgcctcagcctccccagtagctgggactacaggcacatgccagctgcctggctcattttgtatttttagtagagatggggtttcgccatgttgcccaggctagtcttgaactcctgacctcaagtgatctggcctggacatgtaatttttaaggagatattcagaagaaaagggaggtgagcccaccatttacaaatgcacacaggaggccgggtgtggtggctcacacttgtaatcccattactttgggaggctgaggcaggcagattgcttgaggctaggagtttgagaccagcctggccaacaatgcaaaatcccgtccgtactaataatataaaaaattagccgggccactgcactccagcctgagtgacagagcaagactccgtctcaaaacaaacaaacaaacaaacaaaaatacacacaggagaatgtgaggagctgagtagtacagttttctcggagtacacgtctattaaagggaagcagtaggaagtaaaatagaaaaaggtaggctagggccggaccatgaagagctgagaatgccaagtttagaaatttgaccttgagtcagtgaactcatgttttacatttaatcttttggttaccaatttttttttgtaccatcattggtttgatttttaaaatacagtcactttgttttctaaggattttatgatatatgttcaaatcttgagttaaaggtaaatagaacacagtttgggtttttttttggcatataaatggttgaatttcaaaattatatttgtgttacaaactttgtttttactctctgccttccagcatttgcaaataaccatttctctttcaaaggaaattctagtatgtattcccattcaataaaagcaaagagctgagctctatatgaataagaggtaaaattgaacatgaaaattactgagcaagattagtgggggatgaaatggatgaacattggggaaagctgtgatccttgttacctttgctatagtgcaatttggaatggcttctttattcctggcaattcctgacagcatttcttttaaacctggccacctttccattgccagctcgaccttgatgttagctggtgctgctactgcaagggctgcctttggcaggaagccttcagtcaactttctgggctctggttttggctctgcacatgccttgctgagaagaccttaagaatctgaaatgtggagggtcattttggggtagggaaatgtggtggcaactcttgagttttctgccacgatgtaacttaacagatcctcttgtttttccttaaatggtacaagggtttgcaccgaaatggtaattcatctgtgtctgtgatgctttaaaaaataacagtttcactaatgtgtcacaacatgtattatttatcattttagtaaatggatattttaacaagcaacaatttgcaaatttaagcatggcagttaacatgatctgacattaaaaaattaaataatctcctgccatctttgttatcagccttgcattaaggattttagcccttctgggagcttttatttttttgttgactctgactgatgatggcagattgtggtagtgatcagagctatgcttttataaattattttttagttggaacaatattggcatgtaacgtggactggcagaattaacattgtttatcattaccagtgttgttttgacagatattctcagttctttaaggaagcagatagggaatgtctgtaatggacatctgctgtccactataggttgcccaataatgagtcctggtaggttctaccttctgctgtggaagccagcagagttcaaatgggcattttctgttcttgcctcctaggaactgcaggggtggacatgcttcttaggcttagcctgttgactgcttccacctggagtttgaatctgaacagtgttagaaaatgcagggacaggctgagtgtggtggctcacgcctgtaatcccagcactttgggaggacaaggaaggaggatcacttgagcccaggagttcgagaccagcctgggcaaaaaagcaagacccagtctctacacaaagtaaacaaattagccaggcatggtggtgtgcacctgtagtcccagctacttgggaggctgtggtgggaagatcctttgagcctagaagtttggggttgcaatgagctatatttgccccactgcactgcagcctgggggacaaagagagaccctgtctcctataaaggcagcgacagttagtagtggcactagagttactaaaattatcaagattttcttcctggatagtcctggttgcacacatcagtgttactataggtggacttagcctttacttttgtacatttcgcactgatacctctaaccaccttttgtgcacatagcagctattataccccccatagcataaccaacctgtgtaagagaagagtataagtcagttgcttgcaaggaactcttaggggtagggagctcttgcctgggggaggtgggggtttctcctctttctgtcctcccctagtcattagagaaaggcctcaagagaataactcagagattacggttgaattcaagagggtagattgacatctcattgagctgcacagaggtaccagccaggtgctgctgtgggattagaatggactcctgagaaagcgttcttgagtgagtgtggtgtggctttcctggagtttggggatgtctgtgaatacagaggcaagtatcttcctctcatctgaaagccccccatgtggctggagctgcccctggggacagtgtatggagagaggacagcaaaaacgcttgacatttcctgtgggcctggtggtctacatggaggacagctggcctgagtctttttgaaagacttgtcctgcctgcgaaggctgcctgccagggctaggcccgcagcagaaagaggttgtgggtgaaccacagaggcaggagctgagaggagactgagagctgagtcaaagggcacccgttgcctgcatcaggcagcatggaggtcccagcaaaggggtctcactagagagagctggcatgtggactcctgcaaatggtggaagatattttacaggctgcaggactggaccacagaaaagtgggcagacctttccctttcctcacacttgccgcctttcattccttggacccctctctttttcctcactgctgttcttaggggaaaagcttgacattggataaaatgaatttggatttagactaaatagactttttaataactgaaagtttggctttatttaagataatattttctttttaaaacactgtctagaaatcagtgggtttttttttttgttttttgtttttttttaaagacagagtttcgttcttgttgcctaggctggagtgtgatgacgcaatctcagctcactgcaacctccatctctggggttcaagcgattctcctggctcagcctcccgagtagctgggattacaggcatgcaccaccacgcccagctaatttttgtatttttaatagagatggggtttcaccatattggccaggctagtcttgaactcccgatctcaggtgatctgcccacctcagcctcccaaagtgctgggattataggcatgagccaccacgcccagccaaaattagtggttttaatgttactaaatcctgaaatagctttccatgatgacaaaatcaatcaacaatctcaaccccagtagactggagtggattttagaatttagcacactttcccttatttatactctgcaggtttcaagcatacaacttgccagcaattactgtgttggctgagaaatttgaaattttactagcttgaacactaaatttgttgatgtaacatacagctaataataaaggtcacgtccccatattggcatgagggaccccttatgaattagcctgaaactttgcagcctttaatcatatttttctctcttttttcccttgagacggagtctccctctgtcgcccaggctggagtgcaatggcacgatctcggctcgctgcaacttcgcttgccgggttcaagccattctcctgcctcagcctcccaagtagctggaactataggcatgagccaccacgcccagctaattttcgtacttttagtagagacggggtttcaccatgttcaccaggctggtctcgaactcctgacctcaagtgatccacccacctcggcctccccaagtgctaggattataggcatgagccaccgtgctcggccatgttgttatttttggtttgtttgttgattatggtttaaaaaaaccacataacattaaatttaccatctttgccatttttaagtgtgtagtatggtagtgttaactgtatgcaacagttagtgcaacagatctttagagtttttttatcttgtaaaaccgaaactctgtacccaggaagcaattcctgattccctgcttctgccagcctctaccaaccaccattctactttttgttgctaagagtttgattactttcgataactcacatcagtggaataatgcagtatttgtttttttcttactggtttatttcacttagcttaatgtcctcaaggttcatccatgttgtagcatgtgacaagatttccttctttttaaggatgaataatattccattgtatggatagaccacatttgctttatctagttgtctgttggtgaacatttagggtacttctacctttcggctcctgtgaacactactgcagtgaacatgggtaagcaaaaatctctttgagatccttttggctatatacccagaaggggattgctggatcatcattctgtttttaattctttgaggagccgccaaactgttctttatagcagctacgccattttacattcccaccagcagtgcacagagattaccattgcttcatatccttatcaacacttggtttttttttttttgccattttaatgggtctgaggtgatatttcattatggttttgatttgcatttctctaatgattagtgatgttgaacatctttttatatgcttcttgcccatttgtatatcttctttggagaaatgtcttttgaagtgctttgcccattttttaattgcattagtttgttgtttttttgatttgtaggagttatttatatattccgggtattaatgccttatcagatatttggttgaaaatattttctcccattcataagttgccttttcactttgccctttaatcatattattattattattattattatggttaaaacattaattgtgtaatactgaaaagtttaggaaataatatgacagattttgatcaggtcttaaatatcttcccaataggccctatgagtaaggcataaaaagcttgaattaattccatagtttcaccaaaacgctcttcttcttaatcttattccttatttttttgaggcagagtctttctggcccaggcagcctggagtgcagtggtgcaatctcagctcactacaaccttcacttcccgggttcaagcgattctcgtgccccagccacctgcgtagctgggactacaggtgtgagctaccatgcctagctaatttttgtatttttaataaagatgaagtttcaccgtgttggccaggctggtctcgaactcttgggattcgagtgctgggattataggcatgagccaccatgcctggcccttaatcttgttcctatcaatctttccagctttaccttccccagcatgacttcctcttatccccttcctatgtccaaagattccctaaaaatattctagctctgtaccattccacacactgcttttttgttgttgttgttgttgttgtttttttttgcctgaaatatgggatatgtacctttccctcttgtttaaccttgtttttcagactccttctttttcttttcctttaaagactcagcccagatgtgaaaatgttccagtcagccagtcagctgcttttctctcctatagcctcttaggtacagcccaggttagcacacttgtctgaaagtattgtgaggacttttataaaccccctctctccaggaccatatgctgctagatcacctagcttagctttgcctttttattcctctttgtcatgggcctaccataatatctagtccataatatttgtgtactttagttttttatttatttatttatttttgagatggtggtcttactccatcacccaggctggagtacagtggcacgggatctcggctcactgcaacccccgcctcctgggttcaagctattctcctgccttagcctctgagtagccgggactacaggacacgccaccacgcccagctaatttttgtatttttagtagagatggggtttcactattttggccaggctggtctcaaactcctgacctcaagtgatccacctgccttggcctcccaaagtgctgggattacaggcatgagccacaacacccggcctatttgtgtactttaaacgattatgggtagaaagaaagagcaaatgcctttttagaaataagataacagaactttttaccaattgtgcttccaaatatgctttctcttctaattttatctgctaagattttggcagctaattgtagattttatgaacttacattgggttgcctttgtcttctgttataaaagcaataattagaggaaatgatccttttgagaggttgtttaatgaattctgcttgttttaaatgtgctgctttaaatcttatttcacgtaaactgtactaatgcccaaattatctcaccctagatcagcattgaaccaaagtattatgatgattaatttccttctgttaaatcccttatagtcttttctttggtgtgtgtgtggggtcaacaatcaaagaaagaatttattgactttacatttaatatggtttactctacttgattatattgttcaagtgtgaatttgtgtatggtataagattatgccatactgggattctattttctgttaaacaaatagctttgtgttttattaactgccagtgtttaaatttaatggtttaagatttcagagagccctttttgtaagtatttgaaagtttttattataatcctgagcctaaccttcttctggtttcactgcatccttctccagccttgaaacaagccctggcacagacgcaaatcctggcgtgcaccacctcttcctctcccccgctccccactctaacatgacaagaagtgtctgtcccagaagtaatctgattgtgcacctagagtacctgttttctgcctggggaagaatgcacactgctggacctagagcggtggcaaaagtgccctctccactgtgggggccacagtggtaggcacaacccttatccctcagccccattagttaattaagtcattttacctgcattaaactttacgggcagagaaaattcagtaagtcaccactaccaggtgactttcttttttatgttaccccctagcaaggcatgtagtttgcatcctacagaatataaaagatggggccagcatctattctgtgtcttagcagtgaacttcatccaatagatacttgatttttaaatactttcaccttgtgtcatgattaaatcactaaacaggaagtttcagcttttctttaaagaagtacatcctattaaaaatttaaatgtcttcataactgcttacgctcagtaaatgaacactaggaatctataaacaggaatctatggctctaaaaattgaaattttgggggctgtttcattctttagaacttgaaaacgccataggcaattagctataattcatttgcagattatttttgccatgttaaattaggaattttagccatagcaagcataacagacaagcacacttttaaattattttgttcagcaaaacaccataggcccttatatgtgtttgctggaatttttctttgtcaacaataaatctatatgtttctttagttaaaaaaaaaacagcaacaaagtgtttattgtagaatgtttactttttaaacaaacgtgaaaggcattggtacaaaaagggaaaagcacctaggatttggatcctcagtgggtccaggagtacagcttccttgttctgcagttactggaggcagtgtggtgaggggaaggatgtgggctttggactgagctgctgcttctacctgtgctatgactttgcacaagttaggagtagcctttttgagctttgttttctccttagaagatgactaagatcatgtttgcacatagcacatgacacaaactcatgatactggttttgttttttctaacattgtctcagtgggtcttcactgccttctttctacaattttttttttttaagggaatagggtcttactctgttgctcaaggctggagcgcagtggctgatcattgctcaccatagcctcaaattcctattcactgccctcttatatagtggataatgtgggcgttagtctcatgcagttaagagaacaggttcaaaagaagttttgaactgtctgttttattttcacaaggccagtcagtgacagagaaagaacttccacttgggtgtcctggctctgtgtcccatggttttcctactgaaatactattactgtgctatagcagaagaaagaaggctaagacagttctgtgcttacagtcaccttcagtttcaaatgtaatcatatcctgggggaggggaaatgaaactttgagtttcatctcccaaatcattcctttatttagaatcaaccggctgggcacggtggctcattcctgtaatcctagcactctgggaggctgaggtgggtggatcacttgaggtcaggagttcaaaaccagcctggccaacatggtgaaacccccgtctgtactaaaaatacaaaaaaaaaaaaaaatagccgagcatggtggcaggcacctgtaatctcagctacttgggaggctgaggcaagaaagttgcttgaacccaagaggcggaggttgcagtgagctgagattgcgccactgcactccagcctgggtgacagagcagtactccatctcaaaaaaaaaaaatagtatcaatgaattcaaagaaataaaatgtttttcatgtactcatggaaacaactatttctaaaattctaaatgaattattattattattattattattattattattattattatttgagacggagtttctttcttgtcagtcaggctagaatgcaatggcgcgatctcggctcatgcaacttctgcctcttgggttcaagggattctcctgcctcaccctccccagtagctgggattacaggcgcctgccaccatgcctggctaattttgtatatttttagtagagatggggtttcaccacgttggccaggctggtctcgaactcctgacctctggtgatccacccaccttagcctgtcaaagtgctgggattacaggcatgagccaccgcgcccgacctctaaatgaatttttaaaactccagcatctcacaaatggttcttgaataatttttccttagcctgcagtgtttaagttgggttttgaaggttttgttactcaatagtcacccttttttgggtgtaagtttgtcctctactcctgagtaagtaagtgaccttagggcagtattaccatgaaacagatctcacaaataacattgataccaacatcattatttttggtcaaatgttaaatagttaaaatttgtcatcctagtctatattgaactaatttgaaataccttatatttaagcaaactttattgtttttaacatagcaaaacaattaataaaactttaaatcaattacacatgaaacagtaagaaagcagtgcaagattaaaatctctaggtaagtgttctatagtgtataagtaagttctgtagaacttcagaaaaaagagaggtcagtaggattcttagagcaaagtgtgattttatctgtactttgggtcagaataacttttctgattttttttattactaacatacctaaacacagataatgttaacattaattaagtgaccttagggcagtatcacaatgaaacatctcacaagtaacattgatactaacacaattatttttagtcaaatgttaaatatttaaaatttgtcatccttgtctatattgaactaatttaaaatatcttattgaaatatattattaattaattcatatcagacttagctagagacacctaatgttcaaaacagaaagtagaggtggattgggcccagttggctccagttgctcagaggatgtggtcagtgctgtttttgtacatcttgagctctgctcactctgtctgcgagtaggttttgcgttttgcttgttggctgtcttgttgggggtgggaaaatggctgcccataccttctgccaggtgggcaaccccaaagacttttcttttccagcgcacgtgtaggagcagcctgttggaggcatgtgcccatgctttagactgtcacccaggtcatgaggactgtggtttgaagagtgtgctcactcaactggctagggggtgagggcactgtgtttgacaactgtcaaggactagcgaggttcccagatgaaagggggtgatataccagaagaagaggcatgggtgggaaatgtgcatagcagtcccagccaatagctatcactgcctaccacatagtgctacaaaacagcgtaagaattattcattgagtgcaaatgttgggggagtgggggttaaacagagacctattctaagtgattcttgactgtttgtccaggtgtcattccttgttataggagttttaaaagcagaaaattctcaactgctcattcacctaatactccatgaaagtatatattcttgagtgtcctaagtgtgtgtcctttgaaatgtttatatatataaaagatattttaagtataaaatcttaaatatcttttacacttaaaatatcttttatattttatatttgtgcttttataagttaaaaaatgtgatcaccatgaccctctacttggatgtgacaaccctccattttataaaataattaccgttgaatcaaaatttttgctcaacgtatgctatccagttacctgtcaaagccaactgaatgaatgatgaaaaggttcagatcaaaagcaactggcttaacttcacggaggttttcatgctttaatttaaaatgtgtctatgtctaactgattatctctcacattttataaagaaatattgacgttctgtaaagtatgtagtgacctcacttctggctgtgtgggcaggtttcactgcaggcctctgaagcattgatattcctgtaacctttgaggcaagatgtgtgtgtagtgtattaatgagctgattgaagtgatgtacagtaatttcatccttgggtaaaaacagatgtgaaagattctgttttaatatttaatcagcctccaagcctctgttggcttgtttaagttgacctgacagcattatacctggaaacactttgaattaaactctgagtgcttgaccttgttcaaacagttgtaatttaataaggctgctgtcttggtggagatagtgtcgctaataggcaaatcctcttctgactgggattgttctgtttgtgagtgctggggttggagagattcagagattctcatcagtttgtggggaggaactgggatttgaagaagtaaaaacaaatctaaattaagaaagtgtcttttagaagatctttaaaaacttttattttaatttttagacatatagaagtaatgtttttaatgtcattttgattaggctcattttggttgaaaggaatggaaaatcatttgttaaaaagagagctggaaacttgtcagaaatcaaagaagtgctaggaggactgcatactcactctggctctccttgtcctcctgtccacccatccctccacccacccatccgtccctgcttttctctgtctctgtcttgggcgtcctctgcacgatagcctgtctgctctctcctttcttctgttggctccctcaatctctgtttcgtgtacttctctctagcccatagctcctctttactaatcatttctgttctctcatgccatcagtttgcaggggctcttggtagtttcagctctcttgtatcctttcagctctaagtcttgctgtcaacaagtttgtttccttgttcacgttccagttagctgggtctgaatggctctcctgatcttttttgtgccatatccaaattgcccatgctttccaaagcagggggagctgtggacaagacagtttttggcttgaaggaaagattagttggggcaaataccatgatttgcccaatataaatgcgtgtagatatatattttctggttctaagagtaccatatgcttactggggaaaaatgagaaaatttaaaaaactaataaaaatacagttaaaatctcctgtaaaccgactattcaaatagctaaactactttggtgtatttcctctgattttttttgcttgtttatacataaacataatatacacagtaaacatcccaaaattttagaatcatagtggtaacattttaaagatcttcatatctacttgttaccagtggcatctgtaggaatactctggctgtcaggcctacgttaaaaactgtggtaatttggtgtgaatcttttattaattctttccttttgactaatattaagtgtggcatcattaatcatgttatattatcttcactttggcttgcattacttatcaactcctttgagaagagttaatattattttcatatttcacagtacttgacatattgtctcatacttagtagatgttcagtatttggtctatagtttctgcttaatttttatgaaacttgatttctgtgagtgggcaaaatacattcataaggttccagctcagaagaaggaaaaagtaacaatgtatagcactaagaatattggaaaacaacggggaaatatgctaattgcttttaaacgaacagggattttggcagtattgtggtatatgaagggtctcctgtaggaagctgactggctcttctcttttaggagccctcccagggtggcattcattaccttgtcggattgccatggtccagtgtgggtagcagaatcctgagagacccccagtgaccctgccctttgtattatatcttcccctttgagtataggtggaacctatgcatgtttgagatatcacccatgattctactaccttgcttggcagagggagactatccaggtgggctgatctaatcacacaagccccttagaaaccatattctccagcaggtgggaagaaagagtgatctgaagcatgaataggatttgatgttgactgcgaagatgaaagggaccatgtgccaagcaatgtgggtagcttctagaaactgagcatggtccccagctggcagccagcaaagaaacagggacctcagtcctacaaccgctaggaaccgaattattctaacaacctaaacgagcttggaggtgaatttttcctaagagctcatggataagagcagagtctggctgacaccttgattttggctctgtgagaccctaagcagagaacccagctgagcctgactggatttctgacccactcagctgtgagctcatgaatgggtgttgttttaagccactgtttgtggcagtaagactaatatagtccagggtctggctaattcttagctttgtcagattttaacttgattttctgtggatatcaagggtggagctgtctctcaggggtagacttacaggagcctagctgaagaaactggtgtatggaatcaggaggccagcatatttatttgtttatttacctgaaaagtaaatgttccagggactgagatactccatgtggatggtcagtacattatctcccttaaggcagacctgtgtaggaggccaggtgtgtattagtgagcatggcatccaaaccatgagttagatgagcacagtttccatggcatcaaacacctgtctcacaacaaggatggccttctctatgtctggacaatgtttagatgggtactgccagcttctctggagactcactgtattagttttcaattacagtgtaacacataaccacaagttagcagcttaaaacaatgaaagtatattatctcacagtttctatgagtccaggcacaggtaactgggtcccctgctcaaggactcaccaggctgaaatcaaaatgtcagcagggatgtggtctcataagctcactggttgttggtggaattcagtgccttatggttgtaagactgaggtcctcttctcccagaggctgccctgccacatggccctctctacaatgtagcattttgcttcttcaaggtcagctggaaaatctcccacacacttttggtctttacaatctctgaccccctttaaaagcctagccctgtgtatgctcatagggagagattgtacaggggcccaaatcttgagggcattgtaaaattctgctcccacacttgctttcccctcagcatcccttgatgactggccagctttctgtttgacacctcctttctttagctgtgttaatatatccagtctttgggagtccaggcttggttggatatttcacatctctgaagtgactacatagttcttctcacattcagtatgtattgatttttaaaatttaaatttgtgaacttaatcacacctttatttctgtgatcctcccccctttagtaactggggaatgggatgaggaggaatttcttcatcttagtttcagaagtcttcacagcagtggcctctatttgtagtttgatggtctaaggagtttagattgttagagaacttctaccttcactagaattttgaagacgtaacttaaaattacacttactagatgtagaaactggggagacaaaatgagttatttgcacagttaaattattagctagtgaagaagggtttttatttcttatttatatcctgccttctctcaatatgatgatgtccagtaaaaggcatagatagtctaaaagtgaagcaattaaaaatttttctattatgggaatttgacagtacaaaaaaacacagatgtccttgcccattaaagtgaacaccaaggagtccaaaatattttcatgaggtagttttttgccattgcctgtcagttgtgagagatcattgcctcaggccacagcgactaggtgtgtggcagagttaacctgcctgctctctagggaaaccgtcaagaaatgggcaataaattaataagtagaaagtgttctctgagctccaggcagttgttgattgactgatggaaaaggtaggcggtaggctaatagacgatgacatccaaattcagctgttgcctctcagctgaacccaaccctgggcttctgctgccttttgctccttttccctgagtggtggtggcctgcaggttaaacaggtgggcttgggaattgggctgcctagggtaaatcctcattcccccatttaactcagtctgccagactctgttttcttgtctgtaaaatgagggttaaaagagagtctctgtaaagcatttaatacgttgttgggcactagcggtggattaaggagaagagggctgtgatgggagctgtcagccccagcaggcaggagttagaattgtctggaattgccggtgtagggtgataataaaaagcaaactgactcttggtcggtttattactatttttaaattccctactgacaaggccctccctattgcctgcactctgagtggaccactccttccatccatgccttgcaatgccactgtcttgcacataagggctcaaaagtgtatgctgttgttgcccttctcacatttcggctgaggtgtatattttcattaaagaggattatgtagaaaaattggtttaataaaaatgatgagactttttaatatggtttgtacaccattaagagtgaaatatggcaaaatctggtctgaaaaataggaaaaaatatagcaataactgattaatagaaaaccataggattggctgggcacagtatctcacacctgaaatcccagcactttgggaggccgaggcaggtggatcacctgaggtcaggagttcgagaccagcctgaccaacatggtaaaaccccgtctccactaaaaatacaaaaactagctggacgtggtggtgcactcctgtaatcccagctactcaggaggctgaggcaggataattgcttgaactcaggaggcaaaggttgtggtgagccaagatcgtgccactgcactccagcctgggtgatagggactccacctcaaaaaaaaaatcttttttttccctttttatatttttgtctggatcctaaatattgggacatttgaaagatgtgcatatttagtttaagcaaattctggtggatttggttggttctctctgtagtaagagtagagaagaatggtagatgtgaaaagaatatattctgaaaagaatatgggataagagaaaatcaagaaggcaagaaaataatcatttccacccttttatctactttgaaatcaccacttttcttactttggtcttctgtttcctctataaactatgcttaagagaccagagtgagcagacttcttcgtgaaaacctgagcttgggagttgggatggtttacagtcttggcttcagtccacttttctgacttaacacccagacccctttccggctaaatttattgtctcctgttcctgctgggcctttctggagcgtccgcctctggagtgccctctgctcttgaggtcccaaactgcccatcccacacctacctggtcacagctttgcagtttaagtccccacatgccagtgactgcttcctttctggacccctttactgcatttcagcagtgctgtcaatccttcctttaaatttatgtcactggtttgtagggctcattcttccagcctgcagacgtcagttgagattccactgtgatcaaagcaggatatttaagttctgcagcgggtgggctgcaagtggtagaaatagttattttcttgccttcctgaatttctcttgttccattctcttttcaggatacattcctttcactacagagagttgtctgctctcactacaaacagaaccagccaaacccaccacgatttgcttagacataatgggcaagaactttcagaacatttggaacttttcagaacattgggtggtcttagagactagccagtacagaaatctcttgagagggtgttactgtgttccttctggacacctccagtttctgatttggctgtcctgtttgtcagcagtacatccttcatattgagcccaaaacctccattcattctggtgttcttcagtgcagtcacactgcttcgtgatggcttttcttcagtgcagtcatttgcttcatgtgacttttcttttttctttttctttttctttttctttttttctgaggcagagtttcactgttgttgcccaggctggagtgcaatggcatggtctcggctcactgcaacctcctctgcctcctgggttcaagcaattctcctacctcagcttcccaagtagctgggattacaagtgcccaccactatgcccgcctaatttttgtatttttagtagagacagggtttcacaatgttggccaggctggtctcaaactcttgacctcaggtgatgcatctgtcttggcctcccaaagtgctgggattacaggcgtgagccactgcacccagccatgatggcttttccaatgcaaaacattgcaatagttattcctttgaaccttataaaattactgattgttatgttttgaatatttgtcccctccaaaacttacattgaaatgtaatccccaatgtggcagtattgagaggtggagtctttaagaggtgattggatcaccagggctttgccttcatgaatggactaatccattcatggattactagattaatgagttaattcatgaattaatggactgatgggttatcatgggagtggacctggtggctttataagaagagtatgagagacctgaaccagcacattcagcttcttgccatgtgatgccctgcactaccatgagattctgcagattcttccccaccagtgggaaggtcccaccagatgtgaggcccctcgaacttggacttctcagtcttcataactataagaaataagttcctggccaggcacagtggctcatgcctgtaatcgcggcactttgggaggccgaggcgggcagatcacgaggtcaagagattgaaaccatcctggccaaagtggtgaaactccatctctactgaaaatgcaaaaattagctgggcatggtgctgcgtgcctgtagtcccagctactcgggaggctgatgcagaatcgcttgaacctgggaggcggaggttgcagtgagccgaaattgcactccagcctgggcaacagagccagaccccgtctcaaaaaaaaaaaaaaaaaagaaagagaaataaactccttttctttataagttgcctagtttcaggcattctgttataagcaatagaaaatgaactaagacactgatattcaattgttttagcctataaaaatgggaattttatgtgggtcaacctagtatattccccctgattctctgcttttccagctcatatacttttgtagtttagataacctcctgtcagttaaatcatgatataagttcttcgttccttttttttcctttatagtttaaaaattattttatgtgtatctttcctctggtagccccctgagacttgcttactgcaagcccacatgctgccttgactccttttccctgaatcaactgtgaattgttccgcagcttctctcctttttggtctctgaaccaaggtttcttaattagagtatccacaagtctatatgtgaagaggttgagggaaaagtaaccactggggacatgagaaatctgaaaagtaatagttagaaatggccatcttagccttattaaaatgtaagtaaggccgtgtatggtggctcacacctgtaatcccagcacgagaggccaaggtgggcagatcaccttaggtcaggagttcgagactagccttgccacaatggcgaaaccccatctctactaaaaatacaaaaattagctgggcgtggtggcatttgcctgtaatcccagctacttgggaggctgaggcaggagactcgcttgaacctgggaggtgaaggttgcagtgagctgagatcgcatcattgtactccagcctgggagacagagcaagacaacatctctaaataaataaataaatataatgtaaggcaaggccttttcccttatatctattttagggtttacccttgtgtatacagaaaaattgttccctgtccagcttattatgggctggatagcaggcagaactcctcagtttgggttagcattgcattaacagaactgccacatctttctggataatcttcctttgtgcataagctccaggctcaccttctctgcctcacagctgtgcgctggtttcccttagctttcttgggttctggatggatactggccttctgggtgagaagggggttctttggcaaaaggtgtttttgacataatttaggaccttcttaagttctacagcagacctaaatttcttcccccaagttctttgtctatatagagtactcagcactcattacccattctcagttctgaaggaaatcttatggagcagttgtagtatttatagggtaagcagagtgcccagtttccatgccccaccccaaaccatttagatttcagtcatgtatgtcaagggaggagtgagtacatttttgtggtcagctgcctcttcttttccctaacattctcactttttcatctttcctgctttcttgaggtcatttatctattgaataggatgtctattgaaaggaaaaacctcccctaatcgcctttaaactaatatttcttactgggcatggtggatcacctgaggttgacagtttgagaccagcctggccaacatggagaagccccatctctactaaaaaaaaaaaaaaaaaaatattagccaggcgtggtggcgcatgcctgtaatcccagctatttgggaggctaaggcaggagagtcgcttgaacccaggaggcggaggttgcggtgagccaagatcgtgccattgccctccagcctgggcaacaagagcgaaactccatctcaaaaaataactaaactaatatttctcttttctcaataataatggcatgaaaagaattttttctgtgccttttcaaaatcccaataccccctcgtggcatttcctatgttgaagttttcaacagccttatcaggaggagaaatgagcttaatttttgagttttagtgcttagggactctgtcttggcttctagagataacttcactgtgggcacccacaaataatatgtttaattttttttctaaaccttttgctgatggtcattgcaatattttcttgattttaatttcctgagttttcttctttcacattttttcttttttttttggtgatatttttccatattccattatctgcatccttctcactctccctgatttttcaaacatcatggactacagatctgcaacctccctggtaattcctcttgggtttgagaggaagtttgtcaagtactggaaacttgaacttgtataaaacagatgtcaccactcattttaatggaagaaggcatggagtaaatacagatagcacataacagctatatgcattctcttaaatttctttcccgatcttgggcttgaggtatttttatctaatctagtctacccttgccattttcaagatctttttctttgatacttgatagagaagtgtcttctgtatttttcttccttcttggaagaatatattttaaaaaatgtattttgagattgagtattttgtgaaacatctttcctctaaaatcctcaaagtaactttgcctctctttgatttctatgggtagtccagcggagagtgatacacataaggatatttcataaacactgcttgcattcctctgggatttgtgctcctagatgacagcatatatatgcatgtgattctgtgtgtgtaaacatgctttaaaaaatttattgaacatagttttcagctgtcttcactcactttaaaccttagtctactttctttttcttttttttttttttttgagactaagtattgctctgtagcccaggctggagtgcagtggcgcagtctcaactcactgcaacctcctccaggttcaaacgattctcctgcctcagcttcctgagtagctgggattatagttgcccaccaccatgcctggctaattttttgtatttttagtagagacagggtttcaccatgttggccaggctggtctcaaactcctgacctcaagtgatccgcctgcttcagcctcccaaagtgctgggattacaggtgtgagccactgtgcccagcctttagtctactttctgtttttacaattccatgccatgtttattgaaagcatgttgttggtttcttttgatgcctcccctgtctttcttctcatcatgattttaaaaattaatactttgtaatatttgagatttttatatctatgtcaagttaacttttcctgaaaaatattttgatacattttctagaatgttagtgtattgtgtttataacatgggggaaaatgtactgtttcatttttaaatttatttttatttatttttgttattattattttttaagaaacagggtcttgctctgttgctcaggctggagagcagtggcatgatcctggactcaaacaatcttcccacctcagctttctgagtagctaggactacatgcgtatgccaccatgcccacctaatttttaatttttttgtagagacagagttttactatattgtccagactggttttgacctcctgggctcaagggatcttcccaccttggcctcctaaagtgttaggattataggtgtgagttatcacagccaggtgcaataagtgtttatgattaatttaaaagcagatgctgtgcttttcaaaaattatgctcaattttttttttaatattacaaaggacttttagactggcttcctcctaaacatttcttcaactcctatcaagttcagtctgcaaatatcctaatttctaggttgtttgggaatgttaattgattgtctcatgtatgtatgtatgtatgtatgtatggatagacagatagatgaaggttgaaggatggatggatagattaaatggatggatggatagatagatagatagatagatagatagatagatagaaagatagatgaaggttgaagggtagggctggaggaggaattccagctttccagtagattttctatcaagcagtcattcatatatataacttcctatattgttagccaaagttcatccatgtctcttgtatttagctctctgtctgtattgtagaaagcttatttattatgtgagcattttgctttctcctatccctccctctttctttaacatcagttataacagctgtgaatacagtttataatatgagcagccatattcagtttttaggctttcaaaatcacaaatacaaaggaggatataatacatagtcctatattttatacaaattgggacacttttcttcatttcttatttcgtggcattgcctaactatagtcaagctaatgacccatgtagatgtagtgttgtacctggtgtccgtgtccctgtgaatgtgtcatgttgtgctggcctgattccccaacatcagccccagggagccagcagctggagcagctgtcatcttgtgaaagcagagtgtccttgttgctattgattgggttgttcagtcaattgcaaaaaagtggatctaactgtcaatggtagttatatgataatcctggagataaataagtgtcaagtgaagtattacttgaatttaggacttgaagagagagaaaggggtatgagtagttggaggggaagatttgctatgacaagctattattcagtgtggttattttgtatgacaggtaagtctacaggtatcttttgttagataaatcagaaattaagcattccctttgtaaactccaaacaagattttgaaacaccatggtccccccttatccacctccaagatctccagtggatgtctgaaaccactgatagtactgaagtctctatatattatgtttttcccctgtatgtaatacatacctgtgataaagtttaatttataaattaggcacaggaagaaattaacaaaaataagtaagaatagaacagttataactatatgttctattaaaagttatgtgaatttgttttctctctctctcaaaatatcctgttgtgctgtgtgttcacccatttttgagctgccgttgactgtggataacaaaccacagaaagtgaaacttcacataaagggggactactgtattctcataatgttaattgcttctagaattcacaaggattgaattcaacttgaatcttgctaaagaagtactttattattcgatgttagtccagcaacaacttatagtgtagaaatttgcccttttgagggtgaatacacaaaggggaaagaaaacttgtgtgcccacggtccactaacagataagcttctggaggccaggagtaaaccgccctgcaggggagccatctcccagggtttccccagcagagagctgtgcccagtgccggggtctcatgcttacctatttctctgtgccagtatagtagacctgttttcaagcctagcatgagccttaagtattactggctgggagtggtggctcatgcctgtaatcctagcactttgggagggtgaggcaggcggattgcctgagctcaggagtttgagaccagcctgggcaacatggtgaaaccctgtctctactaaaatacaaaaaattagccgggcgtggtggcgggcacctgtagtcccagctacttgggaggctgaggtaggagaattgcttgaacccaggaggcagacattgcagtgggctgagatcacgccagtgcactccagcctgggtgacagagcgagactctgtctcccacaaaaaaaagaaaaaaaaaaaaagtattacttatttagtaagtccatagcattttgttcacacagtgtatcattgtgcttttctgtttcaaagtgtaattatttaatctagaaattttaagtcctgtgacagaaaacaaatgctgttctcacaaaatatgagaaatcaaattccatcttattatttaaattaattcttttttaactgaagaattgttatgtgggtagctttcaacataattttttcaatattagatgcttataactaatgtggatttagttaattcgatgtttatcacatttaattcttatttactacaaaggttaaagcaattttatttcttctggaaacttttaggatcttgtgagtgagggacgtcagccaaaattggcaactttttcaagcaactggctcaagaaattaggaatttctctaataatgagccatcgttttttgaattcaacaatttaaaagggctgcatagttaggatatgattccagtttcccctcagtgcaaattgatatttttttctgttgacacattctactttgttttcgaagactagtttatagtgttcttttaaaagcaaagaaaatatctttaaaaatcccagctttttggctgggtgcggtggcttcatgcctgtgatcctagcactttgggaggctggggtgggaggatcactggaggccaggagtttgagaccagtctgggcaacacaggcactccatctctttaaaataaaaaataaaaaaataaaaatagccaggcttggtggcccacacttgtagtcccagctactcgggatgctgaggcaggaggattgctggagctcagggattcaaggttgtagtgagctatgattgagccactgcactttagcttgggcaatggagcaaaaccttgtttcctttaaaaaaaaaatttattaaaacatgctcttactttggcaaaaatatatgtttcttcatagtgatgataatcataatgatacattattactatatgcagcttataagaatcagttgtctaatgtatccgtgtaagtttctctgtggttttaagaatcattccataggctgataaatgcatactctcttcaccccattgcacatccagcattctgaatttttctcacttccttgaatatgccatgttccatgcacttgtagatcttccatcacagaaggtgcctcatctgtccagaacccctgccatacctctgctccctttgtctagctaacgctcactcatcctttagatcccagtgaaatgtcacttgcatctgggaggactttctgactaggttctgagcttcctttgcattctgtttttcattgacataatgacatcacatttattagtattgtctcattgtaaaccccagtaaggcaggaactgtatctctctgtatccccaacactaccacagtgcctggtgcatgttaaattgcagttaatatttctagaatgaaagagtgcttccatccttcatcatccgtctttcagataaagaagtatctagttacctttgtcttaaattaaaacaatttcaaaaggttgcatgtgctggtggaccagttgaaatccacagctcccatattgctgctcattgccactgttattgatgccctggagatgatttaaaattcagttatgttgcttgtgatggtggtatttaaaaatctataattttggctgggcgtggtggctcatacctataatcccagctctttgggaggccaaggcaggtggatcacaaggtcaggagtttgagaatagcctggccaacagagaaaccccgcctctactaataatacaaaaattagccggtcgtggtggtgtgcacctgcaatcccagctactcaggaggctgaggcaggagaattgcttgaacccggaggcggaggttgcagtgagctgagattgtgacactgcactccagcctgggcgatagagcaagactctatcttgaagaaaataaaaaataaataaataaaatctataatttttatactcatgtgctattatagtgaccctgtgagacatcataatgccttaatgatagcttgtcttgtttttactttcacttacatctatagttccaaatgttttattgaattgtgctttatttgataattcatagttgtaaactgacctcatcccatatttgtatttttacaatctcaacagttttatcagggacatatttttatattctgtagcataatacagtgccttctgtagagcttagtttcatgtgcagtgatgtgtcagaatgaaatatctgcccagtggtattgaatttcatgtattatgatttacatattcttctgtgtatcaactggttttatattacccagagaatgcttatggtggtggttgagagttgtgtattgctattgactgtacgggccatagacatatttgtaggtatattaaatttgctttgtacttctcacacaattgatttggtgggcattcttcttaattatacttgatgggtgcatacataaattcattcttggttaaaaaaattcagatagtgtagatatggcagtggttcctttaatccctccaattatttatttaccttatatatctgggaactttgtataaaaactaaacactggcctggcacggtggctcatgcctgtcatcccagctctttgggaggcccaggcgggtggatgtcttgagctcaggagtttgagaacagcctgggcaaaatgtggcaaaaccctgtctctacaaaaaaatacaaaagtgacccaagtgtggtggtgcacacctgcagtcccaggtactcgggaggctgaggtgggaggattgcttgagcctgggaagtggaggctgcagtgaactgagatcacaccactgccctttggcctgggtgacaggccgagaccctgtctcaaaaaacctgaacacttctttgttatgtttctacaatttgacacaataattcaagtcagccaagcactttaaaaattattttgaaataattttagatttataggaaagttgtcaaaatagggtagagttaattatatataaccttatgcagtttccctgataaccacttatataaccatagcacagttataaaaaaattatcaggaaattcactggtataataccattaactaaactgtggccctttttgactttcaccggtttttcacctcctgtatttttctctgttccaggatcccatccaggatcccacattaccttcagttgttgtttctcctttatttcctgcaatctattaaagattctaatcctttctttgtctttcatgacttcagcaaacagttttagttggatgcttagtatataccagtcactgagattggtgcttgagggaagggagataaatgaatggatgagacatggcccttacctaatgaggtgagccaacacatagacaagtaatgctaaaacaatgtagtgcctttaaaaggcctttgtactatctccctagagaagagagagttgctgactcactgaataacagtgttgaggcagcattttcagaagaaatgacattgatctgggtcttaaagaatggggaaacttttccttgtggagaaatggagtggaagaggagttcatcatggacaggcaggggcatttggcatgaaagtgtgaaagactggcttgtttgcagactggcaaatcacttgataggaatggagcatagggtatgtgaagaacacagtgaggcatgaaactagaagagtagttacaaagctaccttttttcattactttttattaataaatatatcctcatatttgtagggtaagttttggcttaaattttttttaaatctcattattcatacttaatgagcatttaattgtaatcagtgtttctagttttaaactgcacaacattaagattgttactgtacttttggaaagaaaaagagaacaaataattatgcttagctgttgcaatagcatctaatagcatttaaattctgttaataaagaatatgaatttattctgtaatgcctattgggcacctattatatggcaggcactgtttgaggtgagagagatatagcagcaaagaaaagagaaaaactcctgctcttgttctaatatattctagtggtcctagttgcaatatgtttgaactaacatggtagttcagtcaacaagtcaaatgttaactgcctagcatgttatctagatgctcagcagatttttaaaaaatgaatagatatatgactgggtcttgaaggagtaaaagaatttcaggctgggcacggtggctcatgcctgtaatcacagcactttgggagaccaaggcaggcggataacctaaggtcaggagttcaggaccagcctggcccaacatggtgaaaccttgtcttttcaaaaaatacaaaaattagccaggtgtggtggtgggcccttgtaatcccagctacttgggaggctgaggcaggaaaattgcttgaacccgggaggcagaggttgcagtgagctgagattgtgctgttgcactccaacctgggtgacaagagtgaaactccatctcaaaaaagaaaagaatttcattgagtagaggtttgctggcatgagtaatttttgtttatttcatatgcattcttggagattattcttaggtagttagaacacattgaagatattatttcattgtcttttgacttcaattgtcaatctcaggtaattgtcttttccctggctgtctttaaaaatattttctctgggccgtgcatggtggctcacgcttgtaatcctagcactttgggaggctgaggcaggtggatcaccagaggtcaggagttcaagaccagcctggacaacatagcaaaaccccatctctactaaaaatatattaaaaaaatgggccaggcgtggtggcaggtgcctgtaatcccagctacttgggaggctaaagcaggagaattacctgaacctggggcatggaggttgcagtgagccaagatcgcaccacttcactccagcctgggcaaaagagcaaaactccatatctatctatctatatatatatatttttttcctctggttcttatttttgaagtttttgtacaatatatcaagatacagatttatttttatttattctgctaggtatctgaggattggtattttagttcaggaaaattcgcagccattatttcttcacatactgtttgtgcttcatcctctttttttgtttgtttttttgagatgaagtcttgctctgtcatccaggctggagtgcagtggcgtgatcatggctccactgcaacctctgcctcctgggttcaagctatcctcccacctcagcctcccgagcagctgggattacaggtgtgctccaccacgccctgctaatttttaaatttttttagtagagatgggatttcatcatgttggccaggctggtcttgaactcctgatctcaggcgatccgcccacctaggcctcccaaagtgctgggattaacaggcatgagccaccatacccagcctgcttcatcctcttttaatctcattttcagtctccaattaaacatatgttaaaatttctcactgtatgctctatgcctttaccctcttttgtgtttttcttctttttctgagctgtactcagtttactgattctctcttcaactatatctaatctgtcattagttatagaatttttatttagttatcaaatttgtcatcttttatagtttatagttccctgttaaaaccatttagtttggtttttatctctttgaatatagttaatgtcattgtttttaaatctttacctgtattttcaatatctgaagttcctgtgggtcttcttctgtagtttcttgtttctgctggttctgactcatggtgtttgttttttcctgtgcctgattacatcctggatgttgtttttgaaaaagtatttatagaaataatttgaggttgagaattttcatatgcttctgccttctgcctaggttgtacagtttaaggcctcctcaagccaagttcatgattcaggtattgtgagttgggctgcaaacctgtgtgcaggctggttacttacagttcactttccctctttgaagccccatttacaataggggttggtatccttgagaccccacctgcttaggctccagatgtcaccagaatttcacatcagctttatttcctggattggtaaatataaccccatgataaaagtggctctgagtgttgggtttacctcttggacttcctgtcctcaccaatttttgaccgaaaattcaaccctatgttgttagctctttgaattacctattctgtcctcattagaagagtgcctccagcatttattgcctaaacatgacagctgagtatttttagtttgattttttttttaacatttgctaataatacgttttcaaccagatcataaactttgtggataaggtccctgtctgctatttctttacccttctcatatagcatttaatacaatgataggtggataattggttctcttggccagttgactgatcaaggggcaattctccaaactctggtgatttctccttttcgttcgtaagactgcttttataccccaacaaagaaacttgttataatttaatagtggctgtgtccatttttcttttcttctctgctgttccatcccaaggtgggatggccccaattagactaaccactgaaaccctgggcataaaatggtgcccagggagcttttcttcatattaatttgtgtgtactctaaaaggaaagattatttggcttgctcataaatccaaaattttggtgatgaaaatatgtttataattatttcttttgagcttgatttgttgtggattttttcctttattttggtttaagatcaaatggtttcctaatgtgtatgggtcactgtagtctaaatttttttttttttttttttttttgagatggagttttgcccttgttgcccaggctggagttaaatggcgagatcttgcctcactgcaacctccacctcctggcttcaagtgattctcctgcctcatcctcctgagtagctgggattacagatgcctgccaccacgcccagctaattttgtatttttagtagagacaagattttatcatgttggccaggccggtctggaactcctgacctcaggtgatccgcctgccttgaactcccaaagtgctgggattataggcatgagccaccgtgcctggcctctaaatatttttaaagtatagatgtttttaaacttgtagctcctgagtgtgaactgtcccttgctgttttttgggcatctatcaaggcatttgttctaaccactgagtaagaaggacatcactaagggggttgtagctatacctttcttctttttatctttaattaacatgcattgactgcctggtatgttagaaacagacctgcctattacagtctcattcccttccatactcatccttgcttgtgtggctacctcccaagctaggactgcaagacccttatcactcctgcttactattggtttttgtgtccttttggcaattttctagtggctgcttgaactattggttgtcagattgacctgatttgtttcacttgtaaacaaaatgcttaagccactgttgatttttgtgacagctcagttgcttagagcaaggtgttaatgagacatcggtcataggtccaggctctgggttgactggtaagctttgctctggcccatggccacagaccctgactcccccttgccagctgtcttgcacatgtagctatggctcattatggggacacagcagggggtggagataagacaaggcaaatctgtcatctctgccagaaaagacaactcctactgataggtcagtaaccttttcattggaagaacagcacgttagtattagcttctgtagatgtgtctaactgagtctttttcttaaaataactcatgtgattgtatgggttgtctgcagcaagtttagaatactgctcacattttaaagcatgtttgaatataaggatggctttttagtttgtgaagattattgtccttaatcagggattcttaatatcattctctaaagtagaaaagtgagctttagaagtcaaatttgataaagctctagaaaacaactgcaaaattgctgttataaagaaacctgtcaaatttaggaagtgccctccaggagcccttcatcccaaccaatcctctcctaaaagaaaggaaaaaaagaagaaagatggctaggtagatggaatagtgatcagaaaaaaagaacttttctagaaaagcataccagtgtgctctttaccagagcattttagcaggtaatattttacaaaggacccagcagataattgggcaggttttttctttaggaacttagtgttgatggcctgaattaatctgactaggaatttagacatttcttcatgatatattttgagtccatagatgatctgattctaatgtgacttcagtttttaacttacatagcgttaagcaaaaggatgtgtgtgtatgtatgtgtgtttgttttacatcctaaaggtattacaggccccatggtaaactttttggctcaagtgaatccagagtttggtatatgtaacctccagtggtggttcatgaacaaacacttcatttctgtagtcatatttttttttaaagaataaaagtgagccaggtttaaaacttgttaagaaaataatagcacaggtgatacacagatgaagcaaaattgccgtggatggtctgggaatgcctgaggattgagaaacactggctgaattatacactgtggcagaagaaattataggcccttagaaacaggtagaggttattggaaagattcaagcacctaatgtttagttagaaggtaagtaagctggtttcttaagttcttgtttatttattgggtgtgggctcaggataagttagtttgaaatagatcttagagaagtaaatgcaagacaactttatcaatgagtcatgggcaaacaattctattattagaagtagtatagaaaaggagtaggagaagtagaagggaggaagtctagtattcattcatttatttattcattaattcagccactatttcttgagcacctggtgtatgtcaggcactgttgtaggcactggggacacagcagggagcaaaacagacaagtctctgccctcatgaaattcatttacatcctaatgggaagagacaaataatgtaagtgagtatatagcatgtcagctgtgagaaatgctatggagaaaaataaagcagagtaagggaattaaggagtgatgggatggggaggcattgcttttttaaatagtttgatgaggaaagacctctctaagaaagtgacatttaacttgacttctgagggaagtgagggagcattccaggcatggagaaggagtgttctagatggagggaacagcaagtgcaaagagcccttgacatgtctgagaaacagataagaggccagtgtggctggcgtggagagagaggggagagtcgtcaagtagtaagaggtgagagcagatgggaggaaggtctcagcacaggtcaggcctctggctttgctgagagtgatggatgcctttgcagggttttgaacagaggaggcacatgatttgacttaacgttttaacaagctgtttcctgctgctgtgttgagaataagctgtaggcggcaccaaggtggcagctgggagggtattgccacaaaacaagcaagagatatgatggtttaggccagtggtaatggtggagagtgtgagaagaggacagattctggatgtattttgaagtagagcccgcagaatttgttgatgaacttgatgcagagtgttagaaaaagagaagacttcaaggttattggcctgaataactggaaggatggagttatctatcactgagataaacagaggtaacagaagtaaaggggagagatggccatggtagaaggtggattacacctttaaatttttaaaacatatttttatttaaaatagccctcactccctggcccagtgcacacaaaggacctgatttgcttttaccctgagtttgtcactgtagatatcctggaatacttcgttaaaaactataaataaagtggccataatacggctcattttgttcagattctaaaaaaaaattccttcataagcagttggcttccaaatagcaatgcatgctgtcagtttggtgactaattgggttagaggttaatagcaaggcagtcctataaacatcaacgggagtggtgtatccaaatgaaagcttgcattaggcaacaattcaaagaatgagaatgactaaataccatgttacaagccaagtgaattatattaagagttttaactttgagagaaagggacgttacccctgaaataactatcttagttggatcttccctacttaatactcatagttgggttgtaaaaatgtaaaggttaccatcaaaacagcacttcttaaccatgaaattgactaactttgtaaaattagaaattctgttacttacttcctactatgctgattggacattccttcttttgccaaaagaacagaaagttggattttgtgccttctagccaagagaaccacacacctctctctctgtagaccagctaaatgcttcctactgctcggtgatgaaatcagatcatggaatcagtcagtttgctatactgaattttttttttttcagctgtgttctaattgaacctttggggaataaactaattcttaacatctgaaagtttaaaggtctgatactagaatttatggggtggtagaggagaccttttagtctctgtatccaaaccaaaatgtaaatttacttttatttattttttattttttgagaaggagtctcgcttaggctggagtgcagtgacatgatctcggctcactgcaacctctgcctcccgggttcaagcaattctccctacctcagcctcccaattagctgggattacaggtgctcttcaccacgtctggctaatttttgtattatttagtagagacagggttttgccatgttggccaggctggtcttgaactcctgacctcacgtgatccgcccacctcagcctccaaaagtgctgggattacaggcgtgagccactgagcctggccaatttctttttttattgtgggataatcattccatacttctccctcctctctagtccccacccccacccccctttttccccccacaagtgaagatgatttcctgtgctggtctaggattagttttgttacagtctgtctttataagaacatttcttttccataatccagaagcattttgtaaaacctatgcctggaaattgagtcactttttattgcttagattttcttcacagaaaaacataggttctgttggatgagtatttgttgtgaaagcaaattattaaggggtgaaaattgtctatacaagttgatgtataggaggatatctgaactggattagttgctcttttatctgtgttttcaaagctctttaatagtaactcttataacacttataacagtgttatcactattgtttgggcatcattccattctgctagactgggaattcttttataatacagtgcctgataggcatccattcattccttgaaataatgtattgagtgctcattatgtgcttgaaatagagtgtgtgcaggagccagagcagtcggcagaacagatgcagcttgtgtcgcatgtgcgtacagcccatggcagggtggggggcaggggacccagcaaacaagatacagataactgcgcagtacagtgccaatatgcacaggaacagtgactgtcccctacctacataaatgcatagacctcatatgtgtattgtgaatcctctataattgttgaatttgactttgaaattaaacacttgatattttagactagtcaaaaatgggatatgttattattttaataaaaacaccattgtatccagccgggcacagtggctcacgcctataatcctagcactttgggaagccgaggcgggcagatcacctgaggtcaggagttcaagaccagcttggccaacatggcaaaaccccgtctctactaaaaatacaaaaattagctgggtgtggtggcacacgcctgtaatcccagctacttgggaggctgaggcaggataatcacttgaaccctggaggcctaggttgcagtgagtcgagattgcaccactgcactccagcctgggcaacagactgagactctgtctcaaaaaacaacaacgacaacaaaaataacaccactgtatccatattgcctacaggagaaaatgcagatcacttattttatgtatgtgttgaatcattttaaataacctgacggaggtcctttcttgggcccatgcctctgcacatgttgggcatgttgtagttgtcgttactagcaagacacacctaccctttaagaccagtctaaatgccaccttgttccctccatgtaatctcagaacttctttaagggcaaggaccaaattacgtctgtgaaaccctagagtttgatctaccacttcacgtggaggcatgggacagaggttttgttaatgagtgaatgtatccatttaataagttccttcttcagtacactcttgagacctattctggctttcccaggaaacagctgaaggagtgacctccaatcaagtcagctctgtgtcaatccttcattttcggatgttttttcttccttttctcacagggtcataaggatcaaatgtaataatgatgtaagagttaagcgtattcaataaagggaggcagtggaatcatcacaatgttgatcatcacaatcaacattattattactgcaccactatagttccttgtaatacacagtccagaaatattatcacaaaatctcactgaggatgtcattgttctgggtttgacctagatgttgatgtaatgaacagttctctatcagttagtgtgttggcctagcacaggtgcttgacaaaggccctattcagacttctgtgcattacttcaaacccctccctttgctcccatagtatagtaatgaattaggagtcatatcttttgactggcaagggactgcctaaagcagatccctgcagattggggcctcactgtttctgtgggtataaagaacctctcgggagagcctgaatgatcaggagatctgaactggggagccatcggcccagcaggaggtgcctctgcttggccaaccagagcctgctgcaagaaaccttttttttttttttttttttggttctgacaggcttgttggggaaattgaaaatctcctgtttgaaagccagataatttaaaatcctttctgattcagaatctcagcaagtagtgaagggctaggttattgattgtgggaaatggggcagcctcaaagggctctgggctatctcagtaccccatctccctcacccctcacgcttcctcaggtttctctctcatgctagcttggaatggatggtgtatttcctacccagttgcctttgtttataagcatccaccaccgctgcagtagggtcaggaaactggcaatttcctcagtgatccttgcccttgaaccctatctcctccagcctaggaagtattcagaccaagtactcatgtgtgactctccagtgcttctggatagagaagaccctctgagctgccctaaactcgcaagagaatactccacaggcttatgtaagccaaaccagatcatgagtcagacatctgaactcatcaacaaaaagtgctccaggaaaaagaaatggtctacctggcatattattgtttgaaaatttattttaagtcaatcctctatttcattaagggtaataataatcagtctacaatgcaaaactcagggaaaagtaaatttcattttgtatagctgtaatataacattttttactctgctcaaaattcttgaaattgttaatccaactctataaattaggatatttgagtaaagtaagtatccattgtttgactgtgccagaagcaggagttaactttttctttctctggttaaaattatcacttacttgatagctaagtaattttttgaaagtctcttatatcctgatggtacactaaggccctgaagagagtataaaggtgcaagattcagtcccctctctcaagaaactagcagtatgattggatggataagatttatgcatgtgaaacagagaatgctagatattttgggtggtaatcaagtgtaatagtatgtgattttagttataagcgtgatgagtgcaggaagggagatgaaaaataaataatatttagtgaactccactactacagaataaatatttataatattttctatttcatcaggaagaacaatttgaatcactggcttaatcactggtggggggcctggtttttagtctgtgtcttaaaattcttagctcacttatgtcatttgtcatatgaactttttggagaaagaaatatttagtttttatacgtagtttttaagactttaaaggttttataacccttttcttgaaaaattaagacatcaaatcagcaagtatttattgagcactgaccttggtctgaggcatgtacattttttagtttttagacaacagtaaagtaaccctgaaataatgcctacaatgactttgataagtacaagatggtgagttgaggttttagccaagaacctttgttttctcttgctgaatatttttctctttggttatgtggtagaatttagagctcaaaatgttcagactgtttctgtccaagtagcattctcaccatggtcaagatttgtttagtgatttataattaattagataaaagtacgcaaagctttttgggctttgtactgggaagtgctacataagactgcgtggtagtggtttgggcctcattgcttatatctgacatagcttccaggatttatgcctgtctccaccaagattcttttcctctttaatgaatttgaaagtaactatttatcttgaatgaaattagttttttctacctagagctgggagtttcattttctaatcagaatgtctgatttatttatgtgcctgccaaaaaaatcccaaaatactggccgcctgagttctggctaatgtttccaggtgctctgttttgaaaacattccgtttctaccctgtattacagatgctcttgcgtacagtgaaatcttgtgataaatatttttcagtgaacataaagtatttaaaaaataaacgaatggcagtattagtcatacattgaccgaatgccaccagtgtattatttatcatcatatacaggacatagtccaagacacaatccttatttagtggttctgtagtctaattatctgtaaaatggtcatgtcaaaaaaaaccaaggaaccatcagttgggcaaattgtttgcaattatgattaataacttgctgtggttaattaatgggaaaatatatatggcttctaacgggctgctagtttcacatatataagcagtgtgtattcaaaagaatttataccaagtaattatttattactacattctaggtttaattcttacttgtgttttcaagccattcaaggaaagtgagcacaagtaggtgatagccaccattctttatggtaatattatttaggtcttaaaatcagtcagaggcaaattatattatttgaaaaatgattgcttttcacagactaaattatccttatattatttttccttttttttttttttttgaggcttagtctcaagctgttgcccaggctggagtacagtggcataatctcggctcacctcaacctctacctcctgggttcaagcgattctcctgcctcagcctccagagtagctgggattacaggcacctgccgccatacctggctaattttttttgtatttttagtagagatggggtttcaccatgttggtcaggctggtcccgaactcctggcctcaggtaatccacccacttcggcctcccagagtgttgggattatagctgtgagccactgtgcccagcctctttttttattattttaacatactttgaaaatacttaatacctatctagaccagacctcttttgtaccagatatatttattttggtctagagaaaatgaagacaacgtattaaagttgggtgtacccaatgcaaatatctgtttaaattcagtgttcagattggagttttgtgggcaaaatatttaacaagaattgtatttaacttacctgtgattttgactcacatagacttagctgaaatgaaacatagtaagtacagatttaaatatgtatgtatttgagtagaaatctttccacctgtatgcaggtagttttttgtaataatgaaagaaaatgatttcattttagttcttttatttgatgtgacaggaattgattggttagtcaagaaagttggttaaaagcagggaataaaaatgtgcatccactctctgtatgtgttaaatatttattaatattttaacttttgaaatatatcatgtatgtgtatttgccacttgtttgatggaggttccaggcttttctttgagcatgggttggagtttccatcttttttctcaataattttcagtctcagtttctttaaaggcatttgtgaagaatctgaatgtagagttcttctagattgtaatttccccctcgaccttttacagtttttttcactgttaatcaaatccatctaaaagcattcagctacgtgtccatagagactgcaagtctttttttgtgcacatagcttattggatgttggataacaatatttaattaaggttcttgattatagtaacaggcataactgacacaaacaggtttgagaacaagcgcaattaagcacagaactcaacagatggaagcagaagtgcctgggtgccctagacaatagcttatttgccactagtgttgaggattttgtggggaagtaaagagctctgggctggtgaggctggtaggggcggtcagtgaagagggctttgttttccttgtctgaggcttgtctccaactgaaaggcctcctttcctctcctgtccctgggtgaatctttgctcaagtcccctgtattttcatcacagccatcacccctcccctttccacccgtgtctactgccttttcctctgcagtttgtttctgaactgactgaaatctctgtcagtctccgtgttaaaattcccttcaagactcacctccttagagaagccctgtggatggactatacccagcttttacccttctattgatgatttttgatccatctatatagctttaatgaaataaaacttcaaaaacctgaattttagtattaaatatgctgccactcatataataagtgttcaagtatttctttagccatgtgaacttacattagaaaataatgaaattcttgagatggttaatttttaaagctgtttaccatacctttcttttaaaagggatggaagatctggccttttagaatatgatttgccagccttccatagagtatactattgaagaaagcaagaaatgtgtgtttgcgggattctgttgctcaggctggagtgcagtggctcaagcttggctcactgcaacctccgcctcctgggttcaagcgattcttctacctcagcctccccgagtagctgggattacaggcgcatgccaccacgcctggctaatttttgtatttttagtagagacagagttttgccatgttggccaggctggtctcaaactcccgatctcaagtaatcctcctgtgttggcctcccaaagtgctgggattacaggcgtgagccaccacgcccggctgaaagcatgttcttgaatgtatatgtgtgttctctccccatgtgatttgtaaaccctccaaggcttgggtctcacattctcattctttgaatcttttatggcataatggatagagagtctgtgctcttgtccagttgaagtaagtagtgggcgctcaaaaaatgttgattggccaaaatatctacatcaagtacagtaacgactcatagctgctaacatcttttgagcaattaacatgcaccgtacactgtcttaagcactttatatatgtcacctcatgtaattcccacaacaactatagttatccccatttcacagatgtagaaactaaaacttagaggagtcagatacttggccaagatcacacgaccagaaaatgatagagctaggaaagtagagacaggaatcaaactcagtgagtctgattccagattctgcagccttgactcctttaccccatgcctggtggatcagtaacctttcagaaaatttttgtaacaagttctgaaaacatagatgaaataggaattttcccttaaactaaatggaaaactaaaaaagtaatcattagatggagcagatttctgctaaatgggaagtcttgggagggcctcattagaaaatgagggaatggggggccaagcatggtatcatctgctacccagtgagaaaaatatcgacttacgctgtgaacccttttattttatacatgtaccacctgaatgaggatggtatatttatgagctctcacatctcattgctgggtgacatcagggagctcttttttgggatagctgtccatctgttctcctccaggaactcctggatccgtgccactgccacttggctgctggcttcaaaagagcctgaatcagtgagttgcttacaccagggagaacaaacaggctcttctccttaaagtgtctgtaattatatgaccataattagaaataaaaccttctttatacaatttgagctcacaaggaaagactttctgcatacacaccattttttcctgtgttgtttcacatgctgatcaggaaacaggtcacttggcctaatcatccaccattgaatagagtggagagagccagattccccacaaccccctaggttgctgcatgtccttgaggtagtctcctgccctctctaaacttttgtagcattatgtatgatgaggttagtatagccatgtaggaaatgttatgagaaccttagtgcctgctattagttccttggaaaaaagagatagcctagacataagtaactcatgagtagagactaccagttttggtgcagttagggttttgagtttgttatcattttaaacagtaacattgtttgggtggttctgtggtgttcgaagagatgtaggtcaccgttgatttttgcctgatgggttttgagtttgagtagatgttgattaattcatgagccccaactgcaagatagatgttcagtattgattagacacatgcccctggttgtatgctgttaaaaaggagtcagctgtgaaatactcctaaagctaaatcaataaactactaaagttgttttcccccaataagtgtttgtattttatccctttaagtgagaaaggctgttaggaatttctgtgatctggccgttaagaaaactagctgtatctttggaacaatatgctcatatgttagccattccaggtgagtataaattattcatatatacatcttcgctgaggataacaatggcttaatggaggagaaaacacaacaattttctttgaaaaattgtctttattctggtgacataggtagacaactttgctgagagcacacctaagtactaataaaaatttcaagggattgagacatacatcctcacagagtaagagtttaaaaatgcctacaattggccgggtgcggtggcttatgcctgtaatcctagcactttgggaggccgaggcgggcagatcgcctgagttgaagagtttgagaccagcctggccagcatgatgaaaccctgtctctacaaaaaatagaaaaattagctgggcgtggtggcaggtacctataatcccagctacttggcaggctgaggcaggagaatcgcttgaacctgggaggcggaggttgcagtgagccgagatcgcaccattgcactccagcctgggcaacagggcaagactccgtctccaaaaaaaaaaaaaaaaaaagcctacaatccctgttataatcatggccagtaattgctaagcaattagctgtactattagaatgagtcactaccaagttttctgccttggcaatttttttctgaaaactttattgaatttagaacaatttctggatgactttttttctctcaacatacagacattgaccagtcttcataaaatccactaaactcagcaccttctaggcttgtctttctcctttccttgccttctcttccaaattcctagaatgggccgtgtgaacttcctgactgaccatgccggctgcatcctttaaatctttacagtggcttctcatttccttttgcatctactctggctgttcacgccacacatcagaatcgatcaccagcaggctctggagtctcatttccctcatctgctgcgtgggtctccagtcttctccctccattcattcattttcagttcctctaggcagcaccttcttccttgagccttttctcaagagctatcgttttcttagactctgttctctttttttccttctgttccaagtaactcttgaaatcccgtcttccctaaaagtctttttgaattaactagagagttgctgatgggctcttcttcattcaggtctgacaataatagacctcccatagcttcttcctctaacatccaccccaattatactcacctctgcttcccacttccaaaatgacccttgctcttgacttatatctactgacagaatcccttccctgtcctggttactgtttctaatttagagatccacacaggggtgaagaaagcaggttctgagatgaactgcctgagttggattctgagctctgtcacttgcagctattctctttgggcccattattgaacaatttctgtgctgcacaatttctgtgcctcagcaagactcgagcgtaacactgacctcacaggattgttgaaataatttaagcacttaacacagtacatggcatgtagtaaacatgcaataaacatttactgttatttattaattggagagaatgaagagcacacccgatattatacatatgtacatacatttacatacacacacatatatatatatacacacatctgtgtactcatatatagctacataatttggaaaagtatttagaattatatcttttttagaaaatgaaaacaatatatctttttttttcattttttttttgagacagagtctcgctatgatgcccagaccagagtgcaatggcatgcgccaccatgcctgactaatttgtaaaactttttgttgagacgagatcttgctatgttgttgctcaggctggtcttgaactcctggcttcaagcagtcctcctgcctcagcctcccaaactgctgggattacaggcatgagccacagagcctggccaaaaatacatctttttaaatgcaaaacataccaagtaaaattgaacaaaatcctggctggtgaggcaagagtttaaacaagggaggagaagcactgtaccagttgtttctacacacctatgaaagatctggcatgaatggcttggtctttgtttaaaagcatagagcgccatgtgtatgtatggacacttgcatgcttttgagtgatgatgattagggtgagagattttccttaggaaagtttcaaaagtagtcacttatctactcagttttaagtaaatagaaaataattttttttaaaaggatagtgtgaggaagtaattttgtttttaaaaggatagtgtgaagaacaccctaaaaatgtttgtagaagaggattattcagataaatctgtagtgagtttatgcatacctcctttaaaatctatctttagtacagccattatttagcatgaagatgatttgttgcttttgttttccaagttttgttgcttgtaaataatctgttaagaaattttgggccgggtgcggtggctcttccctgtaatcccagcactttgggaggccaaggcaggcgaatcatgaggtcaggagtttgagaccagcctggccaacatggtgaaaccctgtctctaccaaaaatacaaaaaaattagccgggcatggtggcaggcgcctgtaatcccagctactcgggaggctgaggcaggagaatcacttgaacccaggaggcagaggttgcagtgagccaagactgcgccactgcactccagcctggcagacagagtaagactccatctcaaaaaaaaaaaaaaagaaattttgtaaaacatgctgaagggaatcctgggccaacaggtatttttaaaaaataatatactattcccaggtttatgttgattatttatatttgaaaatgttgattgtagatactggtagattactttcaaattaatcatttattcctaattgaccagggatgagtgagatgtttatttagaaaacaaataattttagataggaaaattgaatctttaaaaaataatggtgatttaatatatcaatgtgtggtttttgtgtgtatgtgtgtaatattggagcatccaggagtgtgcggtgtgtatatgaccttatttttctactgtatcttagaggttgccacttccatgggtataaaacttaattggatttctcgatttttattttgtttatgcacttttacaacttatgtcattttaggttgtttattaatgccagttttgtataataaaattattagagaagttatgaaggaggatggcatgagaagggtggccagagtttcactgtttcatgtttgtaactttcattccttttgaagtgtacatttattcctagtgatagaaattgatgttttctttggcaagcattagaagcaagtctatgtgaaattatgtaatgtctgaaaagttatattcatgattaattggcctatccaagaatggtatttgtgtgtgtggaataaggcgatcatgctttttatttggcagtgagttaaagtgcccctgctcagatcgggttactccacagggctttttgactgagaattgtatgtttagcttaatctctaaaaagcgtaaaatgtagcttcggagccaaatatgctggaattcatattgtaaccaaagttaatcttaggataactttaaaagcaagctgttccactctcacaccttagttaacaaataaagccaagaggtttaaaacaacatcatcatcataatagtctctgaaagcacagccagccttcattacccaaagctagactgtctgcactgtattgtcaaatattaatttaaaatcttcttgaccttgacctaaactgataagttataatgatctatttatttatccaagctggactttacaggaatgagaaaaagaaggtctttaaataattgcctcctcctgtgtgtcagcttgagaaattatgacctccattactaatattacagtgatggtgaacttgatagataactagagacagggtaatgcaatggttctaaagcctgactaccctgggaaagttaacttcagtttctcatgtgtaaatggagataatgttacctctcttcttgcattttaatcattaactaaatgcttaccagaatatctgttcatagtaagtgctcttaaatgtttgcttttgctcttaaattattgctgtcgctgcttctgctattactgctatgataactactactaactactgcaattgctgtcaccagcaaccactacaattactattattccagttcctcctccagggctttcactatagggtttaactctttggtgaatcctcatatcgaaatggtaaaacataccccaaacataccccagagttgaatatgagttgttttggcaagatcatagctcactgtaacttcaaactcctgggctcaagccatcctccctcctcagcctcccagagtgctggaattatagacatgagccgcctcacctggctgtttcgttgttgttgttgtcgttgttgtttttaaatgacctgtattcttaccattcaaaaatgtggaccgcaggtcagcaacatcaatctaacctgggagcttgtttgaaatgcaggattttggccccatcctagaaccactgtatcagaatctgcattttaacaggacgttaaaagatgttctgtttgcatattaaagtttaagaagcactgatctacaccatcctccccaccccccagctatcccccaaatcatcttaatgatttagggatggctccctacatagactaccagcagtatcatgtgaaccaggccctcaaagtagatagggcaggtaattggaaagaagagaagatgaagtggaaaaagagaagaaagaagggagagaggaagaaaaaccatgcctgacaatactgatattttacctgtatagatgggtctatgcttactgattattctttgagtctttagattattctttgttgtgacactgaatatggaaaggaatactgaaattttatgggctggtaaaaaatttccatgcccttgtaatttccaatgatctgtcaaacatacatggagagtttcctgttaactcatggtctcagataaattatgcaccctttattttctctttttttgtgagacagagtctcactctgtcacacaggctggagtgcaatggcacaatctcggctcactgcaacctctgcctcctgggttcaagcaattctcgtgcctcagcctcctgagtagctgagattacaggtgcccgcctctatacctggctaatttttgtaattttagtagagacagggtttcaccatgttggccaggctggtctcgaactcctgacctcaggtgatctgctcacctcgacctcccagagtgttgggattacaggtgtgagctgccgtgcccagcccctttattttcttaacacacacacacacacacacacacacaccagtccccttgtattcatgctttagttatctttttagtgtgaagatggtgtgcttcctatgctgatcctgcaagatcactggataggagagcagagtttggtttactactctctgcctgtttggtagtgcttctactgctgtttgagttgattcttccaatgtaaaggctgtgaggatgtatgggaacactaatctttgatattaactatgaattatgggtgcttgtggaggtacagctttatttgtattatcacatactaggggctaaggaaaattacccctttttgacttaaaatatgaccttggagtctgtttttttgttgttgttgtttatttgttttttgagatggagtctctgttgcccaggctggagtgcagtggcacaatcttggctcactgcaacctctgcctcctgggttccaatgattcttctgcctctgcctcccaagtagctgggactataggtgtgcgccaccacgaccggctaatttttgtatttttagtagagacggggtctcaccatattggccaggctggtctcaaacttctgaccttgtgattcgcccgcctcggcctcccaaagtgctgggattacaggcgtgagccactgtgcccagctggagtctattttttaaagttgatttgagaaacaagtttatggtatgattttaaacaactaaattggcaaagggaagaaatttgataaaatatgttggaagtgtgcagtgatacaacctgtcgcaatttaaaatgcctgtttccgttacccagcaatttcacttgtaagagtttatcctatagatgtatttgcacatggaagtgtacatgtgtacatttttatgtagaaacaaatgagtagtaataacatcaatattaattaggatgagactgggactgggttgagaagttgagactgctgcaacttctttttttaaggtgttatttgtgtgtgtgtgtcggggctattaatgaaagtgtcttaatgaatctggttacaataactacctttggagacaggatttgaaggtgttagaccttcaaatgtgagggacacttactttctattaaaatgtctttgtactgtgtggaattttttaagaaaaccatgtgtatgtatacattaaaatcaacaaaatagtgctcacattgaggagtttaaagctatatgtactcgtaattacacttacatatttttcccctttttttttttttttgagacagagtctcgctctgttgcccaggctggagtacagtggtgccatctcagctcactgcaacctccacctcctgggttcaagtgattcgcctgcctcagcctcctgagtagctgggactacaggcacgtgccaccatgctgggctaatttttgtatttttagtagagatggggtttcaccatgttggtccgcctggtcttgaactcttgacctcgtgattcgcccgcctcagcctcccagagtgttgggattacaggcgtgagtcaccgtgcccggcctttgttttttttttttttctttctttaaagagaagttcttgctctgtcgcccaggctggagtgcagttatgcagtcagctcattgtaacttcaaaattctgggcttcaagcaatcctcccacctcagtctatccatagctaggactacaggtgtgcaccactgcacccagcctttcccccatttttaaaacatgtttatgtacctaagctcatttatgcctttgagtccctaaattaggtggtaggcaacaaattcttggtcgcctcactgctctgtattttctctccaactccttagactcttcttagcataaactgtccagtgttctgatgattcagagctgtgattccaaagttggggtaccatcagaattcttgaagattggttacaaattaagattcctaagttaatcccagacctattgagtcaaagtctgtgggtgagacttaggcatgtgcattttttttagaagatccatgggtaattcatcagaatcaggttaagattcttcgcacctggttaaaaagcactgtctggagagcaattcttggtaggaatcttcttctactaaaatgccagctgttatctgtgcacccgcacccccagatcccaggagtgatgtgcatgtggcatatcaccaggctgaatgagcagatcctctacatccaaggaaaagggaatgttattctgaatagtcacatggttctctctattgaattagaataataatggtaatgacagagatgataccaaataagatgtctatgttagaaccaacattttctgccaataacattacaagtaaataggagaaatcaagagttggtcctttgaaacatcaataaaatttagaaatctgtagctagactaatgaaaaagaaaaagacaaattatcagtaacaggaatgggagaggagatagcattgaagacataataaggataataaaggaatattatgagcaagtttatgctaaaaaattgggtaactgagatgaaatcagaatttgtggaaagcccaaattaccaccaacacacaaacacacacacatgcatgcacacatgcacaatctgaataggtctatagcgagcaaagaaattcggttcataatttaaaacttagctacaaagaaaactccagactcagacaactgacaacataatagtgatgaaatctatcaaatctttaacaatacaaatgttaaattctttcagaaaatagaagaggagggaacacatcccatttcactttatgagattggctttgctttcatactaaaactagccaaaaactggccgggtgccacggctgtaatcccagcactttgggaggccgaggcgggcagatcacttgaggtcaggagttcaagagttcaagaccagcctggccaacatggcgaaaccccatctctactaaaaatacaaaaattagccaggcatggtgtcaggtgcctgtaatcccagctactcaggaggctgaggcaagagaatcacttgaacctgggaggcggaggttgcagtgagctgagaccatgccagtgcactctggcctcggcgacagagtgagattttgtctcaagaaataaaataaaaacgaaacaaagactttgcaagaaaaggaaactatggaacattcctcatgaacataaacacagatttttttaattagcaaattaatccagaaatatataaaaaggataatacattttgagttttacctagaaaagggtttatccagaaatacagttgatttaatattgtgacatgaagcaaatatatgatcatcttattaagataaggaaaaacaatcaacaaagctaaaaatccattaatgatataaactcttagcaaactaggaatagaagaaacttttgtcaacctgataaaagacatttataaaaagccatatctggctgggcatggtggctcatacttgtaatcccagcactttgggaggcggaggcaagcagatcacctgaggtcaggagttcgagaccagcctgaccaaaatggagaaaccctatcgctactaaaagtacaaaattagctgggcatggtggcacaagcctgtaatcccagctactcgggaggccgattcaggagaatcgcttgaacccgggaggtggaggttgcagtgagccgagatcgtgccattgcactccagcctaggcaacaagagcgaaactccatcgcaaaaaaaaaaaaaaaaaaaaaaaaaaagccatagctaatgtcattattaacagtgaaagactaaatactttcttcctaaggtcagaaataagacaagaatatccccctttcatcatttctattcagcattgtactggagtttctagccagtgtaacaaggtatgaaaaagaaatgaaagtttgggaggaagaataataatgtctcttacagtattaagtattaatgataatactaatactatgtcttacagcatgcagattgagaggaagaactaatagtgtctctagttttagaccatatggtcatctatatcaaaaatcctaaggaatctttaagacagctgctaaaactagagaggatttagcagggtcctaggatacaaaatgattatttttaaagttgcatttctatatggtagcaatgaagattcagaacctgaaataacatttacaatagcatcaaatactatgaaaatatatacagataaagttagacaaaatataggcaaagcctgtaccccaaaaactgtaaagcattattgaaagaaattaaggcagccctaagtaaatggagaagtgtcccatgttcatagaagactgataatgttacaatgttagtacttcccaaactgatttatagagtcaaaacaagcccagtaaagatcccaaaaagctttttcctaaaaattgggacgttgatgaacaaatttgtgacaaaggatttgaaatagtttaaaaattttttgaaaaagaacaacaaagttgaaggactagttcagtgggaagaagaaaatctcaacaaatgatcctggaataactggttatacatatgggaaaaaaaatgaaccttgacccttatctcacctcatacacaaaaatatactaaaaatggtgtatagacatataaaaaactaaaactataaaactagaagaaaatgtaggataaaaccattgcaactttgggatagataaaaatttcttagattgaacacaaaaagtagaaaaatcgataaatggcactttatcaaaattagaaactgaagtttttccaaaagaaattggtaggaaaatggaaaggcaagccacaaactgggagaaaatattcacaacacttatatcttatgtgttatatacatacatacaaaggacctgtatccagtatatgtaaggaactcttacaactgaataagacaaacaacccaattaaacaatgggtgttacaggttgtgttcctcaggaagcagctacggataaagctcaggtatgggatatttagtaagggatgcccttggtattaaggcttttgagaaggagggcaacaaagcagcactggatggagggagatgttgagcagtgatgcggcccaggaacagccttggatgacttcacagattgctctgaagctggactggaccttcggaatttccctgagttgggccctgatggtgcctttttatttctgcatcactcagtaatgtgggcctgtatcactggatatggcccatgctaggaaggatatatcttggccagtgtgattctctgcagcttgaggcaatccctggagggagtgatagctgaatactgatttcccatagcattcttagctgagacaataggtttttcactgaaagaggatctgacaatatattgcagtgaccattgtaatgggcaaaagattctaacagaaactgtacaaaagaagatatatgaatggccattaagcacatgaacaacgtcattagtcatcaaggatatgcaaattaggccgggcgcggtggctcacgcctgtaatccagcactttgggaggtcaaggcgggtggatcacgaggtcaagagatcgagaccatcctggctaaaacggtgaaaccccgtctctactaaatatacaaaaaattagccgggcgtagtggcaggcgcctgtgttcccagctactcgggaagctgaggcaggagaatggcgtgagcccagggggcggagcttgcagtgagccgagatcgcgccactgcactccagcccgggcgacagagcgagactccgtctcaaaaaaaaaaaaaaaaaaaaaaaaaggatatgcatattaaaatcacaatgagacacttccatacactcgaatggccaaaattaaaaacactgataataccataccaagtgcaactggaagtgtaaaatggcacaagcaccttggaaaacactttgcctgtttcttataaaataaacctacacttaaccgtatgcctagcagttccactcctaggtatttacccaagataaatgaaaacatgtacacaaaaaagacttgcatgaatgttcatatgaagtttattcatagagccccaaactgtaaagaactcagatgtctgtcaacaggtaaatggataaacaaatttagatatattcataaaatgaggcactgagtaacattaaacggaataatctactcacacatgcaacaacatggatgaatctcaaaaatatgtcaagtgtaaggttaagtcataaaagagtacggattgtatgatttcatatatgaaattttataacaggcgaaactaatctgtcgtgacagaaagcagatgagtgattgcctgggtctgaaaagggaagagaatgcaggaaggaacattttggggtgatgagagggatttatgtcttaattgttaggattattacatggatgtatcatttgcccaaacttttgtttttttcttttttttgagacggagtctcactctgtcatccaggctggagtgcagtggtgcatcttggctcactgcaacctccgcctcctgggttcgggagattcttctgcctcacctgagtgagggattacagccaccacacccagctaatttttgtatttttaatagagacggggtctcaccatgtttatcaggctggtctccaactcctgagctcaagtgatccgcccgcctcagcctcccaaagtgctgggattacaggcatgagccactgtgcccgccggcctgcccaaactttaaaaggttgcgtgtttttgcaaataaattacacctcaatgtaattatacttaagtaaaggtgagttgttttttaaagtaaaacttttcataatggagattattttcatgaaggatattgactgcacttttaattttcttttcttataatgtcttcatctgattttggtatcagaattatgctggcttcataaaaccaattgagaaatatttcctcctcctctattttctgaaatagatcgtgtaaaattggcattgtgttcttaaatctttgaaataattcaccgctaaagtcatctgggcctggtagttcttctagggaggttttaaataatgaatcattttctgtagtagatttagggttattcagattttctgtttcttcttgggttagttttgataattttgtctatcagtgaagtccatttcttatctctgttgtctaatttattggcataaagttgttaataatatttcccattattttaccgtcttaatggtctgtagttatatctctactttacttcctgatattggtgatttgcattttctttttcttaatcagtctagttaggggtttctaatgaagttaaacatatacccatctaatgacccaggtgttccactcctaggtatttaatcaagagaaatgaaagcacatattctaaaaaataatgttcatagtgatttttaaaattttagccctgaacttaaaacaaatgctaatcaattatagagagaacaaataaaattttgtatatttacagtaaaatactactcagtgataaaaattaatgaaatactgacagatacaacaatgtatgtgaatctcaaaaatattgtggagagtggaagaagccctacataaaaaaatcatagtgtctgagtccacttaaatgaagttccagaacagacttaatcaaatcgtggtggtagaaatcagatttgtgattgcttaggaagggaagtggaaaggtatgagcagggaactagcaggagagaactttctgggttatggagtggtctgtattttgataggggtgtgggttaccagtgtatgcatttatttaaagctcatcaaactgtacatttcattgtatgtaaaatatggctcaacttagttgtacaacaacgggaatgtagtcagtgccacttaactgtatgcttaaagatggttaaaatggtaaattttatgttatttatattttgccacaattgaaaaaaaaactgtttgtttgttatatttggttttttttgagacgagtcttactgtgtcgcccaggctggagttcagtggcacgatcttggctcactacaacctccaccccctgagttcaagcagttctgcctcagcctccctagtagctgggattacagccgtgtgctaccacgcccagctaatttttgtatttttaatagagatggggttttgccatgttggccaggctggtctcgaactcaagtgatctgcccgccttggcctcccaaaaaagtactggaattatagggatgagccaccgctcccggctgaaaaaacaaaaacaaacaaactaaaaacaacaactgtaaatgggaagatgtgaaggttctaaatgtgcaaacatttaaaatgtgtatttccccccataaccgtgtgctgttctattattatttatttaccatttatatgctaaagtaagaatgtaatttagaaactgataagaaagtaccaagtatgagaaatgttacattcgtatattcaacagatattaatcaaacatctactgtgtgtataattctttattatgtatagtaattaagataaaccaaacaaggatcttccaagagctcaccatgtactaagctatttaagatatgcaaaattttaccaatgtcaccaaaataatgggctttttcttccttcttcctacagtttacccttagtaggctttctactgtttacccttagtaggctttctactgtttaccctagtaaagatctaggaaattaagtttaaaatcttcaccctcaggggaaggccttgtcatgcctggtatttcttctcctggctttgctgcagcttgtattagtatgcagggaggggctttggttttgtgcagttccaacacaccttacagtgaagctgtggtgccagggagcagagtctgtccaagataatgctcatgtaagtgcccagggtggtgcctggcctaaagcataaggagatttagaaactctgccacaaagggggtctaagaatgagtcttctgctacacagaattaactccaaaaaacaaggtcagagctcttgaccttcaggtagtaattatccacataatcctcttttcctactgcttatgaatactgcaattgaaagggtcagaggtagtctgaaagcagggaaaacaaaagaagtcaggagcatggaaattctgcacaccagatggtttgtgtgcccagagggcaattgagaattaagtgtagtaatggaattacactacttttattggttctatgaggacaagcacttggagtaccaattatattctgcgtggcatactttgggtgctgagtaaatattagtaacttattgaatagcacataacatctcaactgccatgtaaatctctgtgagtgcagggcattgtcagaggtggtggtgataatattattgagaaagtgactagtgtctgacttttctagcttgttaataaccacttacctatgtcccatctcctcattctactttcctgtttggatctaattacattcagttgagttgcctgtgtctcctgagcagttagagcaggtttctcttggcaggattaatagtaagaatgtctacattcagttcacagtgtgcctaggcagtgttttgtagcaccatatctaaattaaaatgaatgccttggggcaactgcagaagctcctagctgcctctagctgatacacagctctactaagtatcagctcttgcttgtgtttcttgtaaattgttgttatgcctatcctttaatctatgcattactattttgcttctagcctcacttggaaaacattcccaagtcatagagatgaattacaatacagaatttctaccaatggcagtacttgcattgttttcagaatctagtgcccaggttttcctactgtttttcttgccgtctttaagacagaatttctatttacatccttgtcgatttttgtatccctaaataaattatagtcttgaagtctggacctgctccagtgaaggttcctacagcactgaagttgggaatcactagagaggcactttgttaattttctttttaaaaaggaatgactaaaggtttgtgacacttgaatgtaagttgattttaaaattccatttttctaaatccagagtagggtttatattgctaatatcatgatatgcttgccaaagagaatagtttgtaaatcctaaacagacttcctgtaaccatgtgttgaatttccagctgtgttgaatcagactttggtccctcttcagaagataaatccaatacctgcagtttctaatggcagaagtggaggagagaagtccctgtccagataagaaactgaaggccctggggcaagcaattgtttcatgaatgtcctttccccagccccgcgccccacccctaagaaatttgtaggcttcatctaccaggaaaacaaaacaaaacaaaacaaaaaaaacaagaaaacacacaccacacaaatgagatgctattgttaaatgcagtatgtaggattagatttgtttccttccaatagaatcactttccttaatcagcacttttataaatggcacacctgcctgattagaacaagttctagactacaggatacagtgtgagcatttcaattaagtccacacaattaaaaactgttgtggttgatgttcttagaaagactttccttctctcgtcttactccgttatggctaagctttattattttatacttctgagtcagcctttgatcatgggactttcccactgtgtggtcatttatatctttttttgtttctaaatgatttctttaaatgaaaaaagaagcgatgtattttagggatatatgtagggatgcttttgaatatttttattttattagattttcctgcttccttactgtcacttaaaatatggagaaccctcatcctgtgacaaggaggtaaaaatacagcagtcacattcaagatctccatacattaacaataataaatccttttgccctgagtaatacagatacttaatccacagagctcggggggatgatatagtgctccctcacagaaccaattacccacagagaagtataatgagcaggggaggtgatacaataaaaatctatatagggagagtagaattatgatgacagtgttgcctgtgtaaagtcttatagtaagtatatctccaattatcttttagaaaaaaattgtttggtgtctacttatgtccaattcatgatgaaattgcaagaatagccatggaataaaacaaaagggtacaggagtatagagaaaatggcgatagacttgtcgtaaacagagttctgttctaccccgaaggatgtgaagtagacccagggctgctctgagggagtgctgggcatgaacctccctgcagaggaatggctgtcctgaccacagttactgttactgcagatgcagacgggaacaaaataacgctctggaaaaaaaataagatgatttagatcatcacaggaaatccctacttttagagttagtgtgtttccgaagaccatatctgaagcagattgctgtgagggaaaatcctgagtgtgcatgatctctatcctaattaggagcaaacttgatctgttccgacagacatcagttgcataagtgggttaagtggcaagaaataaagtctagttctttattaggtaagtgtcaaatagagttctgaagtagcaaacaaaaaaaccttagtaacaacaggaagcagttttcagcctttgttgcagtgccatcagttgtgaagtttgtggacaataattcattaccagtaataaggcaccaaaatttgtaaaatatttttcttttaaaaatagaccataacaggccagacatggtagctcattcctgtaattccagcaccagccgaggcaggtggatcacttgagcccaggcgttcgagatcagcctgggcaacatggtgaaacctcatctctaccaaaaataaaaaaaaaattagccagtctcaaaagcttgtctcaaaataaattgaatagattgaaatgaaaattaaatttaaaaagactaaaccgatacatagtcttgttataattttgttaccattgcagtgtattcattttacttggcttccttctttttctttttttttttttaatttttaatttttgtttcttttgagacagaatcttgctctgttgcccaggctggagtgcagtggcatgatcttggcttgctgcaacctccctctcccgggttcaagtgattctactgcctcagcctccagagtagctgggactacaggtgcgcaccaccatgcccagctcatttttgtattttttaagtagagacggggtttcaccatgttggccaggctggtctagaactcttggcctcaaatgatctgcctgccttgtcctcccaaagtgctgggattataggtgtgagccaccacgcccagcgaccctttttttttttcttttaataaccttgtattctttgtagagatggaaagaaatagcgggactggggagggggagtgccaccacaactaggtgctggcaactggtcatgctccaaatctgtcttatatagtgactattacaacctatagtgactattactaagcaagccctaatagtgaatactgggcagataattttcctcccaactgattttaaaattttggtcccgtcttgtcagtttatgcccagggaagtatatagcaaacataaatgtcgtttattatgtgtgtcagagtaaaaaaggtttcagattagacaatggtggaacccaccttgccattgatggtttctttacatgtcgtgtttgtggtcattgaggatatacatgaaaataaaagacagttgacaatattttgggacctgtgaattggagaaaccagttcccaacttcagagcagtttattcatttgtttattcatttattcaatagatacacttttgaagctggggctacagcaatgaacagtctctgccatcatgatggaacttatggtttagtaagggaaacagacaaataaatgatatgcaatatttcagataatggtcagtgcaatgaagaaaaataaagccaaggtatggagccgagcacagtggctcacatctgtaatcccagcactttgggaggccgaggtgggtggattgcttgagcttaggagttcgagatggcctgggaaatgttgcgagacccccatctctatgaaaagttaaaaaattagctgggcgtggtagtgcgccagtatagtcccagctacttgggaggctgaggcgggaggatcacttgagcccctggagatcgagctggagtgagctttgatcacgcccccgctctccatcctgggtgacaaagtgagtggtgtctcctaaaaaaaaaaggtatggagattctggagtggtgccagtggagtacagtttcagagagggatggtcagggacagcctttctgctgaggtatatcaagctccaagtgaaaggagggacaaaccatggggaaagccagagagtgaagggcttggcatcagcaggctggaagttcctccatctcactagttaggtgaccttagagaggtggccttgtagcatggcattcgtatttgggacttgggaaaagcattgtggtaaacagcaaagcattacctaaacttcacatttcagtacagtgtaacaagggagagcaaactaaagagacacagaagagtctttttttttttttaagatggagtttcattcttgttgcccaggctggagtataatggcgcggtcttggctcactgcaacctccgcctcccgggttcaagtgattcttctgcctcagcctcctgagtagctgggattacaggcaccatgcctggctaatttttttttttttttttttttttttgtatttttagtagagccgaggtttcaccatgttggccaggctggtctcgaactcctgacctcaggtgatctgcccacctcggcctcccaaagtgtggggattacaagcgtaagccaccgtgcccagccagtattcatctttgcttgcttttgtagtattattcatttaagattttgtatttgtttatgcttttctttctccaacatctttttcttttcatttagtttgagttttccttttattaaatagttgcaggccttttggctctcagtggaggcattttctactctgttcctgtactccctgattaattcattctttaaaaaaatcctctaagattaatattcatcatgggggctcagaaaatgaaagtcttttatagagtaattctaaactccagaataattcatttgttctgatgcttattaaggacttgaagttgtttgtttgctctttctgtttttatagccaaataaaattttgcaatactcataataatatttgagtagaactttgtagtttacaaaatactttccacactcactcacatttgaactttaacaacccgagagctagacaacacagacactattgtgcacttttacagatgaggaaacctgaggcttagagagcagcgtttaaatctgggtctttctgtggtgcaaatatgaacatatgaatgaaaaatgctgaactgttttgtttttaacacttgggattactaaaatggtatgtttttttaagcagtctcatgaaagatgtagatgacttaagaagtatggatctataggggattatggagagagagggttatatgtccctgatcattgtgaacagataccatggaaatggcttacaaaacccctttttgtgtcattgtcaggaggaggatatgaatctaaatactcctggctctgattttgtgcaggaattttcatttatttttgtccagttacttagactaaggctaacaaatatatagtttccttctgggcagaaacagaagtaatcacaaagtaaaataaagcttcttaaaaatgcattgtcctagatttaaagaatgtttccttagaaaatgctatcttattttgagatcaaaggtcttgaagactcttaaaatttctaaagtattatagaatcaataaaaattagaactgggaaagtccttagagattaactctagaaccgttaaaatatttgatctggaaggaacctttgaagagtcccagatccccaaattgtgtgaggtgaaattgtatactgttgtgtcctcagcatcctgatggggcccatccagtctctccatggcctcttgattataggggcctcttattgcctcaagaataatccattccacaaatactgtatgatttcacttatatgcgatagctagaataatcaaatgcatagagacagaaagtagaatggtgttttcctgggctgggggaagagaatatgggaaattattgtttaatggatacagagtttcagttttgcaagttgaaaagagttctggagataaatggtggtaatggttgcacagtattgtgaacttacttaatgccatttgaaccacaattaaaaaaataaaaactaagcaaatgaagcggaaaaaaaaaagaatccattccattgctggacagctgttggaaaggctctctatgatgactcctattggtgtaagttttgtactctgtaaccacaagaacgaatctaaccctttcacctggatgaagacacccagcgagtccaccccagtcttttaaagctaagtagcctttgttccttcactaggtcataatattttgttttgttttgcttatactttgtttgaatcatgatcaagatatggttcacacattgtgattggctgatacgccctttaaatgtctattaatctagcgattcttctgtatctattttttgctcgcctattcacttggtctcctgtttaatttgttgaagaaactgggccattttttccgtagtgttttggtactagcatctccccgctctatagattaacatattcctctgtcctctgtatttcctctgagtcggtaatgggcttgagagaccttgatttataaatgtttgtagtccaactactgtcatcctttggcatctgtgggggattgggtacaggacccctccctcacccctctaccaccactgataccaaattccatggatgctcaagtcccttatgtaaaatggtgcagtatttgtgtataacctatgtacattctcccatatactttaaatcatttctagattacttacaataactaatacaatataaatgctatgtgaatcattctattgtctaggggataatgagaagaaaaaaacatatatgttcagtacagacaaaaccatcctttttcttttcaaatattttgcattcatggttggttgaatccacggatattaatcccgcagatatagagggcctactgaaaataatgattcagtttagatcttttttgagagtaaagggacacaattttatccccccccccccaactttttgtttggaaaagttgtaaagatgaggaaaaattatagaatgaacacccatatgccttttacatagaataatgtaatgaacacctatatgccttttacatagactccccaactgttaacattgtgtcatgtttactctctctctctgtgcacattaacatacgaacacccttaggtttgtttttttctgaatcattggagagtaagttactctccaatcataacactttactcctaaatttcaacataaagacatcataacactttactcctatatttcaacatatatctgctaaaaacgaagatattctcctacataatcagaattatgttcactcaagaaatttatattatatctagtttatatattgcctaattctgagtatacattaccctaattatcccaataatatccttcatagctgtggatattttgtaaaagtccagaatccaaccacggatcacagattatatttatatttagttttcatgcctgtttagtcaccttaattggtcctgccccctgcctcccttcttttgagaaacagggtcttgctctgccacccaggctggagtgcagtggtgcaatcacgactcattgcagcctcaacttcctcagctcaagccgtcctcccacctcaactccccaagtagctgggaccacaggcatgcgccaccatgcctgcctaatttttttattttgtagagctggggtctccccgtgttgcccaggttggtcctgcccttttttgggtattatatgacattttttcaagagtacagaaaagttgttacagagaatatcccccaatttggatttgcctgattgtttctttatgattggactcaggataaatgtttctggcaagaatactatataggtggtgctcagtcctttaggataggcacttggaaggcacatgatgtcactttgtcccatacttgtttataaagtgtccaccagatttctccattgtaaaggtaccttttccccatggtaattaatacataatccatggtgtttagtggttacctttttaatagttttaaaaaccatatgccattggtcatgggagaaattgtatggaatagattatgaacacattagtaaagagttattgccactgatggaaagataattttagacatttgttattctgaggaatggaggggaggtagcaaagtaagaaatgggctctcatgaagacagacttgtgtttgagtacagctctacacctgaacctatgcaaccttaaaaatgttacttaacttcttagatgctcaatttcttttctaaaatagagataatactcataccgggcaagattgttaagatgattaaatgagatagtgcaggagcagcctgtagcctagcagctgccccagggccattgcatgggagacaaggagatccttccagagcacagtttgctggatgtattcatctttagacttattcatgagccttccttcttgggattagtttaaaatattcaggcatgttgttgggaaaatgtgatcaacaggttaggtgcctttgtgaaatttcaaagaaaggaattaagaatttggagatttttggtatcattttcagacatcttaaatataacttacctgtagtagatttgtatagaatcaaattgccatttactcagacctttttctgactggaatccattttactttattataagggatttttttaaacacagtttatatgtagtctgattgagaacagtgaatcataataatcctgtgacccatttacatgcgttactgtaaaagtttcatttcgtacaagtgacaatttttaaaagttaattagacttggctacacggaggttagcaaaaagtgctttgaattatcaataattcagcagggcagacatttctgtataatgcagtggttttatagagtattgtgagatagttatccttaaaataaatggttgtgagcatacatcagcatggcggggttcgcttgaatgtagcgtgaagtgataacatctatgctttctattattggacagagcgcgggacatcagtctttctggccatgaactactagcaacctttgtcctttgtgttacctttagttaaaaacgaaaaatgagcatgaatgctggctgatggccatgtctctctcacagctaaaaattcatctgggaaagaaaaatgggtttggagatttggatttgtttcattgcatgaatgatatgtgacattctgtaaattatttatcagtgcaaggatgacagcagtagcttgaacattgttatatcaaatgaaagcaggaatcccgttagtaagaggaccgggttttagctcaaatctatcaggggaatgttgtcactttaaagccagattgttcttttaattgctatttaaaggaacaaaagtgttcccaaggtactgcagttgagcagttgcaagtaataactatggatccataattatgcagtgctgattatctggcatttaaaaaactgtggctacagtcagtgaccaatttgttatagcttgtctcttttcgtttttctagtacagaatgttttataatctactttttaactggggctacagaaatacatttgcatagctacctcagaacgtaaagcctgtgcatattataagaacaaattaagctgaaagtaaagggaagataatgaatgcccttgtaagatgagatttgcagtcatattaaacaatttgtgaatgtttggtcatgagatggttttttgtttttgatgacatgttgtcccaaggaactaaggcatttgttggaatcattataaccattgattttttttgttcttaactagcatatatttccttcatgtattcagttagcagatatattttgagtgcctactatgcaccaggaaatgcattaggcatttgggctagagtggctgaacaaatgaagtttattctatgctgatgtatatttagagagttagacctagcaaaatcttgtttttaatttacatttaaaaacatttgtgattatgttgggtgttcttgctctgaatttttgattcatgagattcaaatatagagacatcatagtaacattcagatggctagcagacaacatgtgtgaaggcttggaatatgcggtaaaattacagttttcgtagttttggctgttgaaaataatgtgaccagatctgtaggcactgtcagctattcctatggatgggaatactagcattgctgatagtagtaaataacaatggaaatactaaaatgtatgtagatttatacattgttaaaagcaattttcatacgagagttaaagggtgctaggggactagacaaatgttttgttgtttcttatataaagtgggaatgtcaggccgggctcggtggctcacgcctgtaatcccagcactttgggaggctgaggcgggcggatcatgaggtcagaagatcgagaccatcctgaccaacatggtgaaaccccatctctactaaaaatataaaaattagccgggtttggtggcacgcgcctgtagtcccagctactcaggaggccgaggcaagagaatcacttgaacctgggaggcagaggttgcagtgagccaagatcacaccattgcactccaggctggcgacagagtgagactctgtctataaataaataaataaataaataaataaataaataaggtgagaatgtcagagattcaaggtttatcttttttgtttggtatggtgtggtttacttttgaagaccttcgtggcacaaaagccttgttaataatgaccttttcaagtgtcccacagaatcctgctcattctattattctgtcacctaaaaacatatagatattttatgtcaaatatttagtaggtgaataatagcaatctgcgctgcaatatttaataaagtcttaacagtctatacatgatattcatagactataatgctgaacgaataatttattttaagcatatagataatagaaacaattgagatgtccaatgaatccttaattatgttcatttcaggcaagctatataatatataaaggtattagatttcactggtttaataaaaatgacttctgagtcatacattatactgaaatgtattcaggtagtactttagtgtcaaataatttaagagatttatcccagcactttgggaggctgaggcaggtggattatgaggtcaggagatcgagaccatcctggccaacatggtgaaaccccatctctactaaaatacaaaaaattagccaggcatagtggcgcgcatctgtaatcccagatactcgggaggctgaggcaggggaatcgcttgaacccgggaggtggaggttgcaatgagccgagattgtgccactgcactacaacctggcgacagagcgagacttcgtctcaaaaataatataagagtttttttactagcagaaagtgtttatttaaatacgttatttagcagtttttctttgttaaagaaagaagaagctttaagtgaaaaatgtaaaaagcttttgattttaatgtttttacttttgaaatggaaaagtgacagtattttttattttaattttgtcatagccccgtgctgatcccattccaatatgtagcttctgtttggggactaaagaatcaaatcgtgaaaagaaaccagaagaactcctctcttgtgcagattgtggcagtagtggtaagttgtgtttttcctatgtgttgtacaatgacttcccattatcatagcttcatgctatttgtctctctattaaaactgtattgttatttaaggcagttatatggtaatagcataggctttaaattttaaaagaaaaagtaaggaatagagaaaaaagcgtgagtatgttagtactgacatatggatattatatatgcttatataatactatacatatttatgattaagcttttattttataccagcattggtaattcagtgtggagatgtctgcattataggtaaattccatgtagagaattctaagctttcaagctgagtacaaccccatctttaaaaattaatagcaaaaaataagtaaaaattaagctttttctgttaatcttcaaattttttccccagactacccaaacttttttctccaaagtcttgttttaaaattcatgactatttctctagttatagtaatctctaaaaaaaaaaaacaaaaacaaaaatcgacagaacaccatagctaattcttgtttgggaagtcttgagatatactggctaggagcaaactcaagagccagccatagcccagttcctctgccttgagttagttacttgatcattctgagcccctgtttcctcattagaaaattagagataatggcagcaccatcctcttgggttttatgggaatgaaatgtgagggcacaagtaaacaccctggcacaaggtctgcagaactatggtaagtgtactacaaatgtcagcagtgttatggtttagcatgtttgatattgttatccttgattgctgcacgtaatttaaaatcttatcatcacttatgacagctgcttgatggttgggtagaagaaatgtttcatgctgaggaatgacagtgttgtgtaatgattcttattccttatatgaaggtttaacgtgataggccctttgtggttcagcagctttcaggtgctgactagaagggagagccttggaaataagacatttcaaaccctgcttgaaaaatgcattctgacagtctttttgatgggctttacagattcattaaaattcttttacctggccatggcatcatggatagtgacaaaagggcatggaaacattatctgtacgttcagtttaatacatttcagccccacgatatccctgttttatgctggtgaggtagtgcctcactcatcagttctgactctgtcgttatcttttgggttttctcacgaggctcattctgaatgaattattcttttgtgtaactgcctgatcaatttagtggtgttcacttgtctagggtttaccctttgtggcttttaaggtggtactttaaaaacacccttccctgtttttatttctttaggatctatttgtctgggtgcctagacagattaaagatgtacttaaatgtgggaagaaaagttcccttcatatatttccttacctctggtgatacacttacttgagttgataagaagttcgagatcattatcttctagatcataacttcaaggcctccttcacagggtataaaggtgtaattctaaacaggtagatcttagattttctgatgtaatcaatctccctttgtctttcccggattgaagacctgccagaggggaggttgatctcctttatgtttgaggtcactgaaaatttctttcccctggtgtttcttacttttcgctcagactttttcagggtaaagccaggggtgtttaggtacagtgttatgttttctctgttcaaaaatatcctcttgttttctcttttaacaaatggagaataatgacttgaggatactgtccagagggtttatgtggctggtgtggttttgtgagccagtcttcaagtggagagagccagaggctttggggccaaggtatgggtcatggcagaaattcaagccctggggtcaccatgtctctttgttggggataaaggatgcctcagagtgcttctctggactctgcgatgggatccggctctagtgttgaagttcacttaatcttcccttgagtgtgctgtgccagcctggatttggctgctttagtcaaaaaaactattgttcctaacgcagggaaatgctttgtacatatttattcatctgataaatcagaagaatagactttgttgttttttcctctttaaattgaagggtcaaaataaaatatagttcattttagggagtttgggggttcttgtggttctaaggctctgttttgacaccttggtaattctaaggaaaaaagaaaacaataggccagcatacctcaacagtgtcctcaaataatggcgggagccctgttgtcacagttcagcatttcaagtgggaattacagattagttgggactcctagttgaccttatggaaatggctgccttctcactctcagaagagtctattggttctgggattgaattgagaccgttcataatgttcaaagggatcccaaaatgtaagttgtttatgtgaaaaaatacccatagcagcataaaaccagaaaaaggaaatatagatggcagcctgtggggaggatcattcttaaatgtgtttcccatatgtgcctgatgcttttcagtcgtccctatctgaagtaccattcatatgatgtcacatttagactccgcttagatttcatagatgagagtaataaatgtatccttctgcttacatcataaagtaaagccaattagaaatttatctgtttttaaaggggctcgatgctttaaatgggcagtattttctttaacagtttttttttctactaaaaattctttaaaaaaaaaaatcattcaagtttatatgtagtaaaaacgtgaggtgaggtatgtagtgcccggagctctgaatgtggtgtccctagcctgggttccagttctcttccgccacttgctgggtgtgtaactttggttttcctcatctgtggggtgtaaaggagaatgtctgcaccctccatccacagagctattgtgggatccagtgagaaaatgataggaagatgatcagtaactgtaaaacatgagacaaatgtgaaggattattccagccactaatatgaatgtgggaatcatcagatagtctaggtctgtggaagtgttagaaatgattttacttgactttcatggatcagcctactttgaaattaacactgttatattctctttgcctcattaagaccaaattatctttaattagcttcacataagtattagatattataccaaatgaaattttgtgtctgctgctcagattgctgggtggttaaatcttacttacagatgagttgtgtgcatgtgtgttttcaaattagcaaatctaagataagtgtacagttcaaaattacagcatcattctaagtggaagctcattgaaacgggagacagaagaaaggctgctgtgatgcagctgggtgagtgagagaaatcccttttgtacaataaagggagcaagagccgtggagtagaatatcagtgcaccctcgggagacctgaagtcttccctgggtttgtctttatttgtgtgttaaccctgaacaaaatttgcatgctcatggagggaactggtaggggcagtgtgtggatatatggacatataaaaatattttaaaagaccactagtttcttaaggtcaccccaggagttggttgcttagtcatccagtttcacattgactagatgcagattgaatcattaggttggaaagaagactcttgactagaaagaaacctaaagatatgatccaaagaagaaaagaggccaggcgctgtggctcacgcctgtagtcccagcactttgggaggccaaggcaggtggatcacctgaggtcaggagttcaagactagcctggccaacatggtgaaaccccatccctactaaaaaaaggaaaaaaaaaaaattagccgggcatggtagcgcatcctgtaatcccagctactcggaaggctgaggcaggagaatggcttgaagccgggaggcggaggttgaggtgagccgagattgcaccactgcactccagcctaggtgacaagagtgaaactctgtctcaaaaaataaaaataaaaaaacaaagcagaaaagattgggggttgggggaaagaaggtgagccccatccctgcaaaagcccaaagcatgattgaccatccaaagagatgtaacttcactaaaactgtgcttgtctgggtaatagtgacctctttgtagcaaaatctaatgatcatttttaagtgtttatcaaaatctaattggtatcttttaatccacaccaaataatttctcttagtcatatttgatcttgtagagaatcttttttcttgaagtgttcttttcctttggcccctgtgacaccatattatctgtgttttttctctaccacttctttccacatatttttgttagccccttggtcctctctccattccctaaatgtttcttcagatgtctgtcgtggccctgtgtttgttactttgccttgtagcttctactgagcttctgaccctagatacaaataactatagagcttttccaacgagtctacccccgaggcacctcaaagttaatatccagaacagctcatcaaccttgcactgcttcctccacccaaaacaacagccacaacaataacaacagaaatcccagcaaacaaacagtatcccacctctcctggaggatttcctatattcagcaagtggcacaccgttcgctactcactcagttacacaaactagacatttggagccatcctctgtcctattctttcacaccaaggaatcaccaaaaacacattgattctaaatcataatatgtatcttgaatgctaaatttatcgatgcatccccaccagccagccccactcagatctgctgttataatgacctcaatctaggcttcaccctttttcctccaatccattttccatactatagcctaagttacctttttaagttataaatctgatcacataatttcataagtggctatcagttgctcttaggagaaatccatattctttaatatagcccccaaaaacttctggattgggctctggtttaaccccatcttacatcactattctgttcacattctgcacattggttacattgaacaacttctctctccttggatatacctcgttcatctctccctctgttcatgccatcttccctgctcttcccctcttctggtcccatccaatcacattcatcttttgggtctcttttttagggaggcctttctctaacttcctgctagattctcccatatccctaagccaccccattgtaaggcattaatgctcattcttgtttaatgtttgtctttcctgctgggctatgtgatctggaagggtgggaaccatgcctctccttttcctcactgtatccagtgctcattaaatattagttgaagggaggagagatggacagatggatggtcaggtagccagtctgaggggcttagtgtctgagtcgttattagttttccattgctactggaataaattactacagacttagtggcttaaaaacaacacatttttaatcttatagttgtaggttggaagtccatcatgggtctcaccagattaaaatcggggtatcagcagggctggctcctctctggagactttaagtgaggatccatgttcttttttttttttttgagatggagtctcactctgatgcccaggctggagtgcagtggcgtgatctcggttcactgcaagctccgcctcccgggttcacgccattcttccacctcagcctcccgagtagctgggactacaggcgcccgccaccacgcccggccaattttctgtatttttttttttttttagtagagacggggtttcaccatgttagccaggatggtcctgatctcctgacctcgtgatccacccgccttggcctcccaaagttctgggaaggagaggatccatgttcttatccatctgggttattggcagaattcaattccttgtgttgacaggaccgagatcctggttttcttgctgtcaggtgaaggtcatggccaggttctacaggccacccacattccccggcttgcagccccctccccatcttgaaagcctgtgatagcaggtggagtctctctcatgctttgaacccttcctcctccttttgccatttcatttctaaccaagtccgtaaaaggttctctgcttttaaggattaatgtgattagatcaatcatgcccactcagataatccaggataaactccccatctctaggtcggtacccctagtcacttctgcagagttctttttgctacaacaggtatagtatgtttacaggttatgggaattagagcacagatggctggggcgctgctgttgttgtgcttactacagagcctgtgttttttcttcctcagtactttctccaaaaagcttttccactggtttgtagttccattggtacttgtttaattttaaatagtattcctttggttttgctagataaaactattgtaagctactagtacttgacaatgtatttgtgtaaaattgaatgagtgaatgaatatgtattatggctctcaaatctgataaattgcaaaatacaatagtaaaacaaactccagaaagacaaagcaccatgaaacgtgtcaacagagagaacaagaattttagaggaaattagctggacgtggtggggtgtgtcagtagtcccagcactttgggaggccaaggctggtggattcttgaggccaggaattcaagaccagcctggccaacatggcaaaaccccatctctaccaaaaaaatacaaaacaattagccgggcttggtgatgcgtgcctgtagtcccagctactcgagaggctgaggtgacagcactgcttgagtctgggaggctaaggttgcagtgagccgtgatcatgccaccgcactccagcctgggcaacagagtaagaccctgtctcaaaaataaaaaaataggctgggcgctgtggctcacacctgtaatcccagcactttgggaggctgaggcaggtggatcacaaggtcaggagatcaagaccatcctggctaacacagtgaaaccctgtctgtactaaaaatacaaaaacaaaattagccaggcatagtggcgggcgcctctagtcccagctactaaggaggctgaggcgggagaatgtcgtgaacctgggaggtggagcttgcagtgagccaagatgacgccactgcactccagcctgggcaacagagcgagactccgtctcaaaaaaaaaaaaaaaattaaagtgttagaggaaattgttgagtttatgaaatcgctaaaccagaggtaaggaattacttgatcagtagcattgctttcctttatctaattactatagattgtgcagtagtatatcaagacacgttacggtcttttgtgttattttaaagttggccatgagaaaataaaatggaaatatttcttcatccctcagcatcctttacagaatcatagaaatttagaactgtaagggatctatggccaattctcttgagctaaataaaggtaagattgctgcctaaaggaaagataggctgaagattttagaatttgatagggtagcttaaatagtagtagttgagatacagtattgcttaaagtgagagaaaccattaagagaaagaatattccttgcccctgattgaaaatggctgaaatccactaattttcaaactgcataattattaaaaagtctgtctttcataagatacctgtgagaataaatagtaagctgtaatatgatgtgaattaccttagttactgaatattaagtcacaaagtacaaaagcagatttgaatgtagagaaaaattcagtgcgtgaaattgaggtcatatgtgcccatgatatatgccttacaggaagtaataaaaaagaggggggaagtaagtggtatacttttaagctgatgggatccattttaagggtggaatttaaattgctgttctttaaaagttaagtttttaccctcctcactatataaggggacagaggggagggctctgatcaaagtagacctctcccctccccgcttcagtgtgcttcttagaagtcgacaagcaagctgtctttgtttgccgttcctgagcagaaagaggagattgataccatttttatctattcagactttttccttgcattcatttgaatgagagaagcctcataaaagaacagtgtcacaggttaaatgcatctgcctgggtgtctctcctgcctgaggtcataatcctgtgacaatattttattttctcaacatcttaaatacagatgtttagagttttttttttttaactcaggaatagtgtgcttttattaacggtattggtgattgattttgaatgtttttacttcaaaaagccaaatctcctggtgggtggaattttatgaagcacctgttaagctttagggaggaggacctttttggcagcaatccaaaatacatatttaaacaatgagcctgccaaagtcaggaaattataaaacagttttgaaattgcagaatctgcttttttttattacccctcaggtttcctttgcagcttggttgtaagttctttcacatgggatttactaatgttcttactatttaaagaccaggtttaaaaaaataaaatcaagtttggagatctcttcgggtttatgtgataaaagaccattagattttaaactgtacagccttccaaagaatctaggctcacgctccgcacacctcttggaggaatctattacacactggctcatggctggctcctttgaatggcattgcccctcagggtctccagttttcctctgtgaagtgagcagtaagacctggtgtgtggagcgctgctaggtgaaaagtgtgccccaaacaggaaaatgggggaacctgctgaggccacacttcttggtgggtcctgtttaacctggatctctcagcttcttaactctgtctctcaaattcactgttttctgctcctgcttccagagtttaaactcagtgacccaggggcaagatggcaatggaatatcctctgtctagcccagcaatgggatgttctttgtgtgctattggatttgggtgggggagggcatctgtagttatgttaagcagcctcaattttttatttagttatctgttgagttttatgatttcatcacacacagagagcaggaattgtttgaactttggcaactcccctcagtgtgtggcaaaccaggaccccctgggtagatggtggttgatgaagacggcaagtacaggtgcaggagtaagaatgcctgagcctgtgttatcttcaagttctcaaaggcttcagattggaattggtataaattaagttctcttagggaaaacattcgtacagtcattttgttacatacagggaaagaaggcaaggggaaaaggcagaaaggaaaatctgtaattcggattctctgatctgttggcattttcaagttcctaaggttcattggctagcctcatcagctatctattaaatattagggaatgggagtttaaaaaagtcaaaggcaccattcccatcaagcaatttgctttttattctcataggacacccatcctgtttgaaattttgtcctgaattaacaacaaatgtaaaggccttaaggtggcagtgcatcgaatgcaagacatgcagtgcctgtagagtccaaggcagaaatgctgtaagtatggctcccgtaatccgcctccaggtaactcgctaatttccagtgttaaggtgttttcatttttatagagtatggctactttctttctaaagctttaaatacacatgatgtcaaactgcaaccaggatcttggtgcactttccttatattgtattaatgttaatccagtaacaaaagaatttttggccttttacagttggtttcagtctcaattagtctctaatatgttatattacaggataatatgcttttttgtgattcctgtgatagaggatttcatatggaatgctgtgacccaccactttccagaatgccaaaaggtgaacttctaaactgtactaaaaatgtattttattacatattggttagctttgtcctgaggtctgacagctcagaggtatacaggttctttaagcatttttttcatccctcccaccttccctatacttctgagtttagcacaggttgtgaatagaggagtataaaagcatagaaaaaaatacatatatatatgtgtatatatatacatatatataaaataaaggctctaattcagacccagggatgaaaagaccatctctctctccaaaccattcccctattagaataagattagattattaaggtcaaaagtttagaacactttccatattattcagcacagtgttaagagcttaacaaattttatatttttgaggatgatagtgactccaaagtcctacaacaggaagccatcaccattttcttggccattagttgatattttgaacacgagcatctgaatgatcttatagctgattgtgtctgatggaatgtggattttcttctgtttattgtgtaaatcagctaagctcagccttttcccctcattttgcaatatattaaacatttaaaaataactttgcctttttattataaaatccataatttacattgtggaagatttaaaaagtacagatagacaaaaaaggaataaaaataaaaatgaattggaaatttccttctctgccttcacataccctttgaagggaaatggaacattctgtacatgtttttgtaatgtactttttcctccctcttaatagattataagcatcccctacatcattaaatattctcctaaacatagtttttaataagtatgtagaactccatagtatagagcagggattacaaacctggcaactatgggtcacagatatgctttgttggtacaatatttttacaagtttgaatctgagtcctctgggtggtgcgtgtgtgctccagtttgccacaatctcactactccctgctgtcttacgttccaatttgcttcagtcacatacattatacaatctaggtccttcctggaggtatttgattttccaaccctctatataaatgaactctaatttatttaaccagtcccttagggtggatattacaaatgtttccaattttttccatccacaattatttccttgaaataaattcctagaggaggaactgttggatcaaaggctagatacatgaaaggctgtatcagttttcaggctgtccagcagtatagaaggatacctattttcctgtattgtgaccagtactcaccgttactatatctccttgagtctaagacacatttttttaatgttttaatatttttgaagtcagatgcatcatacagtatcttagatttgattagagtattattatttttaaaattttaccagtttgataatagaaatatgtctgattatttctttttaagtagtcagattgaacatttcttgtgttttattcttggctgtttgtatatcatcttttctaaagtacctctttttatccattaatcatttttctcttgggatttttacctttttcttcctgatttgcagaagctctttttttgtgtgtagtcatattcatgaatctttttatttatggcttcagttttaaatgtcagtcatgcttagattatataaatatccacatatctttcctggtacttataacattttattttttcatattacaatattcatctgtctagaatttattcttgtaaaggataggaaataattcctcttccagatagatagctatttgttctatcatgcttattgaatcatttcatcctttctccactgatttaaaatatgaccttttgatatgctaaacttttctgtaggctttggttgttctggtctttccattcttatccattgacctatttctctatgctagatgtatagtttgaatcattgtagttctgcagtactcaaaacttttatttaaattttaaaattatattttatactgataatttttttttagtgttggaactttccagaaagagatgataagacaatttttttttcttctagaaattccaaaaatggactgatttgaaaatgtctccctcaaatcaaaagatataatatctgacaggggcgagttttcatgtgtgtttatgtgttggtgagaggcttaatgacatgttgggaacagcttcatggaaggattctgagagaggggccacctctgccctcaccaccttcactccagggaaattgaccttagtgatggcttcctaaggaaaatgacaaagggaatgacgcattttttggagtaaagttcagcatacaggcatccttgagcagcttattacagctacaacttatatttaatatcttctcttaaaatgaaacattaaaatatttttctcatatatatattaattcagggatgtggatttgccaagtctgcagaccaaagaaaaagggaagaaaactacttcatgagaaagctgcacaaataaaacgacgatatgcaaaacccattggacgaccgaaaaataaattaaagcaacgattgttgtaggttgagatcttatcaaaagaaatcatttatgttttgctttaaaatataggtgattgttattctctcagattcctttaggggttttttggcatcattttttcaaactcaagggttgaaaaatacttttccttttgcataagctgtggaaattttttgaaaataacatttttaattaccattggcattttggggtcttctgttggcagtagctgtgatactaagtgacatttttcaagcagcaggatggaagcagaatgtaagaattggaaacagtcattcagcctactttattactggctgagcattagagcttaattatgtaaatattttcataggaattttaaaacgagagggatttgtccatgtctatagcaaatctcttttgtcactccagataacattttagaaaaatacctctctcttctgatagtaatgtagcattaccactttttaagatctcttttatgaaataggagcttctgaaaaacctgcagatgaccacttacctctgaagagttagacagaactatttgacaactgcactagtgcagacatatatataaaataatatattcgcagtggcctggaaatctactatgataaccccattttcactatcttgttgctgtataattgccattaaagcccagtagagcatttagcaggagttagttggaaaagcagagaaaagataagaggtgaaatgaatttattttaacctgtgtagagtatagatttgactatcagcattaaggtgtttacgaatgggatcagtagacttgcacatctatagcagttctaccaacagactaccaccatcttttcaggcttagtgaaagggtcattgtgatggagaaagaatacatgctctgcacacaccttgaacagactccaagaatctcactcccttgcttactccttttcccctaattttatctgaagctgctctcactatcttatttgctctcagaaaaatagtattctcccgcacctttatctcctaagaagaagtaagaaatgcaggctcctttctagagttttctatgaaactttgcaaaaaccctttaaccagtagacattttcaatagattttgaaaaaatttctagaggcaaacatgaaacatttatgaataaaatctttcatggtagtatcatttgaagtagaaattatatgtttttgcattcatcctgtgtaagcattgttcccaacatgggtccatatcctcagggcccaattaaaaaaaccaaattaggatataaactttctaaacagaggacacagctgaaaattgcatctggcaccaatcctaactttttgtttgtccaaaattgtcctttgagcttaggaatttttaagacagtctagggagttttcctttttacatgctttataagcatattatcctttctgggcaatcgattccagatacaatccaaatgcagctttctgatgtgaaacatttttgcctggatgagttccttgttggtaactctcactgtgtctctagtgacactagagatctctagcgttcacctgacttggctgaattggtggtgccaggcagagtccctggcagtagagccacctcagatgagcctggtagctgcacctacctccccttcaactaacagctgaaatctggtcattaaatctttgtatacaagatgatcactaaaatatactcttgtatttgtaattacttaagatatttttataattcagtattgtatctttttaaggctttcattttgtcattattcacctttagctaaattgatcattttgaaagtacattcttgggccccagcattgtcataattcatctgcaaatgtttctctattgtataaaactctgctacaaaatgggtagcttcgcaaaccctagcctgaggtgaagacagtcggccgctgttcatgtaagcagctgtgttagcgagtgacctctagtttctagaactactcaacagtatgggcagaaccagggtacaaagattctgacgccaagtgtctgataatgaccatggtaaatgtgccgcttcttcaccagactctccatgtcatgtctgacccgctgtagcttttctttaatcatttcttcagttttttgctattgttgtccttttttcagcaatattttatgctgtagttaattgtcttctctcctaagagagtattattggttatcttaccatcctaagcacaaactgctgagaggaagaggatgtctttttatgttttcttaaaaaaaagtacaaatttatagccatatccaaactctatttatataagtttgcaaattgaattaaaaattacttttaactagagattagataagcttcttcttttgcttctggataacacatatgacttatttcctcctaatactttaaaaaagacatttcaggaaatcataactacttgtgacaacaccaaaggatagcttgtttttatttaattataattaaagcattgggtgttcttttagtctcttcagcatttttcttgcttatattgcccttgggtccacatggattcttccagtacctggtggatgggccctggaagaaccatgacatgtaaatgcagttgctgctgcctttccaacagagaaacatctaggtggtggcacacacaaaaaatacagttcttaagtttaagcccattgaatgcatctagttgcaataaatttgtttttagatacctttataattctatttattaaatgctgatactattctctaaatttctgcctaggtctgtaaccagtgatgaaggatccatgaatgcattcacaggaagggggtcacctggtaggggtcaaaagactaaagtctgtaccacaccttcatctggtcatgctgcatctgggaaggactcaagcagcagattggctgttacagaccccactcggcctggtgccaccaccaaaatcaccaccacctccacctacatttctgcctctacacttaaagttaacaagaaaaccaaagggctcattgatggccttactaagttttttacaccatcacctgatggtcgcagatcacgaggtgaaattatagacttttcaaagcactatcgtccaaggaaaaaggtctctcagaaacagtcatgcacttctcatgtgttggctacaggtaccacacaaaagctaaaacctccaccttcttcacttccacccccaacccccatctccggtcagagccccagttcacaaaagtccagcacggccacttcttctccctctccccagagttcttccagccagtgcagtgtgccctccctgagcagccttaccactaacagccagctgaaggcactctttgatgggctttctcatatctataccactcagggacagtctcgcaaaaagggacacccgagttatgcaccacccaaacgtatgcgtcgtaaaactgaattatcttccacggcaaaatctaaagcccacttctttggcaaaagagatattagaagtcggtttatttctcactcctcctcctctagctgggggatggctagaggaagtatttttaaagcaattgctcacttcaagcgaacaactttccttaaaaagcacaggatgctaggcagattaaaatataaagtgacccctcagatggggaccccctcaccagggaaggggagcttgacagacggaaggattaaacctgatcaggatgatggtaagcaaaaggtcaaagctccaaccaaacctgcgtcccgtccctttctccccaaccctgaaaaaaatcaaccaatcaattcctatttgtcacataggtcttagctatttctcttgttctcacttcactttcatacagaagcagtgaaactttgacctttttctaatgctgactaaacctccaaaatgttgtttttccaactaatactctcccaccttttattatttatttccattcgtagtgacactaggacccccagatgccttcatagcattgcttatggctttgtagtcccgcatgagtagccactgccatgcttctgccatgctctcccccatgtcacctctgcagccacagcgctgttcagttgtgtgctgtcagtgcttccaacagggggtgtttcagctcttccctctgctccattgctttctcatgacaaagttcatcctgcttccgtctcagcaaagcctgatctgtgactctgtgatgtgtgcttttggatgtgagtgtgtctgtgtgtgtatccaccttagggagaaaacggatttcataatttcattgaacaaattggcccattacatttgctaccctttatcaaacaaaaaccgaaactgtgtcatttggacaaagtggtagaatttattatctcaaaagtgataatgggaatgctataactagacatcgataaaacttctaatcttggttgaaaaatatgatttcactttgtattgctcttactttccctcatatatttattaaagctgtaaaaagatgacagtgataaattcaaataaaaatttgagtatagcagggaaaggatactgctggatctatgagcagtgcttagatgtaaaagcttatttataaagctttaaaaaaaatccctatttgcccagtatgctaatttggtgccattttggtaatatatggtggttactcatgattcaagtcagtgaatacactttctgctggttttaaatgacagatactgaaataaaaataaacatcaaacaagaaagtgcagatgtaaatgtgattggaaacaaggatgtcgttactgaagaggatttggatgtttttaagcaggcccaggaactttcttgggaggtaaggcgaggatcccacattgtagtagcaagtataagatgtggcttctaactattaatatggaattactgtgttgattttatagagaatccctttcaacatcctttgtgattctttagccgttatcatgcccatttctactgactgtacattcaaaagcaatgacttagtagaattgtcgccactcttaaaagtaggtatggactcagctggtctcacaaaataaaacagagtagcattagttgaggcagattttggaaaacatttctaggtgtgaaggaatagatttctgatgagttttgcctaaatttagaaaataacaatttaaaatcattaacaaaaagaagaacatcactgttaaattcaccgatgtttcttccaacacagatggccagccatatgaaaaatgtctcatatttttagctcttctgcattgatgaaaacaatattttgtttcacaatcagttgtagtcagttttatttttattgtccagtaatttctttaagtgattccactttaattctgcttaagttattaccacccagatattgacaggtgaggctgtcagacttctcaaagacgaatctaatatgaattgtgaatttgttgtgtcagtgactacattcggtttctatgaccagtgtggtcaggtagactccctacccaaccccacttcctgttttgtggggaaggggttttctgtaggctcttaacgctttatttttagtagcagccagttgggctaaatactcctgacagtttctaccttcagagctattgggtatttccaaccctcattctgccccgatctatcaggatgccttgtatcagctttcctttggctaagataaatgtcagatttcccccagttattaaggttggaagtccttgaaccagcccaggttggaaatggagcaggtcaaaactcctacgttgatcagtagtgggattgtgcccttgaatggccactttactccagcctggacaacacagcaggatgccacctcttttaaaaaaagattcgaagtccttaaatattatctttttttggcctacttctgacattcatatgtaaacatgaacagtaggccattatctgaaagatactgctaattctaaagttttttcattccaacatggtaaaactggctttttttattcaagaaatattcttgttctgtgtcaggcactgtaccagacaccagggataccacagtgaatctggcaggcagagttcttaacctcgtgtggcttactacatggaaataagggaaataagaggagacaaatgctaagctgcagatttcacaattgattatttaattacagttgtgataaatactacttcgtggaggaataggaaactgtaagcttctgtaataaataagcctgtgtaatagccacatcatttataatcacctaatttctaatctgttacaacagattgttaaatccagttctatcgacatttgtatgtatttataccatacttatttcctttgctatattgtttcttagggtattcgtttgctgtgaatcttacacaaaggtaatgttaggttggtgcaaaagtaattgtggtttttgccattgaaaaaattataaaaacagtaattacttttgcaccaacctatttcataagggtctatagtgttttaaggccatgcaaattcacaattaagattagtgttctgatcttgataagttttgatagtcactggtgaaagaaccaaaatgtaagtgaagtatatatattattattttccttttctttctatttgacagaaaatagagtgtgagagtggggtggaagactgtggccggtacccttctgtgattgaatttggtaaatatgaaatccaaacctggtactcctcgccttacccacaggaatatgcaaggtaatggaataagtctggcaggtgtataacttgaatgtcacatatgtgagaaaggaaaattcttgattctaaagcaggaattagggatgattttaggaaataaattttggtagtcaatgccaagtgcttcccaaactattgcttttgccagcacctttttatggtattccttgttctcggtaaattccttatgctccttagttacatgggcattataaattttgccatttagcttctagattgtgctttctttccttggttaattggggaaatgttggttttgtatgaaaccaaattaaaaaaaaaaaaagaaatttgccatggtgaattattgggtagactttcttctccagttgtcttttatattttttaattaggcctgttacttttatctctgatttctggcattttattttcaagtttttaatagaaatttagcaaaagaaggaaaaatgggagaaagtaagtgggaatgggtagtcttaagagacccttccccaaatttttactttagaacatttgtgactttgaagagaaggccaggcccggtgactcactcctgtaatcccatcactttgggaggccaaggtgggtggatcacctgaggttaggtgtgcaagaccagcctggccaacatggcaaaaccccatctctactaaaaatacaaaaattagccagacgtgataggacatgcctgtaatcccagctactcgggaggctgaggcaggagaatcactggaacccaggaggtggaggttgcagtaagccgagattgcactactgcactccagctcaggtgacagaccaagatcccatctcaaaaaataaaaaataaaaaggagaaaataatggtatccaagtttttgtttgtcttgaactcaagattagcctgtgaacgaatatatcccaaaatgggtacattgagaatagatgtcttccataaagtatgtcagggtacactttactagtatcttcaaaaattttttagtctgcaaagttttcagtatttataaacttgattttcttatagaatagatcttattttttttcgttagcatgtgagtgtctggccaatcacgtaactggagaaaatgctaagtgttttctaaaagttaagtgacaaaataagagtcaagaattttggtttctccttccttataccatttggttgtgtgttcttgaacaattttaaaagactatgagctttaatttgcataggtaatgataagccatgtgctctgaaagatttgaataaaatttgtacataagtgcaagatttgaaagtagtctcacctgtgtctgcctctctcttgaaaacctttttccccattcttatactccaaagaccttgcaagtgcttctaaacattttcttataaataccagccatgttcattaagatatggaaataaaaaatgttctgatttttaaggtggagaaaaagtcagcagggaagagaggtgtttgtcttttactcaaagtaacagtggaattggtagaaaacaaattaggtcttttgattttcagccgtgctatttactgcatttagaccatatataaatctctgataataactttaaagttacctcttccagaggtggaaatggtaacaactaagtttgaggacttttcagcctcatatgtatgcagattgtttaaaataataaattcacttctgagtaagatattatatctataccactaaccatatataattggaaataagatagtaaatgtgaattttgaaaaatatgcttggtcccttgacaggatgatatccttattaagttgattttttagggtggtggttccacatctgtaaagctttctttatataggatatttttaaggaaacaaattatttgttcacaaagtaaagggagcacatattatggattatattaaaaaataatgtatggttgtttttacattctgtctttactattggctggctttctttctttctttcttccttccttccttccttccttccttccttcctttcttcctttctttcctttctttcctttctttcctttctttctttatttttttgacggtgtctcactctgttgcccaggctggagcgcagtggtgcaatctcgattcactgcaacctccgcctcatgggcttaagcgatcttcctgcctcagcctcccaaatagctgggaccacaggcatgtgccaccacgcccagctaatttttgcatttttagtagtgatgaggtttcaccatgttggccaggctggtctcaaactcctgatctcaggtgatctgcctgccttagcctcccaaagtgctggaattacaggtgtgagccactgcacccagcctccaatgttattatacagcctttttatgatgtagagaaaattgaacaatatttaatcttccccccaacagtataatctatctgatagattctatgatttttaaactttaacagattaccaaagctttacctgtgtgaattctgtcttaaatata

SEQ ID NO: 85 - DNA, 4320 bp, Homo sapiens
  source 1..4320: mol_type = genomic DNA
gcaaatccactttctttttacttcccactttttccctttcaagttctagtctctttgaaatatgagaaggtaggaaggaattgatgtgtctgcagattgttgtcttacaagtaagaacaggtggactgggcggccaagctgtcacagcctcgtgaggctcggggtccccttctgtaaagccaaggggttgcacagtggcctctgggattatttcttgcagttcctccctggtctgtgtttccatgagtaggtatttgttctctgctgaattggctactgttaatacctgcctgtttcctggaacctagcgaggatcagaaatgctggtggaagttgagggctggtggctccagcctggctgcccagcccaactgtttccctctgtctctgagccaggtggggtggatggaaagtataacacagcagcttcatggccaaggggttggggagtggtgagatgtgtttggggccagggcctgaaagaagtctctggagtcctgggcacagtccaggttctgttccagcttgtcatggacctttgccttctgtggccctgtccagcctccagattgcaatcacatgcacttgttctgatcatccttgggttatacagatgaggcaggggaggcccagagaggccctgtgacatgcccaaggtcacacagctatgtagcagacatgggactaacacccagttctccctactcctgggctggctgtaccgctcagcttctctggaaagataagaatgtacaaaagttctctctaagacttggctgtcacatctgtaaagtgaaagaatttgactagattagtgattctcaactctgcctgcgcaatagcgtcacccatcctgcagactgaagttccggagcccaggcagctggtctttagagggggctgccgacttggttggaaaaagcaacagcaatcacacatgaagcagctgcctgttcagggggagcctctgcagtcctgaagacatttcacagggagcattggggatgtcacccaggctcaaggtgggctcatctgaagcctggcacctgccatgacagctgagcacagggcacagaggcacagttagttagctgagtgacatctttagtgagtggtctgtgctcacagagctcccttgccttctcatcctggggagatggctggcctgccttcagctggagagtttgctggtaagatattttaaaagaaactgtatttttctgttctttttggggtctttaggattcctcggctactgggccctttgtcaggagaataattcatggactcagctcaggaaaccttagtgcctatgtgtttacgcagagggctgggcgaggctctgtggaggactgggtggaaatgcttctgtcctcagggagcttccaggcaggaaggtgaggggctcgtgggaacagaaccgcattatggggtgggccgcagtgggcccaggagttggcatggtcgtgatctctgaatgcagtgagcagaaaacctgtaatttttttttttttttttttttgagattcagtctccctctcgcccaggctggagtgcagtggtgcactcttggctcactgcaacctccgcctcccgggttcaagtgattcaactgcctcagcctcgaaagtagcctcgaaacacacccagctaatttttgtgtttttagtagagatggggtttcaccctgttggccaggctgttcttgaacccctgacctcaggtgatccaccgcctcagtctcccaaagtgctgggattacaggcgtgagccaccccgctggcctgtttttctttttaatgctgcccctgcctctgtcccaataaatgccattttttaaatgcaagtagatttttctttaattttgtctactgtctttctttctagtctaagtcttgtttctgtctctggtggcaaaacagcagcggcagactgtgccagacctaatgagagagatttgtctggcagcttttggctgtggagctgactgctggcacattgacttagaatctccatgagtagagattgaggggaggagggagtattaggtgagcaggagctgtctgctcaaagatatggtatggggagagactagtttagtttgcatgggggactagtgaacgggaaggagccgggaaagacagagctggaaccagccgaggcagtgctgagttagtaggttgaccaataacgtgggtcattggtgtcactcccccagactgaaaccctcttttggcgtctctcttgtcatcactttcctggcagttgcaaaccttgagaccaggtgccctgtactgtgtgattcctcctggcctccctgctgaatctccttcacctctctccacagcagcccccatgctcatctgccattcaggttcaaacagttctcctgcctcagcctcccaagtagctggaactataggcgcccgccagcacacccggctaatttttgtatttttagtagagatggggtttcaccatgttggccaggctggtcttgaactcctgacctcaggtgatcggcccacctcggtctcccaaagtgctgggattacaggcatgagccactgcacccggcctgcttgtgttccttcatctgccccacttccgtgacctggccgctcctgggctctgcccctctagctttgtttcctctgtgctgtcactgcacattgacatttacaaagcatctgagtgtacctctcttctgctgctagacacctaccaggtgcagttgcagagaggatgttggcttttccaaatgtcccttctggggatcccttattgtcttccatcatggttggttcactgttcagcaatcctgtggcctcctcagtgtcttatccccaccctccaatttcatttcccctcccctctctcctctcccctctcccccctccccgtcccccctccccgtctctccctcccccgtccccgtctcccccctcctctcccccactcccccctcctctccccactccccccagttattacacctgacctgacacctcacccccctccccgcttattacacctgaccagggacaaaagttttcagaatcacagactctctagaaccccactgtgtgttagttttattctttgtcttcaaactacccacatttaaatacaaagatacctcatagaagtgaggtaattggggggtttctttatgttatccgtctggtaatttttgagatgcaagaatcatcactcccccacattctaggtttctctgatgttacctgtttagtcaagtcacttaatgtggagattgagcctcctcccctctcagcattttaatggctgcttctggtgttttctctcctagtgcccccatctctccctctccaggaagtccatgtaagcaaagaaaccatcgggaagatttcagctgccagcaaaagtaagcccaggttcttcttaaccctccagatgcccactcagacctctgtgtgatggactggatgagaaccatgttcttccagagagtttctgcccctttcccatcttcctttcatgctctggccagagtcattttccccaaacagggacctgaccaaatcacttggtttaaaaacaaacaaaagtgggtgcctgtaattccagctactcgggaggctgaggcaggagaattgcttgaacccaggaggtggaggttgcagtgagctgagattgcgccattgcactccagcctgggcaacaagaggtacactccatctcaaaaacaagcaaaacagctcagtaaacctttttttgttttgttttaaagacagggtcttgctcctgtcgcccaggctggagtgcgatggcataatctcagttcactgcagcctcaacctcctgggctcaagcaatcctcctgcctcagcctcccaaatagctgggaccataggcatgcatcaccacgcctagctagtttttgtgtttttagtagagatggggtttcgccatgttacccaggctgatctcgaactcctgaactcaagcaatccgcccgcgttggtctcccaaagtgctgagattccaggtgtgagccaccatgcccagcctcagtaaatctttattattgaattacttggcctgtgcctcaaggttttctgttacctgctcaccaggtaacggggtggctacttgccatgtccatctcccaccatattccttcctcttccaccctcatcagtatccctccacattgctgctgttactgctactgaactcttgggtaacatggcctcacatatcagggtgcctgtgtccacactagactgtggtcccccgaggcctgggaccaagccttttcagtgctgctcactagcc

SEQ ID NO: 86 - DNA, 12014 bp, Homo sapiens
  source 1..12014: mol_type = genomic DNA
atacagtatacatggaggaaaatgagtgaccaggtgatcatatggggatcttaagaaataccagaagttgttcttttggaaacttgtaagcttcttttaaaatcttacttcctgtcggtctaagaagggcactcttgatgaatgcttcttagttgtttgtgagggttgtggcttaaagtagctaagctttataattctgttggctctgtcaaatgaaaagtctatccattccaaaactgaacaaataagttttatttctgtgtgagaacaaatggttacttggaatttactgggatttttctttttccaaatccacatagtactggcaacatcttttttttctttgatgttaagatatttccaacattgattctttacagtatatgataggtcaagggattccattcatcatatactgataggtccaaggatgagggaaaaacttcatacaagggaaatataaggtgagttttaagatgaatctagtaccttattttcccacaagtccaaacattattacttttttatataagaaaaatgtttagctgttgtttcatgtggaaacatcttttcttcctttaagtgatatagaatacttgaaaaactattccttgttttcgttaccaaagaatttaggttttctaacaattgtttcctaatgacttctcattctgtagctatttacatttttttcttgaagattttattggaaatgtttggcgtctttatgagttttcagcaagttttgatgtcgtttaatcactaaagtttatactatgccagtgatgttattttatttgcttaatatgaaaaacctcaataagtttgtctcatttccagttaacttaattagaacatttggctccctctgaaactgcttctcatttttaaagcagaaggtgttatttagtgaaacctacaaaagaataatgttagagaaaattgtactttttagctgaaaaatgttctgtgttaataaattttagagctagaaactttttcgagagctcagttaatccttctgggacttttgaaattgctatctcagtggcagtatttcttgacaaatacagtattgagtgcttttaatgatcttttgttaattatatatggctccgacagtagagatttgagtttggcttaaatgaataaatactatttttacccatggtcaccttaaaaattggagttaaagtgttggcctgctggtctttttccttctctttagttttgctagtaatagtaagttttatttgccattgtataggcttaattggttaacatgtggctgctaatatttagtaaggttaatttttagtatgaaaattaagagtttcattttggtttttatataaagtgaagctatgtattaatagatttggtagttaattatgctgaataacaaaagtctaatatttggatgatcagtatattagtagaattagaaatacttgctcttgaagttgtttaaaaattgagatagaaaaagaggaagttgattttattaatgctgtaaaactgtcaaaaataagtatttagaaaggcatatttgagtgctaaattacttatgaactgacaactgttaattctttgcttaaaattaaaatcaaagtataatgccattaaaacaagtatagaaaaggcatgccagtttcccccatatttagggtattatttttcaaaacatttgctgaattaaaaaaaggttacttaaatttcaaatgtgtgttttcctctaaatgaaaattttccctttttcctcagtgtttttctgatgttcaagtggcagtaggtgtgggaagccgttgcaagcagtatctcccaagagtgagcttattctcctattgtagatatcaggatatcattgctttccttttctgcactgtatcatgttttagttattttatggaaatctatcagagtggaagagcaaaaggtcagttggaagagaaaaaagatgaaactgaaactaaaagtggttaaatatacttacattaggtatcaattactacttgtatattatccatgttacattttaaatttgcattggcttttttgttgttctttaggtaccttgctaggattattgattttgttcattatgagcagatctgagtgcctatcatgtacataatatttctgtgaccagttcattcattgtgctcaagtgataataaccaattttaatattaattctgtaaaacatatagcgcttaatattcctcacatatggagcttaatcttcccccacaaattttattttgtatattttaattgcaaaaataaaggatttattcatattgtagctagtttgcatcagcatgaattaataagtttcactatttttcttgttagcatttttaagttttattgaattagatgggtaaatgaatagtaattatattatctgcagtgtaattatctttgatttcagttattcacaccatctctttacaagtgataatcaaaaattatttcaaagtttgaaaatttttaacataaaatttctgctcaatttttatactttttaaatttccttcaagtaatatatgcacatagttaacaataagatagtaccaaaagacttaaggtgaaaaatagcagtcttctttctatttctgttccactctacagtcctgcactccaaaagcaattactcctaattttttccccatttcttaaggtatttacctacataatttaaaataatatggctcttctactaattttttggcttaagcagttttcttatgataattgaagagttagctcttttattatgcctctctccattctttctccattctcttgctatagttatgtcatgaatttaaaatctatttttggtatttatattacttgattatggaaatactgtttatttgtgaactaagtagttcactttttttttttaaagcatccagtgttactattaataagtagaaagccattctgatttctctctggaagcgttcaagatttcctttacccctggtgctcacaagttttgtgatgctgtgctttgataagtgtctttttttcaacctttgtgctgatatttgatgggtctttttactttttaatttttggggaaaaattcatgtgtgtgtttttttttctcttccctttttttgattctttctgggcttcctgttagttgaaaattctgttccctaggttaatttgcctaatttttaaagtgtttttctcctatagtttatctcttaggctttttgtcttatttttctagttgtccttcacttcatctttctgtccgtctactgaattataaaaattgtattatcatagttttaatttcttagaggggttccttattctctgttcccattttaatattatgtctttgattcatgggtacaacatctattcttatttttctgagattattaataagagtttattgatgtcattcctcctacttcctaatttcttttggcacattttggtctttgcttttctgttgcaagcttttgtcagattcttcaagtcttagttcttgcaaaagcagaatctaaaataccctatctttggtttatttggaaggtgattccaggaattataatgagagaataaggaggtgagacagggaagagaagaagtccagtaaaaggtgtattgattttgtgggttatcgtttggagcagctggagctcaatactgctggagactttcagagagactgtgtagaactgcactgtctaatactaatcactagctacatatggctattaaaattaaaattaaaatgaatgaaattaagtaaaattagagattcagtttgcattcacaccagccacactttaagtgcagatgtagaacattagacagtgcagatatagaacactccaattcagtccagtccagtgcagatataggacatttccatcatggtttataacataccttagaattgtaccatggaggttcaggaaaactgacctatttatctaccatcatctgtcccttattgattaagagttgctcctagagttactgactccctgtcacttatggcctgcgccacacaggggctgtgtcatttctgctaccttactcatttccactgggtacctagtaacaccaaatgcagagtttctctagttcatttttttctagagatccaaatcctggtcttctgtcagtctgaggcaagtagtcacttgactgaatgtggtggagggaagatagtcttttataagtatgcagatttttaaccaaattgctcatatttttttggggaaatcttaccccagtatcccatggcaactgttacattcgagttccaagcctttggaggattccatggagtaaattgacttcttattcttgtcctttaccacaggcattctgattgcagttttccctgatctgcaaattactaccactctgtagcttaagaaaaattatgatatatagtatttcaaacatgtggagaagtataaagaaaaaatatgcttgcaattcatatagtgctgggataaattcaactaagccctgtagggttgtctttttttttttaataccaggaatcttttgtttaaattttaggagacttgtcaccactcagtgatatcaaggctgctggggttattatgtcctttttcttctcctttgctgtgtttaggtggctactagtttattgagaaatttttggtctatttgcataagagatcttagcatattataatgttctttctatgtaacatttgtctgcatttggttttgatgtccaggtaacactagatttatgaaaaaagtttgtgttacctctttttccgttatgtggaacagtttgtacaaaattaatattagttgttccttaaatgcttggttgaactacccagtttaggcccggttgtttgtgtgtgtgtgtgtgtgtgagacattccttcttactagtttaatatttttctttttaaaacaccttaaatgtagttttttcagttagagtctgttagtggtaagttctttttgtgtttctggaagtttctttgtttaactctcactcttggatgatagtttagctgggtatagaattctgacaagtctgttttgagttttttcttccttaaatcttttgaaaattttctaagttttttcttattttcagtttggcttgatgaccatgtggcttgatatgtggcctgaatcttacttaaatattaggtctatagatttaacaagtgaaaactaatttttataattcatttcctagtttttatttagataccagcaatattcatgataaaaagtaccatatagtctcagatatctttaattttaatggttagaattatgttaaaatattaaaccagcatgtctgaatcatgactacataataaagcctattgatttaattggtttgaggtgggagtccaagcctgtattttctttcagtgtgctcaaataattctaatgtgcagccagaggttaaagaacatgaagttacaaattgagctgtaaattcagagatattctaatacaaatctcaactgtctttttctttttgttttgtttttatttaaaaagttggcagcctaaattcaaaatgtatgtggaaagacagatcaatagtcaaagcaataaaaaagaagtacatcattggatttatagttcctgattttgagatttacttaaagacaatgtggtattagtgatagaatggatattatggacaatagacccacacatacatattcagttggtttttggcaaaggtggtagggcatttcaaaggaggaagtaataatatttacaacaaatgtgctggaaaaactgtataatacgtatgtaataaaatgtatactgactcttacctcacatcatgcaggaaaggtgaacttaaaatgtgtcatagacctaaatttaaaactaaaaaaagctgtaagacatctagaagaaaacatagaacacagaaaacacaaaccataaaagaaaaaaattcataaactggaccttgtcaaaattaaaaccttttgttctttaaaagttatcaataagaaaattaaaagataagggttaacataggaaaaatatttataatacatatatttgagaaacgacttatatattggatatataaagaactcttacaactcaatgaaaagaaaataattgactcaatttaaaataggcagaatatttcagcactgctactacattctagaagatttgaacatgtaccattttcattccttggaaaatagtttggcagtttagcatatgatactggaattctctcctaggtatttatccaagagaaatgaaaacagatatccacacaaaaatttcgtcatgcatgtttatagcagttaattcataatagctgtaaactgggaacacccaaatattcattgcagatgaatggttaaacaaattgtgctctatccctaccagtagaagggaatgaactatgaacacacacatggataagtcttaaaacattaacaaaaacatgacgctaaatggaggaagccacatacaatatattctgtataatatcatttatatgagattttagaaatcaaaaactaatttatggtgtcagaaagcagatcagtgacttggggtagtggtaggagagtttgactgcagaggcacatgaggtatcttttgttggtgatggaaatgttttgtattttaattttgttggttgtcacacagttgtacaacatttgttaaaaataatcaaactgcacattttaaatgggtgtatgcatattttattcaacaagtttgacgaaggaacttaggaacactaagttggacaatctcatgagctttttttgtgatttcaaatccatgttagtggttaagctacaatgtttattgttgaatgtgggtatttactatggaggaagtgtgtgtatggtcttagctcatttacaaataaaatattttaacctttaattgaatattgatatagcatgatgttaactttatgttacagttactttctgctgtgtattactgggaatgtctttcggtacttatatagaaataaggtaaaaaagctatacaattaaaaatgtggcaatagtcacttcaaatcttttatgtgtgcctactaaagcaaacaaaatactaaacttgttttatatgtgttcaataaactgctgaacaagaaaaggatgcaatggccatgttgttagactgttggagtaagtgtaatagcaataacctaccttcctttttaccttcctttctccccctctccttccctttgtttctccctccctccttcactcccttctctccctcttctacctatccttatttccctttgctggtgacagtgcaagttgaatttgtacactgatctagattcagattagtataataaatttttaaaaatatcaagttgaatgaagaaggaaaattaaaattatacagtacctgaaactaaaaggctaaataaatggattcatcttttaaaaaaagttacattttctgagcatctataattcagttaagaaggtgactgaaaattgcagtttactggatgatcttgggaaaattactcactgtgtttctcagttttctcatttgtaagacaacaataatatgttgaaaggattaaatgaggtaatgtatttaaagtgcgggcacatagtaactactcaataattatttgcctgtcatcatcatggtcatattcaaagtgaaatttcttccacatctgaccttggctattttaatatatgtgttactaagcaatataatgtattttaaagaaaaatacggtgatatgccactttcaaagaaacaaaaaagatgtgcattataaattttagatcataggtgaaattgtacttattatcaattcattaggtgcatacaatacacatttagataggagcattgttaattcatttttagagtttttgaccactttcatacatttcaaaatggctttgaagacataactgcagttttcatatttttcatactttagcattttggtacatgccatattagaatgtatcttagacatctgataagtgtcaagatttcccccttactctgttatctagcaaatattgagtacctggtatgtaccaggtgctggggatataacagtgaagacaatctagatgcctctgtcatggaacttagatttcattgtttggggagatactggggaggaaagattggacaagacaacacataaaataacaagataacttcagatagtaataagtgatgagaagaagaaaatgggatgatggggtagaacatgcctggaaggactaatttgggttgtgtggttatagaaagcctttgtgagatgacatttgagcgaagacctgagatgaagagtcctgaaaatctggggatggattttctagtcagtggggacaggagttcaactgcatcttagacctgatgaacttggtatatttgaattcttacaaaagatgaatattgctaaaggatggtaattaggtagaagactaataaagtagaggagggtggaaagatagccaggacctatctttcacagatagccttgggcatcatttcttactgagtctgtgaagcttgatgccgtaagcaaagagaaatatggaaaataagtggttggtattaacggtgtggcttttaggaaacaggcaaaatatcctggaagatttttattggggatttggaagtataataaaataaataatcattaactttgtatgccgtggggagaaaccaggtctgattattgacttctctttagggaaacatcagtttgtaaaatgtgttttgaaagcagcagaggaggtaatatgggcatactactctttccctcccattaattctttagacttcttctttgatattttactgagagtgtggggttttccccctgtatatatgatatttgtgatgaagaaaggcaaataatttagctagagttcaacactttgtttcctactctttggtcaaaacataaatagtatttggataccttatagtaacatacaaggagaagtgactagagagagcttgtttggttaagatcactcatttaagtagattagaaaagtatacctatggagaagcatcccttggaaggtaagactaggttattttatttagccttcttcttggttgcaatggtttggatgcttgtcctcttcaaacctcatgttgaaatttgatcttcagtgttagaggaagggcctaaagggagatatttgggtcatagggatgagtccctcacaaatagattaatgacttccattgggggtgagtgagttctccattaattcctggaggagcttgttgttaaaaagagcctggtacttccttccatctctctcttgcttctttttttgtcatgtggtctatgcacactggcttcccttcaccttaccccatgagaggaaacaacctgaggccctccctagatgcagatgtccattcttgaactttccagtcatcagaatcatgagccaaataaatcctttttctttataaactacccagcctcaggtattcctttatagcaacaaaaaatggaataagacattggctaagtcctattataaatatatataagtatttaaatgtgttttttacatatggggacagcttagagtctcaaatattagacgtacctaaatgtaatacatggcttctagactggattctataagcagtactataaagaatgttattggatcagctgacaaaattgtactagtacagtaaatctgatgcaggtatttagtgatgttgatttttctggagtcgataactatagtgtggttatgtaagagaatattcctcatcttaggaaatttacattgaagaatttaggactaaaaagcatgatgtaagcaacttactctaaaaaagttcaggggtgaattatatatatatatagagagagagaatgtaggtgtatgttaataataaaacaaataggacaaaattttaacaatagatggatctggataaaggacatataggagttctatgcactaatcttatttttgcacctcttctgtaagtttaaaattatgtctaaataaaatactaaaaatgggttaaagttattttttgtttaaaaataatttcaaaatgtagctatatctcattgtcagaaatactatcaattctatgttgagtttatcaagcaaaattccaatgttagtacaatgatcaagtgttaaatattgggttacaaactaatattttttgaatctagaggtagaaaagattagtgtggattggatgttagaactgtgaaaaaaaagtgcagagtggtgaggtagttaagagaaactggaaagaatgagctggttgagaattcagaattggagaaggtaaatttagtagttacccatgtaaatgctaccattgtagagcaatgttttgtagtcttttgcagtcttcctgaggatacttaccatgttttattgaattttaacgtgcacattttttttcacattaaaaaaatctctgaaatcagggtgtaccttataatcagtggcatctgataatcacatcggtgtggattaaagtcagtttttccatataagatttgtggttttgcctgtaacctgggggcactaccagtaacctggaggcactaccacttttcttctgccagtaacctggggacagtaccaacctgaaactattttaaattatcttttgtgtttgagtacttggaccaccctagtgtgaattcggattacagatttgtgtgtgttctggctggtggttcaaatttggagaggagatagcacctctctcccccgcaccactagtgccaagattgagaagacaaattcctgtgctgttgctttccttgtaataggtttatttcccctttactcttatacgttttttgtcacagtcttcttatgagggttcctgttagactattggatattttttgttgttttcagttatatatgaaaataatggtgataaaaatactttttttcctgcttaactttggtgtccttgctttttggatatatgttcttaattgtattattcctattcatggtttcacagatatctttaatctcaccctatccaaaggaattctaaaggtaaaataacaccctacattgatagcttggtccattaagtcatttgtcttggggaaaagttgtagcataaagtcatagtcagtttttggttaggaggaccttatagaagagatgaatgagcatacatacaccctggagttagtccaagttttggattctctgaagcttacctctgtaacttaatctttctgaactttagtttcctcatctagagaatggtttgtgatattactgctctgttaatgttattgtgctccttcaatgagatagtgtatataaaggtctagtgtgggctctggcagagatgtggtgctgaatagatgatttatttttttgattgattgtgattgccattatttttggtttcctaggacatcctcttccacccagtccctcttcttatggaaatatatcttgtccaaccatcccctcccaccaaccacgagagaggtgggcacattattcatcctggccaatttagattaatcctctaaatataatggtaggttcacgtctgagtgggcatgtgaccaaagtccatcagagtcttttcccatcaggattgatatacagggaatgggggaagaaaacctctctaccggaattacaaaggttggatttagatccaaagccactggcaactaccatctaattccatatggagaagtctgcttaaataatgaagctaaggagaagctatcaaggataagagatggaggttgagggttggggagggcgaaaaagagagggaggagagagacagagactgagggagatccagttccatttttttaggctatccttcctatagctcttctttcagagatatgccagtctcctttccagctttgtgaactagtaaatgctttttttaaaaaaatgtggtttaagttggatttctgtcacttgcagtgaagagttctgatgaatatgata

SEQ ID NO: 87 - DNA, 7566 bp, Homo sapiens
  source 1..7566: mol_type = genomic DNA
ttagaaacacaaggatccattttcaagtaatttcaaaagaactatgttgctttccccaccccttcccaagtacacttattataatatatccagtccatttgctagctttgtgtctttagaaaagttgcttaacctctctctgtaaaatggtgcttatattagtactaacattcagggttattgtgaggattaaatgaggtaattcatgtaatgactagttctatttctagcacaatttaaaccctcaacaaatatgaactattatcactgtcatagtttttgttgttgttttctaattatataatcttcaagattctgagatgggggctgttgctctttccttgacttgaacatcttggtcttttcctaggaggaaacttgactcttgaaatggtcaaatccattgtcctagttcatcctgacccctccctggctccaatccccaccccttaccgtcctccacccttcctacattcctgcacagttggtcttatttatcagtcaactaagggtgttgttaaatcttttatttttctgctgcccgatttggttctaagcactccactccctacgctgctcataacaagaatgcctgggaacgctcagtcagccatatccctcccctgtcggaacacccagttcttaatgctcctggagaggcaacatttctgaggccccactgccataagcccccctcccccatgaagccagtggtctggtagtaatgaacccccaacggcccggagaacactggggcaaggtgtttgtctggggaaatgttgcatgttgccttgactgtgctttcttctacaaagcttaaaaagagatattatattattttatttttatttttatttttgagatggagtcttacttggttgcccaggctgggtgtgcagtggcacagtcatggctcactgcaacctccacctcctgggttcaagtgattctcctgcctcagcctcccaagtagctgggactacaggcacatgccaccatgcctggctaatttgtatatttttagtagagacggggtttcaccatattaactacattggtcttgaactcctgacctcaagtgatatgcccgcctcggactcccaaagtgctgggattaaaagcatgagccactgcgcccggccaaaaagagatattcaaaagctccctctgactgtgtgtgctgaaggctgagtgctgatgccattgcttaattaatgttgttcatgatctccatttgggcgatttgtttagctccttgtggccctttttggacttagcttatcatgtgacattgacaaattaatgagaagtgagcatgtgatgatgcttggattaggacagaaatcacatctaggacatctcaggccctttccacctgggacctgaggcctcaaatctcttggcaggagatgagtgggtctacacagcccgattttgaggtaggtgtggctagcctcatttatgcgatgggaaaactgtggtccgggaaccaggggttttcaaattatgctttttgcccagggctggatgtaggatgtctgggggagaggcttgactgagatctgggtacactgagcctccactttaggaggtaacctagagactacacctactccctaaactgtattgacttttggaagtcaaccatttagaagagtgtggttttggtttcgatcgtatcccagcagtcttttctctgcccttgttaatctgattcatgatctgaacctgggctggctggaggctggccatgtcactttgcagaccatggacacccctgagtgccctcacagaaccagccaatggaaaagtacaacgtcttctggcttctcagccttgccatctccctctggcctatttgatacccccttttatattgagggagtgaaaatgtagcatccaaactgaaaacgcaggtttttctttggtttttataggaaaaacaaattggcatgaacactcagtcaaaccagctcaggctgtttgggcagatgcctttctttgcttttttctgtttattttcctacaaatcaatgcttaactgcgttgttatcggagcagagcaacaggtgcaaaaaaataactctgctgccaactcaaatgaaaaggtagggcttataccctctgggaggtattcagaagataacagaagcccctgccagcaactgaattaacagctctgtttacggtgggttttatgttaacaacctgctcctgaccctcctacacataaacacaccattgtctcagagagagacattcagccatccagacaacccactgctttattctgccctgagtggagattggttttggctcaggctgctttgtgaaactcagaagcattatcctctctgccaactccacgtcctagtcagagttttctgtgaaggcaagggcatggggttgccggagagaagaggattggtcctgcttttaagcctagctgaaattcttttcaaggttggtcattctcaaatgccagagagggttgcccggctctctctgctcttgccccattccattcacaacaggaggtggggaatgagctcagatgactttggaaggagccactattattttggaagccgtgtccttgtgaatagtccatcagggtagggcagcgtctatgttttgttaactattgtatcgccagcacctagcaaagtgcccagcatctagtagacacttggtaaatatgtatgaattacagagggtctgagacaatattgtaatggccggataagcatttcttggtaatagtttctttctgctgaaagctgagagactaattgtcttctgtatgagggcttaagtccagggtaattaagtaatcttttgaaggactgagatggaggtgggatggggttagggtggcttggccagccttgagatgctcctgatgcaagtaaccatcagagagatcctctgcaagcgctatattctggggccagatttgtctgttcggacttcagaactcatacttttgagtatccaattattgttgaatttgaccatttggtattaatagaactaagcaattccctcaagttggcaaataatataatagtaggttatctgcagatggattagaggttgaattctctacattgaatcttttgtctctaactttataaggacttgcttgcatttatggacatttctttcaaggctggtatctcctggagttgatcatcttgtggtgggaaagggaagggaggcaagtgggtaagtctatatagaccagaaaatctcaatggcgagagtgttcaagacttcgttaagggaggttctcagaaatgcagattttagtttagagatctggggtttcagtagccaaacattgttgactctaacaacatgggggtactgagcattaggacctattttatttcaagttggcaaataatacagtgataggttgtccacagaggcccacagaaaacaagcaaaaccaggaggatgtaaatgtttggaagaagaggagagtcaaagtttcttttgaggcctcaaaagcctctgtgatgttttacaatctgaagcttgccctattcttaatcatatctgatgggtttgataaaggccctgggggtcatcttaggcaagcttgtcttttgatcaacttgagtgcctgccactgtcagtatgtgctgcctagcctgggtctgacaccaagactgataaagatcagcatactatgtatatttccaaatggcttacagtcaataaagtgtacctataatggatccagacttggcctcccagtgctgcattattggtcatgaaaacccttgaaaccccagcaataatacctcagatgttgcccctgggaacgtgaaaaatgtctgtttcaaaacacattataaggctatgaaattatctgtgatgtaatcccaagagaatcaaatacattccccaagcttgattcacaattcaattcatttgtaaaaacacaaatgattgtatgtattatattcagttgcctttcacatgtacatggatttttttttctcttatttgggagtagtcctttgaaacgacagtcatattgaaacaggaagtcagtaagctgttgcaacatccttagggcaaatgctgtgaattcacctgctggtaactttgattaaggactgagaatggtgtgggtatcgctgtcatcacaaaagtaattatttaaaaggactaattgctcctttggcttcagaggtaaaaatgcccacatggcagccagttctgtggcagtttggggataatgtggttggatgaataagggagctaggaagaaggctgatggtggccttgactctcaatcccctggggctggggacagggaatgcaggtgcaagccctggttaagatctgctccgtggccctggtggttcccagtgtaccttcacccttgcagcaggagcaaaccatgctgtctggcctgaggtctgattcaggtaaagcataaacaattatggaccagtcgatttcccaaatacaaaattaaaataactttattgagtcatagggggataatttacattatatatgcacgtatgtatttatgcatgcatatgaatatatatacatatatttgtatataagcttgataaaggtgtaaggcagcagacggcacagggagaatgctgtgaccatgtctagaatgggagtcaaagtgagaatgagtcttctctggcaaagcaccctcttctcagcagagagtggcccagttcccaggttttattgcaagacaatctgagtttgaattctcttccagttccaattctttctaaactgtgtgaccttgaacaagtcacctaactcctctgtgcctcagagaggccatctgttaaatgacataatgcctcctagagttgttgtgagcattgattgagataatctgtttaaaccagcagtgcagagctggtacattttaagtgttcagtaagtcctaattactataatatagttattattattatttttaaagtgtttaatcctgagtctcagtagccccatcactgagcaaaagaaagacctccctccagctgagcaggcccaagctggcctgcgttggtctcttctggaaggttcgctctgtatatttaagaagggaggccagtggagcagtccttgggcttgttaggaatcccgaggctgagcagagcctcctgggtcttgggatgtgtggttccagttccctgccagtggcccagggttttttcttgcttttctgtccctattagccctagccccaatccgaaaccttattcttttttttttttttttttgagatggagtttcactctttttgcccaggctggagtacaatggtgcgatctcagctcactgcaacctctacctcccgggttcaagtgattctcctgcctcagcctcccaagtagcaaaccttattctttgcagtatttgagcattctctgtgctaagggactcagaggaaagagaaacctttagccgttctctatcaggagcttgcgttttagacatgctgctcttcctggtcttttttttttttttttttgcacctccaaaccagctatggtatgtgggagtgcaaagcctttgacaacacagagcttaggagcatatgccttaccactgttcttggcagccttggcaatgtgtctagtgagaggaagagggacaggagggatggctttcgtcctttgggtaagaactgtgcccagccagaggggaacatcatggcttctgcaagcagagtccaagccccgctgtttatagttcagccataatggtacgtctacacagcagctctcggaatagggagtggggaggcatgagatctagtcctaggctccactgtgccagtcagccagaactggagaagactgtacagataagagagctttgaagctttgctcgaaatgaacttggctctcaatttcctccttgagagttcaataaaataaaaactacaagtatgattatgattattataaaaaccagcaaacatttatcaaatacttactatgtgtcatgcttttccaagcattttacaggtatcatttcattgttgtctttcgacaacacttttcatgtcatctctactttatagatgaggaaactgaggtcctgagaagttaaataacttgtccaaacttgccccattaggaaattggcaaagccaggatttgatctgtggccatgtaactccagagcctggggctcccaaccatgatcctgcttctgaggagtctactcctaccacaaggatgtccccagtgccagccaacacagtttaaacagagactcatgggcagaccctctaataagcatagacattgactagacacttgctacatatgagacgttatgctggggactttacaaataatctcatttagtcctcatattagctccaccttccaaagtggaattttgttatgtggggagactgaggtggtagagaggatagaaattctccaaggtcaacatagcccaccaagccacagtaccaagatttcaaccctggccgtttgaatcatgagcccttattcttttaagagcttccctcaagacatgtggcaccacggccgggcccggtggctcacgcctgtaatcccagcactttgggaggccaaggcaggcagatcacctgaggtcaggagttcgagaccagcctcaacatggagaaacccagtctctactaaaaatacaaaattagccgggcgtggtggtgcatgcctataatcccagctacttgggaggctgaggcaggagaattgcttgaacctgggaggtggaggttgtggtgagccgagattgcgccattgcactccattctgggcaacaagagcgaaacttcatctcaaaaaaaaaaaaaaaaaaaaagacatgcggcactactaggctgcttttcaagctcctcacactcttgaatgtgtcctctcaactcagcttttagtgggattcagtctctgtggctaggctttaccttctgctatgcccatatttgccaccgaccagcagccaaaataggagactcttaaactttagggttagaccaagtgctctgttccccctgctccccttcatgggtccaggctgtgcatggtggtcagggtggtgcttttctggaagcaagcccttggcgaagcaagcctggagaagcaggcgcatggggctgggatgtgtctctgtgtggctggcacagaagcagtccaagtgcttggcaactcagggcactgcgggagtttgtgtgtacctgaaactgcccttaaaagaagtgagatgcggaggctggcctatctcccgccatgtctcaggctggtcatttagcacagaacagtgctttcttgctgcaaaaagaatttcagattggccaagccccagtggcccataattttaggggagcttatggcacattgtaggggacttgctgcctaaggctaaataggtcttggcaagaagcctggcatgttgtacttgccagttcttcagtctattgggtagcacacagggctccttctcttcaaataaagagtacgattctgccccacaactgtgagtcttacaaacttctgcccaaagaggtga

SEQ ID NO: 88 - DNA, 16376 bp, Homo sapiens
  source 1..16376: mol_type = genomic DNA
atacatagaaaagaaaaaaaaaccggggagagtttttaagtaggaaagtgataagacattgggggataagatggagacaagggcattaattagattgccatagtagtttaggcaagaggattcaatgctaacaagtataatggcagtggaagtggaaaagaggggatttaggttaggggtctccaactcacgtacagaaatcagctaagtaatgtaggtaagtgaaatgaactgagttgggactctggtgaactgggcagccctttcacagctccagctgattgttgccttgcgacaatattgtctctgtgtgatcagatagtcagttttcaaaagaatccagaagtccagaattgtgtatttactcacgttgaaatgttgaatttaaaattttttggccgggcgtggtggctcatgcctgtaatcctagcaccttgggaggccaaagtgggcggatcacctgaggtcaggagttagagtgaaggggtgggttgcccctccacacctgtggatgtttctcctaaggtggaacgagagacttaggaaagaaaaagacagagacaaagtatagagaaagaaataaggggacccggggaaccagcgttcagcatatggaggatcccgccagcctctgagttcccttagtatttattgatcattcgtgggtgtttctcgaagagggggttgtgtcagggccacaagacaatagtggggagagggtcagcagacaaacacgtgaacaaaggtctttgcatcatagacaaggtaaaggattaagtgctgtgcttttagatatgcatacacataaacatctcaatgctttacaaagcagtattgctgcccgcagatcccacctccagccctaaggcggtttttccctatctcagtagatggaacgtacaatcgggttttataccgagacattccattgcccagggacgggcaggagacagatgccttcctcttgtctcaactgcaagaggcatgccttcctcttatactaatcctcctcagcacagacgctttacgggtgtcgggctgggggacagtcaggtctttcccttcccacgaggccatatttcagactatcacatggggagaaaccttggacaatacctggctttcctaggcagaggtccctgcggccttccgcagtttttgtgtccctgggtacttgagattagggagtggtgatgactcttaaggagcatgctgccttcaagcatctgtttaacaaagcacatctcgcaccgcccttaatccattgaaccctgagtttgacacagcacatgtttcagagagcacggggttgggggtaaggtcacagaatctcaaggcagaagaatttttcttagtacataacaaaatggagtctcccatgtctatttctttctacacagacacagtaacaatctgatctctcttgcttttccccacattagagaccagcatggccaacatggtgaaaacccttctctactaaaaattcaaaaataagccgggcgtggtgtgggtgcggtggcaggcgattgtaatcctagctacttaggaggctgaggcaggagaagtggttgaacccgggaggtggaagttgcagtgagccaagatcaccccactgcactccagcctgggggacaagagtgagtctcaaaaacaaacaaaaaaccaaaatatgcccgtgggccaaaggtggcctttgattgtgagtttgcaacctcttgtgagtgacatagaatctactagaaaagagggcattttaaaaaaagtaggctgggtggagcggctcacgcctgtaatcctgaagggggccagcccctccacacctgtgggtatttctcgtcaggtgggacgagagactgagaaaagaaataagacacagagacaaagtatagaggaagaaaagtggacccggggactggcgctcagcatacggaggacccgcaccagcactggtctctgagttccctcagtatttattgatcactatctctaccatctcagccagagggatgtggcaggactatagggtaatggtggggagagggtcagcaggaaaacatgtgagcaaaggactctgtgtcataaataagtttaaggaaaggtgctgtgccttgatgtgcacgtaggccacatttatgattgactttacacaaacatctcagcgcagtaaagagcagtattggccgggcgcggtggctcacgcctgtaatcccagcactttgggaggctgaggtgggtggatcacgaggtcaggagttcgagaccatcctggttaacatggtgaaaccccgtctctactaaaaatacaaaaaaaaaattagccgggtgtgatggcgtgcgcctgtagtcccagctacttgggaggctgaggcaggagaatggtgtgaaacctgggcgacaaggcgagactctgtctcaaaaaaaaaaaaaaagcagtattgccgccagcatgtctaacctccagccataaggcggttttctcctatctcagtaaatagaatgtacaatcgggttttatacagagatattccattcccagggactagcaggagacagatgccttcctcttatctcaactgcaaagaggccttcctctttcactaatccttctcagcacagaccctttatgggtgtctgggggacggtcaggtctttccattcccatgaggccatatctcaggctgtctcagtggagagaaaccttggacgatacccaggctttcttgggcagaggtccctgcggccttccgcagtgcactgtgtccctgggtactcgagactggagaatggcgatgacttttaccaagcatactgcctgcaaacacatttttaacaaagcacatcctgcacagccctaaatccattaaaccttgagtcaatacagtgcatgtttctgcgagcacagggttggggctagggttacagattaacggtgtttcaaggcagaataatttttcttagtacagatcaaaatggagtttcttatgtcttcctttttccacatagacacagtaacagtgtgatctctctttctttcccccacataatcccagcactttgggaggccaaggcaagcagactacttgagcccaggagtttgagaccagcctgggcaacatatggagcccgtctctacaaaaataaaaattagctgcgtgtggtggtgcatgtgtatagtcccagttctgggggaggctgaggtggggaggattgcttgagcccaggagttcaaggctgcagtgagctttaattgtgcaacaaatagaggccctgtctcaaaaaaaaaagagggtttcactcttggtcactgtaacctcaaactcctgcacacaagcaatcctctgggctgagctgggactacaggcatgggccaccgtgcccagctaatctattttgctttttgaatagacagaggtcttgctgtgttgcccaggctggtctcaaactcctgggctcaagtgattctccagccttggcctcccaaagcaatccctaggtaacagactcagtctggcttcctggctctggcttcttcccttctagttcattctccacactgtagtcagagtgatctttacgaataaaaactctggtcggtcgggcacagtggctcatgcctgtaattccagcacgttgggaggcctaggcgtgtggatcacttgaggttgggagttcgagaccagcctgaccaacatggagaaaccccatctctactaaaaatacaaaatcagccaggcgtggtggcatatgcctgtaattcgagctactcaggaggctgaggcaggagagtcgcttgagaaaggcggaggatgcggtgagctgagatcgtgccactgcactccagcctggccaacaagagcaaaacctctctcaaaaaaaaaaaaaaaaaaaaaaagtctggtcaggtcccacttcagctcacaatcagttcagtgcctctccattgtctttaagctatagcccaaattgatcaatacagccattaagaagtgctgctaggccaggcgcggtggcttacctgtaatcccagcactttgggaggccaaggcaggcggattacctgaggtcaggagttcaagaccagcctgggcaacatggtgaaatcccgtctctactaaaaatacaaaaattagctggacatgttggagtgtgcctgtaatcccagctactcgggaggctgaggcataagaattgcttgaacctgggaggtggaggcaacgatgagctcatcgcaacgatgagctgagatcacgccattgcactccagcctgggcgacagagtgagactctgtctcaaaaaaaaaaaaaaaaaaaaaaaagccctgcttctaacagggccaatggctcacacctgtaatcccagcactttgggaggcgaaggtgagagggtcccttgaggccagaggtttgagaccagcctgggcaacatagtaagatgaaacccccatctctacaggaaaaaagcccttcctccctatcgccacccctcccccaagcctaaactaccccttctcacccacagtcaactccctggggtttgattttatctaggtaaatcatcctgctatctctattgtctagcagaatacaattcacaaataggactcaatatacatttattagttacctctataagtttttttcagtttgcctctttatgttgggaatgctgtaaatttttaaatgatcttttctcagccaattcattgactgtcctaccttaccaaatgattttgctcttagagaggtctggagagtgtttgttcaaggagcaaccctgcccccacctggcagcaagaggcactgcctcaattaatagaggagaaggatatgcaaatgaccagtgcttgtcagggaactggcagagacgtgacagtggagaaaaggctcaaattctttttgagatggggtctcattctgtcacccaggctggagtgcagtggcgtgatctcagttcactgcaacctctgcctcccaggttcaagcgattctcttgcctcagcctcctgagtagctgggattacaggcgctgcaaccactcccagctgatttttatgtttttagtagagacggggtttcaccatgttggccaggctagtctcgaacccctgaccttaagtgatcagcctggcttagcctcctaaagtgctgggattacaggcgtgagccaccactctgggcctcaatttcttttctttttgaaccaggatctcactctgtcacctaggctggaatgcagtgtgtgatcacggctcactgcagtgttgaactcctgggctcagaggatcctcccacctcagcctcctgagtaactgggactgtaggcatgtgccatcacacccagctaattctttaattttttggagtgtgacagtgcctcactatggtgcctaggcgggtctccaactcctgggctcaagcgaccaaattgctgggaaacaggcatgagccactatacctggcccaacataaatagaatttcctgggttgtggaggagtgtgacattgaggtggtcttccagggaagaggtgcttttacaactgcagtgggtaacatgggtatctgggctacctgctcatgcaatgtactaatgttttctggttctgctttcagcttcatcatgaatataccatttccatctttatatctgactaaagggtctgtctgactttatgacttgataggtctgacaagacccaattcataatggggcagttctggatgcttcatagtcaagctttccagtaacagccctgatgctgtttctcaaaaggcacctacttccctgctttggacagcttggccttgctccagaatctcagggacttgcattgtgcttttgccataggagcttgccataagttctacactgaatctttttttcgctactgatactttgaacccccaggatctgctggattgcatggcttaagtgtgcattgcatcctagacttgatgcagagccctttcctgctcagagtttgagtcaaagttggcagcttagccggtatgtgggctggagatatatttctaagtctggatgtgacagacaccacacccgtgcattctttttgtctttaatggtggcactaatctctgtccctccccaggatgtgatactgcttttgatttactatcatagctgaagagagggaggggttttagagatctctttgtctgtcccactatgataggtcttacctcttaggccaaggacccaatgcgattacttcaactcctaagtatatcaatcctgttaaatacttggttttttttttttttgagatggaatgtgctggcttgcagtggtgccatctgggctcactgcaacttccaccttccgagttcaagcaattcttggtcctcagcctcccaagcagctgaggctataggcgcgcaccagcacgcctggctaattattttttttatttttatttttatttttgagacggagtctcgctctgtcgcccaggctggagtgcagtggcgcgatctcggctcactgcaagctccacctcccgggttcacgccattctcctgcctcagccttgcgagtagctgggattacaggcgcccaccaccaagtctggctaattttttgtatttttagtagagacggggtttcactgtgttagccaggatggtgtcgacctcctgacctcgtgatccgcccgcctcggcctcccaaagtgctgggattacaggtgtgagccaccacgcccggccgctaatttttttttttgttttgagacagagtcccactctgtcgcctaggctggagtgcagtggtgcaatctcggctcactgcaacctccacctcctgggttcaagcaattctcctgcctcagcctcccatgcccagtccccgtttaaacacttggaactgaggaaatatctagtgatgggtccatggacaagcagacttactatgagctagtaagttttggctaggacttcagttactgcctgacacctgtaagtccccactgtaatgtgggaatcatgatgaagctttgggtttccaggtctcaatgtcagctcagatcttgtgcccaaaatcctcaaagtgtttaggcatttccctttacccagtgtaccgttatctgagtaagtgatatgttgacattctcccttttaggaggaactggcagaaccgttacagttttagcatcctttcgtagggatttgtgtacctcttcagtaattgagttttggatgtgaaagttgtttcagccaggtgcggtggctcatgcctgtaatcccagcactttgggaggctaaggcagtcagatcacttgaggtcaggagtttgagaccagcctggccaatgtggcgaaaccccatctctactaaaaatacaaaaattagctgggcatggtggcgtgtgcccgtaatcccagctactagggaggctgaggcaggagagtcccttgaaccctggaggtggaggatgttgcagtgagcctagattgcaccactgcactccagcctgggcaacagagcaagactctgtctcccccacaaaaaaaaaaaaaaaaaaaaaagttggcttagatccaggagctgaatcaaggattttgcctgtttattgtggtgattgcccttagctgcctcttcctcctctattcttgcctttttctgtttgtagatgcttagtagcatcctttttggctatccgcatatttttcccctaaggatgccatgctctattgtatccacaactctgtgaatcaaacgcctcatggctacccctgcaacattgacagttttatggtagttgcatatttctggcttttggcagctaagcaatgctacccagcctctgttacgtgttgggagatacttccccgtatatcttgagtagctcagctctgactgcttctcctgtcatcagctgtggactgctcagaagccaccactgaatttctaagtgatgctgatgtccaccgatgtcaccagtatattcttgatggtcttgtaaatgtgtccttcgggtcctttcttggaacaccattctctggtctcacatagtacagtatagtacgtatatctattccagcatgcccacttttttcagccactttttttttttttttggatggagttttgctcttgtcgcccaggctggagtgcaatggtacgatcttggctcattgcaacctctgcctcctgggttcaagagattcttctgcctcggcctcccaagtagctgggattacaggtgcctgccgccatccccagctaatttttgtatttttagtagagacggggtttcaccatgttggccatgctggtcttgaactcctgacctcaggtgatccatcctgatgggaatgttaattgtggtagtttctttgcttttttttggcaggtgggggggtggtctcactctattgcccaggctggagtgcagtggcacgatcttggctcactgtaaactctatctcctgggtccaagctactctcgtgcctcagcctcccaagtagctgggattacaggtgtgtgccaccaaacctggctaatttttgtatttttaatagagatgggccttcaccatgttggccaggttgattgcaagctcctgacctcaggtgatccgccctccgcagcctcccaaagtgctgagattacaaggtgagccaccgcatctggccctgcttttttggtctgtgagccagaatagtatctgttcttatcctctaacatctcatcagttctgtacttgaggatactttatcagatagatttttggaacagggagattgaataaaaacttaaacttgctcatcctttttacaagtcaatatagtattgcattacctccatgaatgctgtggttctaccttttggggcagatgtcagttaaaattcagactgtcacattccaccgtatcttttggtttctggaaaaaactttaaggtgaatctgctatttcttttttcttctttttctttttctttctgtttttttgagatggagtttcttgttgtgcaggctggagtgcgatggactgatctcggctcgccgcaacctccgcctcccaggttcaagtgattctcctgcctcagcctcctgagtagctgggattacaggcatgcgctaccacgcccagctaattttttgtatttttagtagagatggggtttctccatgttggtcaggctgatcttgaactcctgacctcaggtgttgcgcccacctcggcctcccaaagtgctgggattacaggtgtgagccaccgtgcctggcctatttccctttattctttctcttttcttttcttttttttttttttttttttttgatacagagtctcgctctgtctccaggctggagtgcagtggcccgaccttggctcactgcactctccgcctcccgggttcaagctattctcctgcttcagcctcccgagtagctgggattacaggcgtgcaccatcacacccagctaatttttgtgtttttagtagagacgtggtttcaccatgttggccaggatggtctcgatcccctgaccttttgatctgcctatctctgcctcccaaactgctgggattacaggcgtgagccaccgtgcccggctgcttccctctttctttaaatttaatttaatttttaaaattaagatgtttatctcactatgttgcccaggctggtctcaaactcttggccacaaacaatcctcccacctcagcctttcaaagtgctgggattataggcatgagccaccatgcctgaccccttttttctttaacattatgtttttgacacatttttgcctatcttttatgtcctggttctttcaaatttagtcatttctagtattctagttagaaattttctacaaattattttacaaatgttctacaaattatttttcaaaaaaaattttttttttttgagacagtctcactcttgtcgcccaggctggagtgcaatagcatgatcttggctcactgcaacctcttccacccaggttcaagtgattctcctgcctcagcctcctgagtagctgcgattacagcctcctgccaccatgcccagctaatttttgtatttttagtagagacggggtttcacagtgtggtccaggctggtctcaaactcctgacttcaggtgatctgcctgccttggcctcccaaagtgctaggattacaggtgtgagccaccacgcctggcctatttttcaaatttccaaatttttactactataaccagtgctgcagtgaaatcttttatatattgttttgtgtacatgtgtgagagtttctctagggtatgaatctagctaggactgttggtgggtaaaagggtattttcattcttttttttttttttttttgagatggagtctcactctcttgcccaggctggagtgcagtggcacgatctccactcactgcaacctctgcctcctgggttcacgccattctcctgcctcagcctcctgagtagctgggactacaggcgcccgccaccacgcctggctaattttttgtatttttagtggagacggggtttcaccatgttagccaggatggtgttgatctcctcacctcgtgatctgcccgcctcggcctcccaaagtgctgggattacaggcgtgagccaccgtgcccggccaagggtattttcattctataggcggttgcaaattgctctcctagaacggatgtaccaactaatgttgccacttatgcaatttgtatcctcctaatcacttggtttagtcagatgttttcatattgccaatctgacggacatgaaattctattttcttgccattttaatttgcactttccagattactaatgaggttttgtaatctttaccattcttttgtatatctaattttgtgaattggcttttttgtttttgagacggtctcattctgtcgcccaggctggagtgcagtggtgtgatttcagttcactgcaacttctgcctcccgtgttcaagtgattctcccacctcagcctcccgaatagctgggacgacaggcttgcaccaccacgccccgctaatttttgtatttttagtagagacagggtttcaccatgttggccaggctggtcttgaactcctgacctcaagtgatccacccaccttggcctcccaaagtgctgggattacaggtgtgagacaccacgcctggcctgaattggctatttctattatgtgattagaatagaatttctatttggtgggtgccgtggcttacatctgtaatccctgcactttgggaggccgagatgggcggatcacaaggtcaggagatcgagaccatcctggctaatacggtgaaaccctgtctctactaaaaatacaaaaaattagccaggcgtggtggcgggcgcctgtagtcccagctactctggaggctgaggcaggagaatggcatgaacccaggaggcggaggttgcagtgaggcgagattgcaccactgcactccagcctgggtgatagagcgagactccatctcaaaaaaaaaaaaaaaaaaaaaaagaatagaatttctatttggtgattttttttcttgatgattattggtttttttcgtactggtttttagtgataatttatatgtttcatctactttgttagctatattagtttcagatagtatgtcttctatttgtggcttgtcttttcagtttgttatggcaaattgtgatgcataattttttctcttttaatgttgcacaatttatttgtctttttcttcatgatttattcttttgtgtattttttttttttttgagttggagtcttgctctgtcgcccaggttggagtgcagtggcgcgatctcggctcattgcaacctctgcctcccgggttcaagctattctcctgcctcagcctcttgagtagctgagattacaggtgcctgccaccacgcccagctaatttttgtatttttagtagagacggggtttccccatgttggctaggctgctctctggccaggcttgtctcgaactcctgaccttgtgatctgcccgccctggtctcccaaagtgctgggattacagacgtgagccaccgcacctggcctcttttgtttcttctttaaaactcttttcttatcctgaggtcagaaagatattcttatttttttctgaaattttatttatttacttatttatttatttttttttgagacagagtctcactttgttgccagcctggagtgcagtggcgtgatctcggctcactgcaacctctgcctcccaggttcaagctattctcctgcctcagcctcccaggtagatgggactacaggtgtgcgtcaccacgcccagctaatttttgtatttttagtagagatggggttttttttaccatgttggccaggatggtcttgatctcgtgaccttgtgatccgcccgccttggcttcccaaagtactgggattacaggtgtgagccaccgcgcctggcctatttgattacttagaatataattttgtgattggtgtgaagtagtgatctaattttatttttttatagtaccatttggtaaatagttcattctttccccactgattatattatctctgtcgtatattgtttcaagtatgcatgagttatttttaggctcgttttctgttccgttggacacttgcccatccctgtgtctttagcatactatgattgttactttatacattattattattattatttttttttttttttgtagagttggggtctcactgtgttgcccagactggtctcgaactcttggcctcaggtgatcctcttccctcagcttcccagaatgccgagatgataggtaataataataataataattattattattattattattattattattattattatttgagatggagtcttgctctgttgcccaggctggagtgcactggcgcgatctccacttactgcaagctccgcctcctgggttcaaggttcaggtgtttctcctgcctcagcttcctgagtagctgggactacaggcgcccgccaccacgcctggctaatttttgtatttttagtagagacgagtttcagcatattggccaggctggtcttaaactcctgaccttgtgatccgcctgccttggcctcccaaagtgctgggattacaggcgtgagccattgcgcccggcctgattacaggtaattattcctttagcaaataacatgcctgctgcctggtagggcttatcttttttttttttttttggtgtgaagtcttgctctgttgcccaggctgcagtgcagtggcgtgatcttggctcactgcaacctctgcctcccaggttcaagcaattctcctgcctcagcctcccaaatagctgggatttcaggcacccgccaccatgcctgactaattttttgtatttttagtagagacggagttttgcctcattggccagcctggtctcgaactcctgatctcaggttatccgcccgtctcggcctcccaaagtgctgggattacaggcgtgagccactgtgcccaaccatactttatataatattattattattattatttgtagagacggggtctgactgtgttacccaggctggtcttcaactcttggcctcaagtgatcctcctgccttagcttccaagaatgctgaggttacaggtaattattattttagcaaataacatgcttgctatctggtagaatttgtctttaaaaatacgattttttttctttaaagatatctttactattctctgcccttttctcttgcacatgaattatagagtcatcttacaaagttctcaccaccagatattaagatttgtattagaattgcatttggatttttagattgtttggggagcactaatttctttatgacatcaaatctttattttattattattattattattttttgagatggaatcttgctctgtcgcccaggctggagtgcggtggcgtgatcacagctcactgcaacctccgcctcctgggttcacgccattctcctgcctcagcctcccaagtggctgggactacaggcacacaccgccacgcctggctaaattttttttgtatttttagtagagacggggtttcaccatgttagccaggatggtctcgatctcctgaccttgtgatccgtctgcctggcctcccaaagtgctgggattacaggcgtaagccactgcacctggccctctgcttttttaaaaaaagaattcattagctgagtgcagtggctcacgcctctaatgctagcactttgggaggcagatcacttgaacccgggagttcgagaccagcttggacaacatgacaaaaccctgtctctaccaaaaaatacaaaaattagccaggcatggttgcatgctcctgtaataccagctgttcaggaggctgaggtgggaggattgcttaagctgaggaagtcaaggctgtagtaagccaagatcacattactgcactccagcctgggcaacagagagagaccctgtctcaaaaaaacccaagaaacagaaaacagaatttgtctttagtttctctatagtccagcctccttttaagagacttggtgttgaaattaaccaattttttctttctttgagacggagtttcactcttcttggccaggctagagtgcaatggctcgatctcggctcactgcaacctctgcctccccggttcaagtgattctcctgccttattctcctgagtagctaggattacaggcatgtgccaccacacctggctaattttgtatttttagtagagatggggtttctccatgttggtcaggctggtgtttaactcctgccctcaggtgatccgcccgccttggcctcccaaagtgttgggattacaggcgtgagccactgtgcctggcctaaccaattttttagttgcagaatgagtgatatttcaaattcaattttctgttacagcataccatactctaaatatctacttctcaatattttatattctctttcaccttattgattataaaatatatatatatttttcagacagggtctcgctctgtggccttggctggagtgcagtggtgtgatctcagcttactgcaccctcaacttcccaggctcaagtgatacctcccacctcagcctcccgagtagctgggactacaggcatgtgcaaccacactcagctaatttaaaaaattttttgtggccgggcctggtggctcacgtctgtaatcctagcattttgggaggccaagtcgggcagatcatgaggtcaggagttcgagaacagcctggccaacattagtgaaaccccgtctctactaaaaatacaaaaattagccgggcatggtggtgggcccctgtagtcccaggtactctgggaggctgaggcaggagaatcacttgaacctgggaggcagaggttgcagtgagccgagatcgcaccactgcacaccagccagggtgacagtgcgaaactctgtctcaaaaaaaaaaaaaaattttgtacagacaaggtctcactatattgcccaatctggtcttgaactcctgggatcaagtaatcctcctaccttggccttgcaaagtgctgggagtactaggtgtgagccaccacacccggccagctaattaaaatcaaacttttttttatagagacacggggtcttgctacgtggccctgtctggtctcaaacttctgggctctaatgattctcccattttggcctcccaaattacaggcgtgagccatggcacctggccaggctcatcagttatttgtttttttgtttatttctaatttttattttaattattttagaccagttctagctctgttgcccaggctagagtgcagtggtgcaatcataactcactgtagcttcaacctcctgggctcaagtggtccctcccacctcagcttcccaagtagctgggaccccaggtacttgcaccatgcccagctaatttttttttttttttttttttttttttttttttttttggagaaagagtctcaaataatttatgtagatcttccctctgcccagagatacagagtttaactctgtacatcttgagtgcaggctgcgcttagtgattctcttcctcagagtgtgatgacaaagttttggagggccaggggagggagaaaatgaggatgcagtattgtgtgatcatgactgcagaaatagctgctgttggagggcctcagtgatcattttaaggtctcttattgctacttatcttttttgatgagattaagtattctgtctctgatcagttgaatatctgatgtcattaatccaaggataatatgttaaaagtactaccccatattttccacatactgacctgctatttctctggtgtttatcttttagtatttggtttcatttgagagaatggcttg

SEQ ID NO: 89 - DNA, 12612 bp, Homo sapiens
  source 1..12612: mol_type = genomic DNA
aaatgtctttaaaacattaaaaaactttgtagtatcacaaataaaacagagggcaattctatactcatatacttttgattaaaacaatgcatttaaagcattctcagttaaaacagcaagaataatctcattaaaccttttaaccactccagcaggtaccactgttattctaatttacaaaggagaaaactgacaattagaaacttttccaaagagaccaaagtagctgatggctaggccaggtctagcaaacatataacttgacacataataatagctcaataaatggaagtcataattatttttcaactactagatcaatctcaggattaagagagaaggaaatcattctagagccattttctatttgaaaaaaaaagtagaagaaaatagaaatatgctcaaaatagaagagtagttgagtaaagaaaaatcttctgaatgggaattagagagtaaaacatatataattttccaacgctaaaagaaaaaaagacactattatatgatcaatccatagccagaaaggcagaaaaagcaggaacagaaacagatgcatgcaacagccttttactaaacccaaaggagactttggatatctattatctataatctattatagataggtagataatagatatctatatattatgtatctctaacctgttatctccctccctctgtccctccccaaggaagactttgtctctaaagcatttagaatcatataaaaaattaaccttaaatctaagacaaaggggatatggattaaattaagcatgtttaataatagttaagtttggaaaagttattttattcccaggtgcttttaattctgaaaatttgtctctaattgtatatttataaatacagtggttaataattttagtttcttctcatgctcagctatttttacattttttaaataatagttttgttatattcttaattatccgttccagaaatatggctatctggatcacaaagccatttacaaggtactgccatccatctggtaatggtaggaggaaataaacgttttgagttctgacttttcaacgtccaccttttatataagaacagaaatgccaagcatacaaaaaagtgtactgaatggtgaaagattagagtacacagcagaggctaaagtctatgttccagggacacagtcaacacttgataaatgtttgttggcacagggagggagggagggagggagggaggaaggggtaggaaaaagaaaggagattcaaaggagataaccacacacagaaattccgagatggaaaggggaagttaagaagtttaattagaatgtgtattttgtgtaagtaaggcaatatgtgccaagagaggtgtggtcaaacacttaccttaacccattagggaacaacttcttgtagtcaacatttattatactgatattgtttttagcaagggtttcaatggatactaaacggcccacatgctgaaaaccaggagccacggacctgacgtattgcctatcatgagctggcaaccaaaaaatctctaaggagaaacaagaagtccctcagtagataatcagctatccaggtacgaacagccccatagagaatggagggagctccattccagcacaggtagtattctacagagagtagagagagagagtctagtccttggtgaaagagtcaacatgggctagtattttctttgttttgttttgtttttgagatggagtctcgctctgtcgcccaggctggagtgcagtggcacaatcttggctcactgtaagctccgccacccgggttcataccattctcctgcctcagcctcccaagtagctgggactacaggcgcccgctaccacacccggctaattttttgtatttttattgtattttgtatttttagtagagatggtgttccaccgtattagccaggatggtctcgatctcctgacctcatgatccgcccgcctcggcctcccaagtgctgggattacaggcgtgagccaccgcgcccagccctgggctagtatcttctaatgaactcttataatggggctttcactagggctactctggagctgagttttctcatgacctctccatttaccagttaacatcaagtgtcaagggcctactgtgtacacaaagactcatacaagcaaagtagattagttgatagatatgggtgaatagtgagaatcaaaaacatctttctggttaatgatgttaaaaatcatctttgaggctgggtgtggtggctcatgcctgtattcttagcactttggaaggccgaggcaagaggatcccttgagcccaagagtttgagacaggcctgggcaacatagggaggccctgcttctattttatttaaaaaaaatcatctttgagaggagtcatttcctgccaacagagatgctattatgactcatctatgaaatacttccatttgtaaaaagacttataattgtttcactcacagcactcccatattctgagaatttatgggatttggaacaactgactgcccaaatgcagagttgcttctgaaaaacattacgagcaaatctctgctcaaataagaaccagctctcctttctatatcattcatcatgccaagtcttcaaagccttaatgttacccaggctctttctaatggatctatgttggtgtggtgcaggtcacattagatagttattacacatattcctctttaacagggtgctgacatttcatttggtttggaatagcaaacagcctcaatgattttccccactgagataaatttaactgggtcattcctagattaccacatgtagctgtataagtaacaatcttcatttccataggaagtaaaattacttaaggatcccagggtagatgtacaaggtaggtcaagttcaactactgtgctcctaggacatgctacccacctcccaacctatgtcataaatactgagatagacttaccagatgttgctcgattttagaggcaaggatcacgcttactacttggcggacaaatgtgtgtctgagaggatgttttggtggagggcgatgaagatcaaatatcacaaattttctttccttctctgcaagtgtcaataaatcagctagtgttggaattgactgatttcttgctctttctttatctgcctctgatagaggtttcatattgtaaaatggcctgagctagaaacaaatacatcaaaaaatacataaaagcactttccagttctcctactatgtagccacacatccagctctacctcagttgctccattatcattcaatccatcaggccctctgaagtactaatcctagaaaacaggtgacaaggagagaaataaaatgtaatcatcatcaataattacagtgtttggaatggtctcttctatatcctacaacctgttgtatttgcactgaaggtcatgttcttatcctgaccttcctttccagccttctctcccataagtcaagataatacatcccttttcagtcacgctggcttcctacatgggctcccgctattctagttttgtgtaataggaagaacacatgctttggcttcaactgaatttaataccagctctacccctcccttgacttccttgccatatccacttgttaaaatcctacccttcaaatgctatttccctcatgaagctttcctttaatcttcctgaactaaagagacttcaaggctggtgctgtgatcatgcctttaatcccagcaggctgaggcaaaagtatcacttgaggccaggagttcgaggccagcctgggcaacatagtgagacccttgtctctacaaaaaaattttaaaatagctgggtgtggagatacatgcctgtagtcctaactactaaggaggctaaggcagaaggattacttgagcccaggagtttgaggctgcaagtgagctatgattgtgccattgcactacagcctgggcaatagagtgaggccctgggcaatagagtgaggccctatctctaaaaaaatcaataaataaagagacttcaatggctttgaagcccaatggcccatttttatgcctctgtatgtctcattcatatatagctaatgtatgtaaaaatagctaagcatgagaagaaactaaaattattaacgactatatttataaatatacaattagagacaaattttcagaattagaatttggacatgtcttagtacattaaagttcaatcctggctcactatgcttcttgctatgcaaccttggtaataaaaccatttaaattctccaagtcatcattgcccaaattataaaatagaggagaggaagaataacctatatatttcttaggattattttgaagattaaatatgataaaaatatttacagggtctgggagtatgtctggtacatagatagaaaagtatacaattcacattagttccttcactctctgctgactctactggagtgtaactccctcttggtgggaactgtcatacattctttgaaacgcacagcatttcacctaacacatgggagaacacacatatgtttgctacattaaatttaatagatggcaactttgataatcacttgccattttttagatcatttgagtgaaggcagtgataaaaggctacctcccaggagaaggaagtagcagaaggaagaagtcacattttcttaagactcaagtaatctctctttttctctacacaactttatcttcattctctttcatacctctcctatttcttcttcttcttcctttgacctaaataagctgcctttttaaacatttttctcaggaaagaaacaatcacattgcacagtatctccggaaaattgctaggccagaaggcagatcattgctaggccagaaggcagatctaaaccatggtttagatctgattgaaagctacaactaatggttttcttaattctcaggacaatagaaatatgcttcagaattcaagattttgttagctactaccagacctaaaccaactggttcacttaactattaaaccttcttgtgagaaaaattgttaaaagaatttatgggaaagaccaacacaagaccaaaaattcaaaatagcaaagatggtaaatatttaatcaatataagagtttaaaactagactccagtaaactttaaatagtattatgggggtaggcctaacagctgaagtacattgtgcctctttagacttaatcagaaaaataaactggaatggataaatgcctgtttagactatattcaacatgtgattgaatgttttcaaaaagccacaggaagtaacaagctagaaatgaaaataaatttctggtcctccagatgaaacatctggttcctcaaataaaaataagattaaaaggtcctctgttctctgtgcctctgtgtagacatattacaaaaagaaaggttattggaagaaccaatgtataatattggttaagaaatagaaagacaagtccgggcatggtggctcacgcctgtaatcccagcactttggaaggccgagacgggcgaatcacctgaggtcaggagttcgagaccagcctgaccaacatggagaaaccctgtctctactaaaaatacaaaatttagccggctgtggtggcacatgcctgtaatcccagctacttgggaggctgaggcaggagaatcgcttgaaccgggaggcagaggttgcggtgagccaagatcgcaccattgtactccagcctggacaacaagagtgaaactccgtctcaaaaaaaaaaaaaaaaaaaagaaaagaaagaaagaaatagaaggacaattaaacctgtccaatgatgccacatcaaggaaacattccactgaatagacgattctgataagaactaactgtaactacatgtgaacaacaatacaattttcttttctttttttttttttttgagacggagtcctgttctgtcgcccaggctggagtgcagtggtgcaatctcagctcacttcaacctccgcctcccaggttcaagtgattctcctgtctcagcctcccaagtagctgggattacaggcatgcacgatgacgcccagctcattgttgtatttttactagagacagggtttcaccacgttggccaggctgatctcgaactcctgaccttgtgatccacctgtctcggcctcccaagtgctgggattgcaggcgtgagccaccatgcccggccaacaatacaattttcttgttgatatgggcaccaccacatctaccattaattgcattactataaaaaaatcagatcaccagagtactacaaccacttaagtagtgggagtatctaacaatcctgtctttttccatgtcccaatataaaactattactttgagaccattgtcagaagaacatctctttcttctctatggcactttccctgtacatttatttatttatttttaatttttatttttcttgagttttgttcttgttgcccaggctggagtacaatggcacagtctcagctcactacaacctccacctcccaggttcaagcaattctcctgcctcagcctcccgagtagctgggattacaggcacccaccaacatgcccggctaattttttttttttttttttttagtagagacggtgtcaccatgttagctaggctggtctcgaactcatgacctctcccctataaatttaaatattagaggctgggcaaggtggttcacagctgtaatcccagcactttgggaggccaaggctggcagatcacaaggtcaagagatcgagaccatcctggccaacatggtgaaaccctgtctctactaaaaatacaaaaaattagctgggcgtggtggtgtgtgcctgtagtcccagctactcgagaggctgaggcaggagaatcgcttgaagccgggaagcagaggttgcagtgagccgagatcacgccactgcactccagcctggcaacagaccgagactccatctcaaaaaaaaaaaaaaaaaaaattagcaagctactttgcaaaaagaaccacaagaagaaatgtactacagacaaattgtttttcgaagcctcagaaggttctatcgcacattatcaaattacagctcatatgaacgttactatattgattcaaaaaataaccaaatagacttctggtttctggttccacatgtaaggagcttggaagctgtcactccatcctaacaacaagtaaaaagttgaacagaatgaaaaatcaacaactcttattggatctgtaatagaggtgaggacacagggcaaactgctgcccagaaaattggagacacaggtgaaaggagatgaatcatagcttaccagaatgagcctaacaaatggaaaccactaaggaaaccagtgctcgggtaggaaaacttgaaccatcactgacaaattcctggaggattagtgtggacaagtctgagagttaaaaactcaaggggacaccttgagatacgtgattatgttgcttatttgaaatctttctacgttttttgatgtaggcatttattgctataaacttcactcttaacactgcttttgctatatcccataaggtttggtatgttgtgtttctattttcattcatttcaaaaattttttaaatttccttaagttcctcattaacccactgatcattcagaagcacgttgtttaatttccatatatttgtacagtttttaaaaagtataacatcttatttgtaaaaagcttaaatttgacataaaattttataaacacagtattatctgatttttacattttctcttttatttgagccaataaaatttatttttttaacttttattttagattcagtgagtacatgtgccggtttgttacctgggtatattgcatgatgctgagatttgaagtatgaatgaactcatcactcaggtactaagctcagtacctaatagttagtttttcaaccctggcccccttcctccttcagtagtcccaattttctattgttgccatctttatgttcatgtatatctaatatttagctcccacttataagtgagaacatgcagtatttggttttctgagcctgtattaattcacttaggataatggcctccagctgcatccatgttgctgcaaaagacaggatttcactcttttttataagtgcatagtattttgtggtgtatatacttgtacagttttgaaagttcctctcattgatatctagtgttattccattgtggtcagaaaagatacttaatatgatttcaattattttaaatttgttgagatttgttttgtggccttacacatggtctgtcctggagaatgttccatgtgctgatgaagagaatgtgtattccatagctattttatgaagtattctgtaattgtctgttaggtccatttggtccaagtacagtttcaatccaatgttgatcttttgtctagatgatctgttcaatgcccatagtaggatgttaaagtcaccaacatttactgtgttggaatctttctccccctttaaatctaataatatttgctttatatgtctgggtgctttagtgttgagtgcatgtatatttataattgttacatcttcttggtgaattgatcactttattatttcataatgaccttctttgtctttctatggttttggaactaaactctgttttatctgatgtaaatatagctattcctgcttgcttttggtttctgtttgcatggaatatctatcccttcactttctgtctgtatgtgtctttacaggcaaagtgagttttttgtaggcagcatatagttgagtcatttcctttattcattcaggcagtctgtatcattcaagtgactaattggtttacattcaaggttattataataggggatgacttactgtagtcattttgttaattgtattatgtttgttttgtatattctttgtttcttcttgtttttcatttcagtctgatggtcttctgtagtataaaaggtttgatttttttttctctctctcctttgcctatctgctctattgatgagttttatgcttttccatgttttcataatggtgattatcacctttttgcttccagatgcagggatcccttgaatatttcttatagggctagtctagcggttttgcattccccagtttttgcttgtctgggaaagacttcctccctcatttctgaagaatagatttactgagtcaaatattcttggctggcaatatttcttctttcagtactttgaatacctcattctactctctcctggtctggatagtttcagctgtcagtctaatgagaattcctttatatgtgacttgatgcttttctcttgctctttttagaattatttgtctttgacttttgacaatttgataaaatatgccttggtgaggaccttttgggattgaatctatttgggaacctttgagcttcttagatctatatgtccacccctctccccagatttgggaagttttaaactattgtttcattaaatagtgtttctatggctttccaactctttccctcaggaacatctacaatatgaaaatttgtttgcttaatagtgtcctttattgtaggctttctttattctttttcattctcatttctttttttctcctctgggtaattttcaaatgatacatcaagctcagagattcttctgctgaaacaagtctcttgttgaagctctgtactatattgttttattttggtacttgaattattcagctgcaagggtgtccatttgggtttttttgtttgtttgttttttttttgttttttttttttttttgagacagagtcttgctttgtagcccaggctggagtgcagtagtgtgatcttgactcactgcaacctccccctcccgggttcaagcattctcctgtctcagccttccaagtagctgggactacaggcacatgccaccacacctggctaatttctgtgttttttagtagagacagggtttcagtatattggtcaggctggtctccaactcctgacctcaggtgatccagccgcctcggcctcccaaagtgctaggattacaggcatgagccaccacatccggctggttcttttttactgtatctatgtttttgttgaatttatcattgacataatgaattgttttcctaattttgttgaattgtctatttttttgtatctcatggagtttccttaaggtaattattttgaattccttttccagtaattcatttatttccttttcgttcaggtcttttactagagttattatgttcctttggtggtgtcatatttccttgctttttcatttcttgtgcccctgtgctaatgtctatgcatctggtggaataatcacctcttctaaactttctagagtggcttttctagagaaagattttcacctgcagttgggtcttagtgcactagttgagaagggtgtggtgactttgttcctgggtaggtgcagtggtatagtctctgtgcagcttctttggctgcattcagcgtcagcaaaaactgtgggcatctcagtggcttaggggtgtggaaatttgttgtcgcaacagcagaggtgtatgttgttaatgtccttggtccacaaatgcttttggtgttctccaattcttgttttccctacaatgaggagacttcactgaggggatccctcttggtgtcaggtctgacacggcctacaatcaactgccatggtgctggattccaggtgcaaatgtttacattggcagagtcctaggatcagagtctcacaaacctatttgccctctctgtgaacctttcactctctgtggcagagttggacataggttgcccacaccatcagactccaaccccttagcagcttgagtccaggaagttaggctgtagctgtgactccactcttgctaggcagggaacagccctggactgactctaaggaagaaggtatgttctggaggtttgagcctagggcacagggtatggctataatttgggagcttgagccaacagggctcagtggcagcttgggtgccttgggatgaggcaccatgtagtggcaacactagactctaagatggtaggattcagcagtatctcagactctgtgaggccaagtgcagcagccaagtaccccagtatggctgttgtttgggtcctggggggcaagaagcagcaccatgtgactccattccttagggatggcactatctcagcagcttagactctagggagctagtccagctccagggaagcagggtactacaattgtttggcctgtagggtcgggtatctctcctcagacactggtttgtttccctgggatgaagggtactatgttagctcagccatggaacgtgcagttgctcagctcagccaaaacattgattctccaagggttgatgtgccactctactcaggccttgggggcctgactgttctgagcagcccaggcaccatttccctgccacacagggctctgacaaagtactttttccttgagagggcagtgcacagtttcaactcaggaccccagtggcagggcatagccaagtctgaaagaggtagatggagctgttctgccaaagcaccgtatccccaggaaagggcacacagctccatctctagcccaagggtacagggggaggggtaggtgaaacagttctatctgctgcttggctccacagagaaaggtgtaacagttgcttggcctggggatgttaggccactctgttggggtggttccccagtagtttagcataagggatgaaggggtgctgtggctactcacctctggagcaagatgtgagtagttccaagatggcattgcgcagtagccatgtaggccacggggcaggcacagctggctccttctctgaggggaacacagttgtatggcctctaggtagctaccccagctgggcttagggcctgtgaggactgcaggggaccccaataggggtccaagctgttgctgggggctgctgggatcctcttgcctaccttttcaccatagagagaagttcctcctggttcctggctgatctcagctgggggatgaggtggcagggtcctgttgtttccttccattctctatgtgggtctcctgagtttctgtgctcaccagggtttctgttactcctctgatgtactctggtgctgtcctttattttcattaaaatatgtttttttatttattgttttggctgtctttgtggaagggatgagtgctagtattttctagttgaatatcttgctgtcatttctcctttgagtgggttctgtcatcctgcctgttccttcattaatgtgataaataaaacttgtactcatgccaactatgtatctgcatgaaaattatatttttatcatttctataattatactttcacaaaaggatataacaaagttccacggaagtgttggttgggctaaagaaacaggaattcagtttagcttccagtatcaactcccagaatgtctgtatctattcttattttgttataagattaactacttgattttcacaataatctcaagattaataaatacattaataaataatgaccaattcaccaccatgatcaatcaataatcatacccaaccaataaagaatcatcagaataatctttactaatttcttcactatggaaaaaacta

SEQ ID NO: 90 - DNA, 805573 bp, Homo sapiens
  source 1..805573: mol_type = genomic DNA
gtttcctgataagcactttcaacaaaaaataacggcttattttcttcatctgattcagcaaatgctgtctcaaaccaataaaccaacattatagagatgggttaaggattaaataataaataacacatttataaataaatactggaagaactatagatgaatatgtatataaaaccatatatcctttctggagaagggttttctaatatggcaactaagaaaaatatggaaatatttgtctattatacaattgtatactattaaagtaaaaatatatgtgtggctaaaaaggccatgaataatgataagagacaaatggtcaccctggatcaatataaatcatggccagggaaacagagtcacataatataatatcgtactatggcgaccagattgcctgtatgaaaggggtaagggcccagaaaagaaagaatctgaagaccagcacctgtcccaagaataatctactgcaaactccacagtaattgtaaagagtgaacatttatttcagattctggcaatatcttgagtatcattcttaattttaatattgatgcaagtttttatgtttcctctttattagggtatatatttcaagaaattgaaaaaagacacttttggcatctggctataactcattttttaaaaaacagaaaggcatcctttttttttatttatttaattgagatagggtcccattctgtcacccaggctggagtgcaatcacagcttactgcagccttgatctcctgagctcaagctattctcctgcctcagcctccagagtagctgggactacagggacacacagccatgccaggctaattttttttttttttttttttttttttttagagatgaggttttgctgtgtttcgcaagctggtctcaaactcctgggctcaggtgaccctcctgctttggcttcccaaagtgctgggattacaggcatgagccactgtgcctggcctattatttgtttttaccaaagttatatacataagcacatataatcaaaaacatcattactactattattttgaacaaatgattatctgctagatcaagtaaggctaagaaaaatcaaagattttattttgctttaatttactcattctctggtacatttcctttctttgtgtagatccaggtttctgaccttgattattctccttgtcactaaagaacttcttttaatttttctggctgggcacggtggctcacgcctgtaatcccagcactttgggaggccaaggtgggaggatcacctgaggtcaggagttcaagaccaacctgaccaacatggagaaacctcatctctactaaaaatacaaaattagccgggcgtggtggcgcatgcctgtaatcccagctactcgggaggctgaggcaggagattgcttgaacctggaggcggagtttgcagtgagccgagatcacgccactgcactccagcctgggcaataagagtgaaactctgtctcaaaaaaaaaaaaaaaacaacaactttctttgaaggcaggcctaccagcaacagtttccctcatttttttgtttgtatgagaaagcctttatttctccctcatttttgaaggataattttacagggcatagaattttaagtcggtaggattttttcctctcaccgtgtttagtatttgattccactctcttcttatttacatggtttccatggagaagtcagctgtaattctaaactttgctcctctataggtaaggtgtttctttcctctgttttctttcaggattttttctttatctttctgaagcttgaaaatgatatgcctaggtgtcttttttttttttcttttggcatttttccagctttatgttctctgagcttcctgggtctgcagtttggtgtctgacaagtgtttgggaaaattctcagtcattattgcttcaaatatttcttctgttattttctctcttatcctgatatgttacacattttgtagttatcccacagttcttagatattctattctgggtttttttgaagcttttttctttttgcttttcagtcttggaagtttctgttgacatatcttcaagttccaagattctttcttcagccatgtccagtctcctgatgagcccactgaaggcatttttcatttcagttacagtgtttttgagctctggcattttttaaattctttcttagaatttccatctctgtgcctatatgatccatctgttattttaatcaaaattatacatgcacagaggtacctggtgacaccaattcttttgccataatctctttttcacattgtgtaacttggtcctgaattagagatttctctctctttcacaagcataatgtcagattctatagttttcaagaaacttcagaatgtctttgtgagaacagtgagagagtttgttctcattctagccaagaaaaaaaaagatactaaatatcaacactaaaactgaaaacacagcaccaagcaatttagagaatttgattaattttgtacattaaactatgctgctctattagttcttccttaccactcttttcatgaattatattgcaatcctatattctattattggccatctggatgaaattataaattataataaaaagaatccttgatgaagggtcatgcacatttttatttctgtatctactttaaatgtgttaatactatagagttgcagaaatttgaagtaattttaaattgctcttatggacaaaaccctaagcctccactactttgcaatgatggaaaaggccacagagcactttgaaaaatcatacttttatccccattatctcagccaaatgtgaactgtggcaaacatcatgtacctgcaagcttctctccacctataaggcccctgtcttcttcacatgctaccctttctacctgggtgtgagcatcaatggtctggagtcataacttctgggagcaggtctgcttttgatcaactataccactcacaagattttatgtgcttggttctcttcaactatgcaaatagtagatcaactaacaactgttccagccataaagatgaaatcctcttcattcttacattctcttataattgacaaagtattgaaatacttagtgatgctctactgctactacaatagctagatagaccttttgttccatcattagttgattcccctccattctgggcctgttttcattaagttttccttatataatatgaggaaactgtgaagcatgatttctcaatctcattatcagcactcttgacatctggggctgtaaaattctttgttatgtagggctgccctgtgcatcatagcatctctgatctctgcccactagatgccagtaccactcccccaacttctagtgtgacaaccaaaaatgtctccagacattgccaaatgtccccagggagtgaggggtaaaattaccctcaaaccccaaataaaaaccactgttgtaaagaaaacttaaatgttataatgtatataaaggggactcacaaactatgcagtttaggaattattatatttttaatgttttttgtcaatgtgttgtagaagaatatgagatgaaatataggcaaagagtgaaaggtggtccttagagtgtattccagtttactgtctgtatggaagttgccttatgagaaaaggcagacaatctctaaggatgccttaaaagaggtttctgtagctagtcatgtaacagttaagttggccatggtacccacatcatgattaccttacagcttattccttgggcaggggactagcccctttgctgcttgctataagaggtgctgagcctttaaccctaggttccccgcatgtggcacaacccactgtgtgagtagctgcccattaccaccccatgggactttgggacaggagaaccagaattaccatgctgatgttcccactgtgtgctgtgctgtcttgcttgagtctctttgtctattttcacacctccaaagtggcagcaagccaacctggttactggcttagtcatctccttggccttcttgttactcttcaccattctctatgagggaggagtttcccctgatactgggttaagttacttcacttccctttgtctttgtttccacattttaaaatggggataataatgatagtacttaaatcttagtgttgttgtgaggatcattcaagctaatgtaatagcctgataggtaattatgtccaaactaatgccatgttgcttagttctattttctcctatatgtccctgtgttagtctgttcccacattactgtaaagaaatacctgagacagggcaacttataaagaaaagaggtttaattggctcatgggtttgcagactgtacaggaagcatagcagcttctggttctggggaggcctcaggaagcttccaatcatagtggaaggcaaaagggagtaggagtctcacatggcaggagcaggagcaagagagagtaagatgggaggttttacacttaaatgatctgatctcatgagaactcactcactcactattgtgaggacagtactaagagggatggtgctacaccattcgtgagaaatccacctccacaatcctatcacttcccaccagtcccacctccaacattggggattacaatttgatatgagatttgggtggggacaaatatccaaactatatcagttcctaccttcttagattgcctactaaactccaaatcctacctttctttcacagtgaaatttacttttctttgtcatagactacatttccatttcacagtgcacatcatctcaccatctttcttgctttctctctccctcagtctcctctactcattaacctccatcctcctttgccggacagattcctccctttgtctttggtgcagttgtttgcagaccaaatttgttgtaacacgcccctagtatttcagtttttacttcaaggtgattaaaagattttcatctagtcaagtccctcctaccaatgaaattcttgttaataaaagtttctttatcacctcacataattcattgttcaatgaatatttttgttcctatagtgggttaatattttgatattcaactatgtgatttttcttaattcctcttacttatcttttctttccccaccattcaaggagtgttagggttttagaaatacagatacaaagatgatacagagagaacaattaaatctttaacctgaagctcttgagaataattctgtaaagtccatagcagagaaaaaggtcttaaaagtcattgctttccattattagagccagagacttagagaaacatgttatttaaatccccaaagtcagactttaaatatccaaagccagtcccccagagggccaagtacataatatttatactaaaaccacggaaagaaatatgtgatgtcctaagaaccatgtcctgctcagaagaagatcaaagcttgaccagcaggcaggaaggtggggattaatgaaggatgtgctaagggttccaccgctagtgggacccagtgttatcacttcctcccccaagggcaaccctttgcagagaggcataataagctcagatgcatgcatgtgtggcattccgtagcaaaaagaactattacctgcctttccagacaacccaagcaactgtaaccctcacagaggacccctgaatccacctgggcagtagaacagtgatgatgagggctgggactgttaacatcagttctttggtatgtggtattggaaggaggtggagcaatgagtaattttttgtttgtatgctccaagactgtttggcttgaaaaaaagggtatgatctagtcatgcaatattttttaaacaataaaataaaaatgtgaaaagaaaaaaaaagtggatgtgagaagggaaaaaaaatctcgtaagcttagcagtaagtttcaaaagaaactctctaaaatttttatttaaaaattaatattggttagatgcagtggctcacacctgtaattccaacactttgggaggctgaggtaagaggattgcttgagaccaggagtttgggaccagcctgggcaacatagcaagacccttgtcactacaaaaaattaaaaattagataagcatgggagtgcacatctgtagtcccagctactcaggaggctgactaggatgacttgagcccaggaggttgaggttgcagtgagccatgattgaaccactgcactccagactgggtgacagagcgagaacctgtctctaaaaaataaataaaaatgaatctcattttgaataatcagactttcacttctctcttttcatctcttaactctgcacctctgattaaagtgatgaaattgagtaaaatgagaagaaaaagggagcttcttaaaataagccacattgtggaataaactcaagaattaagatctgatcttgctaggttttgagtcttaattttcaaggaccactttcagttgtggttgtgggagttgatccccttttctcaactaatgcccgttaacctggaaatttctctattccttcattctcttctgtccccaccccgaaaccacaccccacatctctttctattccccataccatgcacattcacatgcccagaacttcttatcttcttgtctttaccctaatttctttttctttctttctttttttttcgagaaagagtctcactctgtagcccaggctggagtatgcagtggctgatctcagctcactgcaacctccacctcctaggttcaagcgattctcccacctcagcctccagagtagctgggactacaggcgtgtgctaccacgcccggctactttttgtatttttagtagaaactgagtttcaccatgttggccaagctggtctcaaactcctgacctcaagtgatctgctcacctcgggctccaaaagtgctggcattacaggtatgagccaccgcgcccagcctttcccctaatttcttattatcccctacctctaggcttccccattcccctttctcaagatcttcttttatcctcaagaccacatgagacatcataacttcattgtgagaggcattaatctactggatggagcacatgtggggagtatctggggtctataccaatttccatagtaacctttttcagggaaatcacttcatccttaaaaaatgggataaaggaaagaaataaggctaaccaccctgggctacatccaagaacagtgcagagatatggagggttccaggctgtgtgaaagacggttcataactgctactaattgtagctaggaaagagaggaaaggagaacacgaattagagcctgagaatggagagagagctgaaggagttgatggcatgatttgtcaagctaaaggaagaaagaaaatgagtcaagaaacagaaggtcacagaagaaattcagcaattaatttgtttaatactgtgccattccacccttcttctcccagttcagtgcacaatccctgagctcaggatatgcccttgaagtttcaaagtcaggaaggataagctggggtttctgaagaggagagttttgggggcgggggcctactagatataaagaaatatgtgtgcctactttagtacattttccattacatgatttgagtgagggtaaaaagcataaaattaagcatttcatttttaaaatgtgtattcaatattccaagagttattcttatcaacttaaatccagaataatttttcatgtgatgacaagcaatgggacatggtgatgtctatgattttgtgtccgagcaagtattgtacacttgattaatcttttctggataaaacattagcaattcttgggaaaccaaagcttgaagcagagcagaatgaggcgtgacactgagtaagtggtgaacttggtgtcattgagctcctttttagggattaaaccatctcagaatgcatttgactcacttcaggaagtaatgctgcaaagcaaatgacctacttcatacttaatccccaatgctgcaactttgtgcagcattttgaagaagcccagaggacctgatcctagaccacccatgaggaagtagtaaacccccaacacccacaacactgcccccacatgcagaagtgagaacagattcaaaattgtgtggaagtgcttgctgcgagggcttttggcctctgcctgcccatgttaagcaacttgggcacacacctccagtgtcttggcaagaatctccaactcccacaagaatgggaagaaagccaaagaaggccaaagaaggccaaaactttctccaaacaagctcagtagcaaaactctgtgggagagagagaagtaaggcaattgccctaggcatattgggcagatgagtcagcacccagcaagagaggagcctgtaattctggagaagttagggctggtaccaccatggaattaggtggagaggaagagagaatgtgtactcatcaagaaaaatggatagtccagcatgcagacatggaaatgccctcttcaccgtccttcctttcctaagaaattctgggttctaggccaggtgcagtggctcacacctgcaatctcagcactctgaggccaaggcatgtgggacacttgaggtcaggagttcaagaccaggctgggcaacatggcaagaccccatctctacaaaaaaattaaaaaattagccaggcgaggtagtgcacacctgtagtcccagctgctaggaagactgaggtgggaagatgacttgagcccaggagtttgaggctgcagtgagctatgatcgtgctattgcactccagcctgggcagcagagtgataccgtctctaaaataaaataaaataaaataaaataaaataaaataaaataaattctgggttctctgtccacacctgtagttaaactcactgagaaggaaaataccaagcattgcaccaaagtctaagaaatcaccactaaagaacttacccctgtaatcaaaaaccatatagacccctaaaaactatggatataaaattttataaaagaaaagaaaaagaaaatgcccagcaggtggcagcactagacaactgaagtaaaacaaggctgcaaggcaacacgaaagttcatcttggagactttgcgctgtaactttccttggtgggattttatttagctatcagtgaatatctcataagaaggaatttgtatcccagcacctaccacagtgcctgacacatgctgggtatatgtgttgactgaatgcaggcaggctggcaggcaggaaggaaggaaggaaggaattttgacaactcacctaaactagaaaaatgtcatcatttgaaatggccatattctcttcttatcccatcattactattgtcattttaattagttttagtaatattaataaagcatcctactagattaattttctctactcacccttttgacaacctacatccttattctctactgaattaaatttttctcatcgcttttggagacttttattaaatctcagggttaaaaaaaaaaaactcaagattagaaacaccacagctagaattccagttttaaaagaaattatttgtctttgaatgttggtgtttataaggaaggcatttatgagtagactatcgttctttgattagttgtattttttttaaccaatgacttgtttgcagactgtgcttaagttttattattatttaaaaaaaatttgttttcttttattgaccatctctgaaatatgctattgtgcagtggcttgcgcttttttagaatcctacttaataataatttaaggtaataaaagttagaagaaagactaaataaactaatagatgataagaaatcactctgcccatgcactgtgctatattgggtcagagtgatgactttctatcactttcgagatagaggaagaaaatcctcaccctttgcttcaccagatacagaaaatggctacattggacacccgaataagagcttccaaatctacctattagaacgaagggtagccaaactttccctgaaagctaatgttagctgagcacgatggctcatgcctgcaatcccagcactttgggaggtcgaggcaggagaatagctggaggccaggattcatgaccagcctgggcaacacagcaaaaccccctctctaaaagaaaatgtttaaaattagccaggcatggtgatgagcgcctgtagtcttagctagctactcgggaggctgcagtgagaggctcacgtgagcataggagttcaaggttgtggtgagctatgattccatcactgcactccagcctgggcagcagccagatcctgtctcaaaaaaaaaaaaaatgctaatggtaaaatttttgctagtaagaataatggcagttgatgacactcagttggagcatgtagttgagttttttgagggcgggtatgttgttttatgtactttcatatatccctagcatctcaccttgtgtctggtatattttaaaacctcaatcaatatttactgaatgtgtggagactatcaagacatatgtcactgaacagtggtacttgaatcagagccacgttctcagcagaagaaaagaatagaatggcagatcatgggagtcacaattcagcagacttataagaatgggcccagagccaaaataattagcatcatctggaattggtgacaccctagattatctctttcatcttaggaactcctatcctcaccctgttcagctttgttacacatagccatcttgctgctgcttttacacctttattgtgtattaaatgcaactttcctgaacttgaagagcctctgagttcttcttatcaataaggggaatgttctgagttatcatgtgtctccctaattctggaggaatagtgtatctaaaaacaagcatcttacatgttgatgttccctgcatcaagcttaattcctattctattttcattctgcatgctctccccaggcaagtgcatccccacccataatttctaaaccaggaactgcagatctttacttgtgattgccattgtttcttgaatttcaaatccatacatatagctaatttcccataagaaaactctacctgggcataccatatattaatagctaccttaaatatatcatatcaaagatcaaatccacaggctctgatttaagatggcagattaagcacatttgtttatctttttcccaaaaaccatattgaaatcatagtaaaagaataaaaagcatgtcaggcacagtggcgtgcacctgtagtcctagctactcagaaggccaaggcaggaggattgcctgagcccaggagttcaagttcagcctgagcaacatagacctcacaaaaaaaaaaaaaaaaaaaaggaaaggtaaagaaaggaaaaggtatgaacactccccccacccaacccaaccaaacaaagagaatggaagggaagctaatggaggaatagaggttacagcaaagttctagaagtcaggagatggatgaagagggatgactgatgatgatcagagctgatgaggaagctgcagcctagtacccctgagggatgagactacagccaaaaagggagccgatctgtctagaattaactcagaaatttgtctcaacttggagactacagttctacagaaggcaagagtaagaaacagacaaccagcaaaagcacattagcatcttcagagaaattaagaatgacattgcatccataaaacaagagcaagataaaagacatgaatgccaaacgtcatgcttctccacaacctgtgtctgttcctgcgcctcctgtctcagtgaatgaatgcttccatcatgcacccagtttcccaagccagagagttgaaagtgatccctttattcttcccttctctttatgcctcattcaataaactaagggttgattctacctcctaaatatcctttgtattttcccctcacctctcttccccacagccactgcgtttaatagacctttcttacgtctttcctaaattctagcaataacatttatccctgctctatctctagtttgaagccttcccaaacctttctccaggatcataatccccagtttcagtcaacccagcatctggcatactgcccttcaaccagtgagtgtctaattgtcatttggattgagtaatacctgaccatctgtccagcctgcaatttttactgctccatactttcttctttaaatcccagaaatatggacttacttttagttctttctcaaaacatgtctcctttttaaaacatgtgctgttctcccagcccgaaacccgcattctcgttgttggcatagaaactccttcaaggctcagctgaaatgttacttcccctgaggaagttccctaatttcccctggactgacatgggtattcatactttatatgccctgggaatatctcatgtgccttctctacagcacttttgtgttgaattgtaagttcctgtttccccagacccgactgtagcctctttgagggcaggaaccaatcctctgagcttggtatcccttgcacatatgcggcataaaggagtggttataatcacagaattctattttttaagatagaaggaagctcaagaaattatctgtatagttcctatccttgagccaatgaaatattatcattcttatttattaattgaggcaactgaaacatgcagatgaagcaatttatttaaggttgcaaagtgaagtgcacaggcttacgtgggcaatggggacagaggcagggaggggagagagggtgatcagaactaacatcccaatttccttcttacacagtgctccttccacctcgtgaacacacctcttaccaatcaattgccatttactgaagaaatccaccttgaaaaaagaaaaggaaagataagcaacaaaaatatatacattgcccaaactgacaaggaaattactttctttaaaataatgacaggccagatgccgtggctcacgcctgtaatcctagcactttgggaggccgaggtaggcagatcagttgaggtcagtagtctgagaccagcctgaccaacatggtgaaacctcgtctctaccaaaaaatacaaaaattagccaggcgaggccgggcgcggtggctcacgcctgtaatcccagcactttgggaggccgaggcgggcggatcacgaggtctggagatcgagacaatcctgattaacatggtgaaaccccatctctactaaaaatacaaaaaattagctgggcgtggtggcgggcacctgtagtcccagctactcgggaggctgaggcaggagaatggcgtgaacctgggaggcggagcttgcagtgagccgagattgcgctgctgcactccagcctgggcgacagagcaagactccatctcaaaaaataaattaattaattaaataaaataaataaataaaaaattagccaggcatggtggtgcatacctataatcccagcctgagctcagaagttggagaccaccctgggcaacacggtgaaaccccgtctctgctaaaatacaaacacttagccaggtgtggtggtgggtacctgcagtcccagctgcgaggctgagggatgagaatcactccagcctgggtgacggtgtgagtccctgtctccaaaataattaattaaaataaaataatgaccattgttacctgatatttttaaccttagtgttgtttcaagccaggagggtaatcatcctctgagagtatagaaccatttattcatttggaactatgtcccatacataatttcctattaaaacaaactaacaagcaaatgctcccataggctgccacagtcagttcttccctgtattcattctctttctctctctctctttccttgtttttagagggagatggggtttcactatgttgcccaggcttgtctccagttcaaagcttctcgagtagctcgggctgtaggtgcatgccaccacacctggcttccttgtattggcttattgcaatttctggtgcatacaccaatggtggcaagtgagccaaatattatcagcattctggccagccaaagccattttcttccctgcctcagcacagtctcacatagcccaccattgtcttgcctattcttgacagtttgcaagatctgtgtcttctgtttcttttttatttcactcggtgccctatctataattataatagatactcaagagataacttgttgacttgataaagaaaacaagaactgcagaacactcagtgactttttacactttcttacccatttctgtcttagatattgttatttgatagctccttctcaatctacttatagcctgaatctatatcagaatttatgcagatgagttgcattgagaacacccatttttagactacctaatcctggtttttcaaccaggtagagccattcagccagccccagttttgctaggttagctcagttaataagaacagaagcaaaactgattaattggattgtgaatcctaaccctggttgaccaaaggcaatagacagatgttactttgtcctttttagaaccaccatgcaaatgatataaatttccttgattctgccctctactcttttctatttgaatattttctctctgggcagttttatccatttagcatcatcataagtaatatgctaatgactcccaaatctacagttctaaaaccaacctctcctaagagctgaagaccccaatttcttagggcctcctacacaaccccacatggatagtctgatgccaccttaaaaataagatgtctaaaataaattttagcattttactcgaatctatttctctcactgttaaagatatcactatctttccaaacataatggcctagaactccagtcataatttcaactcctctgtactgtcctccccccctacattgggatagctcaggtggctcctcaactcacaagaagttcccgtgtggccgtgaatataatgccttcctttactcataaatcatgatttttatggggtctgccgaaaacagtacctcattgccaggtccagtgactagtgcaattggtggatatttggccccagcccatcaattcctctctggaaaccttcagactggcccaggagaagatcccattcttcttgagttcctcagctagaagaacacacctcctgaaccaactatggccatgaccctcaagcttggagagagtctctaccgcagagaagaaaaaagccacattcagaaaggggatatggaggaagaatgacacctgaggccctgattcgttgtccctacctggctgtatctctgtctttcccaaagttaggttcatcatctgactttgcaaatacattttccttttttttctttataatgagccatgttgggttttcatcatttacaaagtccaaacttaaaacttttcttttttcacccatgcttccccttgccctgaccagataggaaaagatttaatcagttgccaaattctgtggcttcttcctcatagacatcctccatatgtgtcccatccactccatctagcccaggccctgggttacagtaatggcttccttaccacattcccaaactctaatcttgcattctctaaacatcctccaattgccgtcaaaaagcttctaaaaaaggtatggtggtgtgcgcctatagacccagcatctcaggaggctgatgtgggaggatcgcttgaacctgggaggatcgcttgaacccagggggcagagactgcagtaagccaagatagctccacagcactccagcctgggcaacagagcaagactctgtctccaaaaaaaaagcttctaaaagactaaatgtggctgggcacagtggctcacacctgtaatcccagcattttgggaggccaaggtggaaggaccacttgaggtcaagagtttaaaaccaacctggccaacacggtgaaatcccgtctctactaaaaatacaaaaattagtcaagcacggtggcaggtgcctgtaatcccagctacatgggacccgggaggctaaggcaggggattcgcttgaacccgggaggaggaggttgcagtgagttgaaatcgcgccactgcactctagcctgggtgacagagtgagactctgttttaaaaaaaaaaaagaaaaaaagaaaaaaaaaatactgaatgtgtcagccttctcttcagtagtcttcagtggctccctcgaacccacagaacaaaaattaaactcaaatggcctcaaacatcctatgattttggcacttgctttttttttccactttgtctctcagtatatccttcaggcaaacatgaccactcacttatcactaaatatttcctgaattttcctgtctctatgcttgcaattttctctccatctaccagaatacaaatcctacccattcttaaaatgccacttcttttttttaaacctttgtttgttgtttttgagacagagtctcattctgtcgcccaggctggagtgcagtggcacgatctcagctcactgcaaccttctcctcccaggtccagggaatcctctcacctcagcctcccgagtagctggggtcacaggcgtgcaccaccacacccagctaatttttgtatttttagtagagacagggttttgccatgttgcccaggctggtctggaactcctggcctcaagtgattaaccctcctcagcctcccaaagtgctggggttaaaggcatgagccaccatgcctggccatatgctgccttctttatgaaacataaaacctcccaaacatcagcaaactacattttctttgcttctagagcacttgatacctttactttgctttatactacagttattttaatatgtcttattttccttttaggctataaaatttcttgaggacagaaacttctatgttaaccattagtaccaaacattaataagttttcaccaaattgattagacatgtatatttggaaagagggtttgtttctcctcttatttcttcaaactttaattcagtgttggaattaatgcttccagtggaaactgtgagacatttattacgaaaatctaggtaactgcatcattttctatcctaccattctcattcatttcctctgtaagaggagtcccagttcaaaataatttctgggagaaaatcgaatgcctgattctgtcccattaagaaaaaacatcttccagcctcactccctttcttctttccttcttccttccttctttcctgtcttctttttttcttttttctttctttcttctaagagataatcagaatgcaagctatgggccagatgcggtggctcatgcctgtaatcccagcactttgggaggcctaggtgggcggatcacaaggtcaggagatcgagaccatcctggctaacgtggtgaaaccccgtctctactaaaaatacaaaaaaatcagccgggcatggtggcaggcgcctgtagtcccagctacttgggaggctgaggcaggagaatggcatgaacccgggaagcagagcttgcagtgagccgagatcgcaccacagcactccagcctgagcgacagggccagactccatctcaaaaaaaaaaaaaaaaaaaaaaaaaaaatgcaagttatggcttaggtataattgtaggtgccaaactaaagtcaacttttatttgtgactcttttgccattttgtcaagtcagcagttcatcttctctctgatctatgaagactgcacctgaactagtttgagtcatgttatttgtatgacataaaaatggggcatctgataacatctgctccctttctcttatccaaatcacgaatagcgttcctctcccttcccttagtcaccagcttttgaagatttacaatctgtgatagtaaaaagaaatggattttgaactctaagcagtccagttaaagtaaggaagccacaagagaaggaaacacagagtgaacccttaataataaggacttttctgtgtgcaggaatgagctatggaagatgggagagaagaatgaggatggatgactaagagcaatgaaagcttacaaagaaacccaagaaggcgaaatatttgcttatgaataaacaggaagggaagaaatagctttctgcctttcttgtagtagatactcaatagccatttatgtaagaatttggacagtccttaaaagataagacttgcattcttagaattgagaatcaataagaaaaactattctttgagagaaccatggttattttaaggctatgggatgacttatataaatggtttgaccagaacttatttaagctcctatccacatacaattctatataaactgagttttagagagtctttggttccaggcatttatagcctgaaactatatcaaaatttttgcagataagttgcattgaaaacagttgtttttagacaactttatcctggtttttgcaccaagtagagccattcagccagcctaatattgctaggttcacacagttactaggatctgaaacaaacctgatcaactggattccgagtcctcaacctggttggccaagggcactagacagatgttactgatacagagtcaaataatatataggcaactgatctgatatggaaccagagagttgggatatggtagtgaaaattgcatcagatttctgctcagaacaacctgagtttgaatcttggctcccttgtgtagactttgagcatatcactcaatttctctggttcagtttcctgtggctgtgaatgaaaaactccatttctctcagattcagcttcctgtgaaaaattggaatataaagttgtgaggattaaataagacaatgtataagaaggtaacttagagtctgcaaagtgttatgtaaatgtaaggtattatgaatttttggttatggacttgttaacaaagtgatgtgttaacattatgcttaagcaaagggtttccattattagatttgagagcaggagaattatgtacaatatatatagagacaggatgagccatccactaattcaatactaattcaaatgtttattggcagcatagcatactatgtgccaggagtgttttcagtgttggagatacagcagataaaacaaaaagattataatacctgtcctcagggacagcatacagataaacaatgaactagtaaaaacaaagagggctggctgggcacagtggttcatgcctgtaatcccagcactttgggacgccgaggcgggcagatcacctgaggtcgggagttcaagaccagcctgaccaacatggagaaacccagtctctactaataatacaaaaattagctggacgtggtggtgcatgcctgtaatcccagctactcaggaggctgaggcacgagaatcacttgaacccgggaggcagaggttgcagtgagctgagattgcaccattgcactccagcctgggcaacaagagcgaaattccatctcagaaaaacaaaaacacaacaaagagggctgcaaaaagtcacttaggtcaaatttgggattatatcactgtgaagttcacgtagaatgatatttttcagttgctgatgtcacaaaaaaaagtgaaacaaactatatatacacaactaatagacactaaactgatttttaaaaatctcagattatcaggagggagtcacttctaaagtcctccccacctccaatcactactcccctgcccaacccactcccacaagaattttgactggttaagaactggatcgaggctggacagaagatgggaaccccgtgctttatatctggggttaatgtccatgatatgacagaatgtgtcttggagaaaagtagcctcgggaagggaaatagagacagtcctgggtggtgggcatagaagacggtgggaaggtggcatctaagcctgaaggtgagggagccatccacatggagatctgggggaatcccatgcccaccaagaggaacaaagagcagatggccctgagctgagagcacatctagtgtgcacgggagagagcaagggggtcaaggaggccacggaggaataaagggcggggtggtggtggcaggaaaaggttaataaaaaagaagatcagaggtaactgggccagatggggtggggagagccacgaaagacactgaacgtcatgttgtaggaccttcttcttggttcagctgaaagccaggttcttgtcacaaggccatgagagattcggttcgcatacaatttgaatggcgagaaaaatggaatatattgggcaaaaaagaaaaaaaaaaggaagggggcggaaacaggaactctcagctgagcgagagtcttgttagcggctttttctgcctcacagattgaatcccaggtaccaccccggaccaggtggggccaggctcctcccacctgcaaatggcgggaacctccccaggctccaccccagtgcgcattcctcccagtgcgcagacaggtcggaggttctgcagggagcccttcccacctggctgtctctcttactctgggtgagatggggagctgtcgaaagacgttgagcagaagagtagcatgatctgaatgctctccaggataactcaggccactgtgttgagaacagactgcaaggagcaagcacagagcagaaagcccagtgaaaagccatagaaataatccagggtagaggtggggacctggaccaggatgggagtggtgttcatgggaagtggttggatttggtatgttgtttgcaggtaaaaccaacaggatttgctgacaaattggatgtgaggtgtaagagagagggaggtatatagatagattccaagcttttcagcctgaacagctggaagggtcaattggcattgactgaaacaaaggtgagcaggaattggcttgagtgggattagcttgagaagtcaaggatcatttttccacttccttctattgtggtaagtgagggagtcaggatttaatgagcaaagaaggagaaagaatttagccaattggaatgaaaatggcattccaagagtaggtgagaacatagatgcaaaatatgagggtgaatgatgggcccacctagtgagtttgctggaacggcttagagcagatggttgagttgaggagtagggaggagaaggcaggaagttgagggagcacaagatgaagacttgtatcttgttgttttaagattccatcactgaggccacaggagcaggcaggaggtaaaaaacaggtggtagacgatatcctgttggttgtagtcttgagatgtgtgagtgaagagcaaggtaagaatttcaacaaagacaacaaaggtaaaaagaaaatatcagtctatggcatatagatggggagaaatcttaagaaaaaaaggctggatttagaatatatcatcctcaggcagggcgtggagactcatgcctgtaatcccagcactttgggaggccaaggcaggtggatcacctgaggtcaggagctcgagtccagcctgaccaacatggtgaaaccccatctctactaaaaatacaaaaagtagccagacatggtggcgggtgcctgtattctcagctactcaggaggcaggagactcactagaacccaggaggcggaggttgcagtgagctgagatcatgccattgcactccagcctggggaacagggtgagaatccgtctaaaaaagaaaagaaaaagaaaaagaatatatcattctcatggcaggaagagtaaaatatatttttaggtggccttccatttgacttactctccgtccaatctattaacttctgtgagttccacctccaaatatttcttggatctgcccacttctattggtttccactgctaataatctgttctaggttactaagatctcttctctttactattgcaactgcttcctaaatgtccctccacttctgctcttgtcttcttctaatttatttcccatataggtataagaaagaatatattaaaatgtctatcaaacattttcagatatctgggatattctttttaaagttcaatgattccccatttcacttagaataaattataatgataacagcacacttgtggcacatactgtgtgtcaggcactatagtaacagcattacacagattgatgtaagtaatatttaattctatgaagcaggtgctgttatcataatttatatctatcaaatgaggaaactgaggcactgggagctgattcattcaggaggtctaccttaacttggatttcccagaaaacagaaccccactaaatacatatgtgctgctcccctcttggagattgcaatctcagaaaagaggagtgagtcaggcaaagaaggaccaccgtttacaagaaaaggccacagcatggcatgaagcacaactgattgcttggtcttgcaacaccattgctatcctggtcactccaactaggtagaggagaagaatttattcatcggcatctctcactctttggtcagaggtttaccccgtggggcattagctcccttgcacttgtgcccaaaggcagatctttgccccaacaggaatgcacctaggcaaaagatgacaagtgtgacaggacacaaggcaagggattaccaggttggtccacacaaagcccactggaacccaggtagagctgcctgtcacactgaccactggagcagagcaagtagctaaagaccctcaggactcatgaggccagagaacctgaagtagtgcacaacaagtggctgacgcatataggcagtgaagaatcaagctggggtaaaaactctggcagccgggcctcaaagcccacacatttaaaatttctctgatatgctgccttgcagaataaggcctgaaccatttaccatgccctacaatgtcctgcatgatcgggcccctaccatctgtccaactccatcttgaaccttctttttctcactcacaaagcttcaggaacttgttcgttcagttcctaaactccgctccatcctttcctgccacaggaccttaatgcatgagtcctctgtgtggatgctttttcttcctcttttgcatggcaaacactttcttatcttttagtcacagtttaagtgttgccttctcagagagaacttcctgaccactctgtaaaagaggacttccccacttgtaattcttctcttccactccatgtgtgtttctttcacaatactgatcacagcttgaagtaattttattaatttctttgataacttcttttttgtttctgtctccaagagaatggaagcctatggaggcaaggacaatgtctatcttcctcaccattatagcctcagcatggagctcagtgcctgacccaaggagatgctcaatgaatagttgtaagatgaatgaatgaagtgttcttatatgagaaatagatttttttttttttgagacggagtctcgctctgttgcccaggctggagtgcaatggtgcaatctcggctcactgcaacctccaccttcctggttcaaacaattctcctgcctcagcctcctgagtagctggaactacaggcactggccatcacgtccggccaagttttgtatttttagtagggacggggtttcaccatgttggccaggctggtcttaaactcctgacctcaggtgatccacccgcctcggtctcccaaagtgctgggattacaggggtgaaccaccgcgcaaattttaaagtggtattgtccatatcagtgtttgaggtagaaacactgtggagttgctgaatggacaaatgaatgatgctaacgggtgaaggaagataacagactggaaagaaattagatgaatggcctggctctctcaagttttcttccagctctacaagtccttgaactatggaggatatctttaaggaagtgcaaaggaaacaggaaggaagcaaaagtaggaattccttaggaagttcagaagaggaaagctggagaatctggcccattgtatgacaaacaggaagttatttaaagcagggttttgaaactgtgaacctctaaatggcttacaaaaatccaagagcactcataaaattgtatacaaaacatgtctccatatctgcatgtgcaattttctaggcaatagtttctatcgtatttgaaaaggaacttataacttttacatagttaggaaacactgattgcagaaacagatgagtctacagataatctagacttacttcctcagttttcaaatgaagacatcaaggcccaaagatgttatggaacctgctaaattgcaaacacaatcaattaggtgacaagagggcacaagactcaggtctctcaattccccttctagtgttctttgctgtgccacaataccttcctgaaattcagttataaaatactgtgtgaagaaaaaaagaaatgtttaatatcttggaaaatagaagagaaaatctaaactgataacataggtaaatgcaatagaatctcaaggctaaaggagcctcaaaaggcccactgaacagttccctgacttcaggcaaaaatcctgtaaacatcctggaatgattatttttcaagatggttaaggaatatgaaagaaagagtcaaaataattattcagcacttaacttagaaacaaaatactagattatctttattcataaacataagcatgaatatagttgtctcttggtatctgtgggggattggttccagggcacccactgataccaaaatccacacatgctcaagtcccttaaataaaataaaatggcatagtacctgcatacaacctccacacatcctcttgtttactttaaatcatctctagattctttataatgcctaatacaaagtctacacatcacttcatttgcatggattcaatgtagtacttggcatacagcaaattcaagtttgctttttgaaactttgtggaatatatttttccaaatattttcaatttcttggttggctgaatccacagaagcagaacccactcatatggagggccgactgtatatatcaaagttgctcacaagaaagaatttaaaaataaaggcataaactgacaacctatcaaaatccaatgctcaattatgatgcaaaatgaaaacagaaacatggtatgttttttaataactgccgagataacaaagtatggtgaacatttgattatctctcccaatgtgagtttaaggacaaattaagtaaattaattgcacaatctatagtccttaacttaggcaattagtcaacttttgttcagagaacatcagactgttaggatacctgagttaaatttcttgcaaccaccactaatttctgggcttggacaagtcactttctctagttctcagtttcctccatcttcacagtggaaaaaggttaatcttggacaagggttttcaaacttgttttgtcttttctgttttttttaaattcgattttttgttgttgttgttaccacccacacagtaagacatatatttcctgttatctgcatccataaacatatatgcccataactgaaataaaagtttcgcaagacagtattgatgctcagtatattcagtgcactctcatattttctattctatgagattatgtcctgttttttaaaaaatgtaggttattactcatcacattgatttaataacctatgcatgggtcacaatctacaggttaaaaaacatgaatatcacttgtagttttcatattctaccaataaactctctgcaagaaccacaagtcaatagtacaatttacctgaatttctattttctcccttcctatgccagaggtgataatgggcggtgacaaagaattacaagtagagaaagggtaaataagtgctttgagcatccatcaaaggaaattctgccagtaagtaatttaacattaaccagagagaatgacaggacatccacaactggaaacacaggacatccagagttggaaagttttcactgactttttttttttaacctgcctatgaactgttcgagttttgagagtttcccaagaaaatgtttgagagaaggtggggatggaaagaaggagagggaagggggagaaaaggaaaggaggaaaaacaggtgaatgttcaagtgttggtgggtagtgttgaccccctacactagcgcaagcctcagtccatgcaaaaaccccctctacacatgtgagacaggaccttctgggccgtgtcagcaccctgcactgccagaacacttcctataaatcaaaacctgactgttatatgtctactaaagattcttcagtgccttctcagcctctatagggtaaagtgcaaactcttcagcacggcacaccaaccattcgtgatctggtggcatttttcccttttccccaaaaccatccacaaccacaatggtacacacactgtcactagttgcatagagtccttaaagttctccaaacaccccttcccatgctgctttgattttgtttccactcttctctcaacagcttaatagaagcatattctttacttcctagcgatgtacttgtacttcctgttaagacagcacatctaaaatgacttcagttcccaaaagctctggaatcatgttttgttttttctgcttattttggggtttcattgggctctcctctattcattttcttttcttttcttttcttttttttttagacggagtctcgctctgtctcccaggctggagtgcagtggtgcgatctcggctcactgcaacctctgcctcactgcaacctctgcctcccaggttcaagaataccctccgctctgcctccctcttctagtccttcaattcgcagcacatgtatcccttttctttcattcccacctggtccatggtcttccaacgctgtgctcacccaaatcacagatgttgatgccaagtattgcaacacatcgcatctgctcatcttccccacttgaccctgagttggacacaggatggtgtccatcctgttcaaggtgagccgtgtccaacacactgtaggaatgccatggaatcccataagtatttgttagctgagtattgaaggactctcctatattctacctgtcctagctgctgtcctagctacctatgcctggaagctctgaacctcagctatgacggttggcagtcaagtgtgatcagattaagcagataatctctagtcttctgacaaaactttagcaaaaacttcacataaaaagtaaagtatgattctttacccattaaaaaaaaatgataatgattaagcggaatgggaacattggcagccaatcaagagaatgttatcttcctaaatggcccttccaaaacaacttgaaattaaaagtgaaaaaaaaaaaaactcagaaaacagaaaaccacagtgaagggtgaacagattttaagaaatttcatctttggactatatcccttttattagtggaaaacagaggtaaatgtggctaattgtaaaaatcatctgtgtgaaggaaggcaaagcacctctaaaactcaaagatacattcctaccttgattagtaaaagagtacaatttcactcaaacaataaatcactggtgtgaggagcaagtcacatgggctcatatagttcatttttttaatattagaaataaaacaagaaacggttaattaaatctaacaagggataatgataagaggacgaaagataatgaatgttatcccaaagaaaggaaaaaatgaaatattgcattttagaaaatgaacacaggctgggtgcggtggttcacacctgtaatcccaacattttgggaggctgaggcaggtggatcacctgaggtccgcagtttgagaccatcttggccaacatggtgaaaccccgtctctatcaaaaaaatacaaaaattacccaggcgtggtgtgcacacctgtaggcccagctgctcaggaggctgaggtgggagaatcacttgagaagactagagattatctacttgaacccgggaagcagaggtttcagtgagccgagatggcactactgcattccagcctgggagacaaagtgagactccatcaaaaaaaagaaatgaacagaggtgagcgcaatggaaccccaaaataaggagaaaaaacaaaacatgattccagagcctttgggaattgaagtcattttagatctgctgtcttaacaggaaatacaagtggacagctaggaagtaaagaatatgcttctattaaactgttgataaaaagcagatgacagaatataaagaactagggacatggtttaaatctccttgtctctatgacatacaggatatctcaattagataatgatttcttttcatttcctgaagaacaaaggggctgaataaagtaaatgtatttgttggttatcggaaagaataaagaagcctgcttccaaatgcatttcccagtgaatccgattccggtccttggtaaactctttgaagaaaatgtctatgagcacatgaagaaatgcaaccagtaaaataacatgaattcttgagagcaattcaagataatgatgggattacattttcttcattgccgggattttgtcctaaaaattattgatggttatatattggtggagaaactgtaagtgatttttacaagttttatgcttatgtttgtatcatcaaaagtttctacaatgaacatgtattactattggaataaaaaaaatccccttcctctcctcttctaccaaaaagaaaaattctgataggacaacatctaaaactttggtttatttgatcttttgtggcagaaatttgaaaaatgtgatcctgtcattcaaatgactaccaagatgatctctgagaaattaggctattcggaagagcatcaaatccaggctcttaaaagtggaaatcggaggacatagttccagggatagcaggggctttcataaccccttccgcctgggcagaggtgaactttgtggtagtgttgctattatttgacagtaagtaagcaagcatggttaggagatttttattttagtgacttagtcatcaccaagttcttgatcaaaaaaacagaaactaaatcagctggctcagagtttttgaaagcaagtttatttttaaggacaccagaaccatgaaaacatgattcagtccagcctgtgggagctgcagatgggaactggtgagctgttgggttggggtccacgcttcataagtcctggcagattcatggcctctttcctttgctcttttcttaatatctgccccattctcatctcagcagaccagatcccttcacttattcaaaatttctgctctcttgtgattttgccctgcacgtggcttttactaggccataaaactgcccccaggcatgatgctacatgacagataggcttctggcagctagcacaaactttcagagagccagttccacattgaaaagaaaagatgttgattgtctcagcgtgggtgaggtgtacatccctgtgtagatctgccatggcagagagactaggatacattttatcaatgaccactttggctcagcccttcaacaaaggtttactggggctaagttccagagaaggggactttgtgccaagtatccaaaatatatttattacctttgaataagcatctttggatgaatctgcactcctcctccctgtgcacagtctcattcctacagcagcctgccccttcctggctgaaacagaaagcagctaactcatactaaagtacttatgaacaaccaagtgactttagagcaaataattcatcttctcagggattgactacatttaattttctctaaaaagacagaattttgattgttatttagtactaccttctagtatagaaaatgttttctactataactttgtaaccgccaaaaccaaaggttgaagatcacctctccagggctatttgcatttttaaagcgaattctaaataataatgatagttaacattaattcagtgtttattatatgtcagacactcttctaagaacttaacacataataatttctttaattcttacaacaacccaagcaacagagtgtgttaattaggataatataaactgtggtaacaaataaatactgaaaatatataccttaaacaaaatcaaagtttacttcttgcttacatcacaggccaggatgggtgttcctccatctgggtccgtgggtggctttcctccatttggagattcaggaatcgaagttttttttgtttttcctgtgactctgccatctcctaaacctcactttcacctgatgtcagccagggaaggaaaacgaaagtgtggagaagttacccacatcttaaagagcctggcctagaagtaacacacttcaagtccactctgttagtgagaactagtctccgggcaccagctggatgcaagggagtgagaaatgtactctctgatgggcagccagttctcagaaaaattagttttttatcaatctggatttgcacattcttttcacattttaacatctcttcaataggaatgtattgttcaatcaatggcaagtttattattcaaggtaaactcagatttggttggcagcatttttcctttttggtagtacatacacagcgtgtgctttacaatcaatggaatcttaggctagatgaaatttggtttataatacggaagagggaggagaaattttgcctcttcctcatttagctgttcttttcaccaagtatctgtatatacacccttctttcctcattctaaggacactgcaagatggagaacatgctaaattcttatccagttcatgcatacagctcaaagaccagcatctctgggtgatatgaagtcttctcatctaaagctcttttcactttggtgatacacaaacatataaaaaaaattccctgcccctctaatatgtaatgataagacagggacaagataaccacaatagaagctcctattaagaaagggaagaattgtggatacatagcagtcattggtccattgtagaaatggatactgtcttttaggttatcataaatatggtttttaaaatgttttgccaaggccaggtgcggtggctcatgcctgtaatcccagcactttgggaggccgaggtgggcagatcacgaggtcaggagttcaagaccagcctggccaacatgacaaaaccctgtctctactaaaaatacaaaaattagctgggcgtggtagcaggcacctgtaatctcagctacttgggaggctgaggcaggagaattgcttgaacccgggaggcagaggttgcagtgagccgagattgtgccactgcactccagtcctgggtctccatctttccagcacccaacaccagttttttgttgttgttgttgttgttgtttgtttgtttgtttgttttggggggtggaggggttgctacctgctacccaagtgttcagagagtaatagttactttaggtatttattatagcagtacttttttcaaggtatcaatttttttattaattagggtaatgttagaggcagtagataatagaccccaaaatttatggctcaaacttaatagatgtttatttctcattattttaaccacccaaagcatatgtcccattggtggtcatctttcctccatagtgtgattcaagtatctagtcttcttccatcttgtggctcagtcttcccctagagcaacatctgcaaatgaatctagctggtggaaggagaaagataatggagaaaatataccttcttcttaaatcttgacctgaacatgccacacctcacttctgctcatattccacagattagaaggaaggaaggaaggccacatcaggtccatgaggagacaaactccttgtctgagcagtttccagtgacaagtccattctctaaaggggaagcacaaattctggcagacagctagctgtttctgatttaaaaggataaggattgaatcttgaattacagaaatttagtggtgggggaaaattttttttaatagcattaagtagttcctcatagggtacctcagatcataacatatcagtaaccaccaactctgtctcctaagtctgtgcctgtgtactattttgaaatattagattaaatatatatgacaaaaaatagaacaaaaaacaagaataggtgacaatgttttaaaagtagccagcattggtagtagtaatcatatagtagaagtagctggcattatttttagtgatttctatataccaggcactgtattgagtacgttttaagcatgattttatttaaaccttattagcatccccatgagatgaggaaatttagaggtaaaataacctgctgggttaaataacgtctaaaaatatctcatttcagggcctggttcctaaccattgtagaggaggaaaatagtttttcttctaccttcttaggttttctaactggggccctggaagttaaaccaacaaaaggtggactaacaagagaaaaacagtttcatacatacctatgcatggtacgttcacagataaatgagactcaaggaggcagccagatgattgaggcttatgtatcatcacaggctaagcaaaggaaaaaaggatttggggctttggggtgagggaggcaagtattaggaaggtgaggggaggaaataattagagttgtgttgttaagcaggtaagagtctctcaagtgctgagtgctgtctccaagagcagccctctcccttttcaaatgaaaatttcctttacaaaaggggaaatgtatactctactttcaggcagtcacagggagacaggagcttttcctgcatcggatagttttcaattggctttaactcaaaataatctatatgacaaagaggcatattttgaggtggcatattcatataccctgcatcataccccaatcatttcttcaacttaatattcagcaatccctgggatttcttgaagaaaatacttgagaagtactgaactaggagttaacgatgatagtgtaggtgaatagttggcaacactttagtcataaacagaaattcaaatgaattacctgaaactgcacattagtccttggttaagagattataaaatgactcagaccttgcttttaaaaaaatcatatatttctggccaggtgtagtggctcatgcctgtaatcccagcactttgggaggccaaggtgggcggatcacaaggtcaggagctcgagaccagcctggccaacatagtgaaaccccgtctctactaaaaaaatacaaaaattcaccaggcatggtggcgcatgcctgcagtcccacctactcaggaggctgaggcaggagaatcacttgaacccaggaggcggaggttgcagtgagtcgagatcgtgccactgcactccagcctgggtgacagagtgagaccccatctcaaaaaaaaaaaaaaaaaatcatatatttctatataatcatgaaaattaagaaatcgaagattcttgtagagaacttatagtttgagagatgtctcccaattctataaatgtgtgaatccctaattttatcagtaatacttcctgctacctcagagaaatgctaacttgttgggagagtttttctctccttaatattattgatccttgactttcaaaccttatgctctttctaattttttttttttttttttttttttaacaggatctcactctgtcacccaggctggagggcagtgatgtaaacatagctcaaactcctggacttaagtggtcctcctgcctcagcatcccgagtagctgggactacaggtatacaccactacacctggctaatttttaaatttttgtagagacagggtcttgctttgttgcccaggctggtctcaaactcctgggctcaagcaatcctcccactttggcctcccaaagtgctgggattacaggcatgagccactgcacctggcctctctttctaatcttcagggtcatttagaaacttatagtcaattccactgaaacactgaaaggtaaagattctcaaggtccatgtatagggaggaaatgatgggccctattcatgagtgaccaagggtgataaaagagagaacataagccggtcagtttaactagaaaaaatttgacagctcttagaagagagaagatggaggccgggcacggtggctcacgcctgtaatcccagcactttgggaggctgaggcgggcggatcacctgaggtcaggagttcgagaccagcctggccaacatggtgaaaccctgcctctactaaaaatacataaattagctgggcatggtggcaggtgcctgtaatcccagctactcgggaggctgaggcaagagaatcgcttgaacccaggaggcggaggttgcagtgagccaacatcacgccattgcactccagcccgggtacaagagtgagacttcatcgcaaaaaaaaaaaaaaaaagggagagaaagagaggatcaagtccccagatggagaggaactcagacagcagggtccaggcccaaggaagactacattgtaggaaatgaccaaaggaactcctttgggggaaatttctaaggaaggtgtcactaaatgggatatgacagaagttaataactatccttcggctttcgtgttattgtcaggtacttcctctatttttttactgtttatcattcattcctttccctgggcttctgagcctcaagtgttttttcactgttgcatttcctcctacttggaccagcttatttattatttgtttgtttgagatggagtctagctctgtcacccaggctggagtgcagtggctcaatctcagctcactgcaacctccgccttccaagttcaagcaattctcctgcctcagccttccgagtagctgggattacaggcatgcaccaccacactcagctaatttttgtattattagtggagacagggtttcaccatattggcaaggctggtctcgaactcctggcctcaagtgatccttctgcctcagcctcccaaagtgctgggattacaggcgtgagtcaccacgcccagcctacttagactagtttataaattaacattatacaaaatatatgaaaggactacaaatgtgcatccagacaaaggaacagaggagtgtgtgtcactctgcaaggaggctgcttattccaggacctgcctgcaccccagagtcagccatccaaggagatcacacacactctgcagacactggtgataagggtctgggagcaacacactaggttactttatgtcagaggcaaagggaaaagaaattgcactttcttctcataacaaactccagagtgctcacttgggagactgacagcccaacaaatacaagtgacaaggaagcaatttcaggaatgtaataagggagaactagctaggtttaaaatgtattgctaaagagttatgcaatttttgacttgtaagaaacttaaagaccccatctcatctaaaggtcacaaacagcagccttggagccaaatctggcccacagatgtgatgtgttttgtttggtgcatagtttgaattagttgtcagcatttaaaaaagaacagttcacattttttaaaagtccagattcctgattactgctgggaaaccagaaaatctgtggatcctacattgccagcatttcccggtggcagtacgaaaagccgagcagtgatcgtgccctttggacgttgctcgagtctgcagtttcccacagtccctggctggcctcctttaattcatttacataatctgtctggactctattggcagcttttgagtttaaagcccttgctaagccaacctgttcatttttatagataagaaagcgaggccctgagaagccaagtgactcacccaaccatacgcctatgttggtgtcgtttccatacattcctttttccatcccatgctttctcacttacacggtgaggtttatttagcaaaattttgaaaagagatttggaaagcaaacataaatggtgaggttaaagtctgaagaaactatgttgaaagccggaaaacacaaaggtgatgttaaaaagaggataatttagaggctcgctaactggaactcaagagacttccaataggaaattgttaatgagaggaagtggaaggaagagagaggttacaggcataataagaacaaatgagagaagcgtgagctaaggtaagatgatgagagagagtaaaacaggcactgttttacttgatctgctcccatacagaacaaaagcagcagttgacagaaaggaaactgacaaaataaatttcaaaataaaaactgatcagaaaaaaattagcaattataggccgggcatggtggttcacatctgtaatcccagcactttgggaggccaaggcgggcaaatcacgaggtcaggagtttgagaccatcctggccaacatggtgaaaccccgtctctactaaaaatacaaaaaattagctgggcgtggtggtgggcacctgtaatcccagccactcgggaggctgaggcaggagaattgcttgaacccgggaggcggaggttgcagtgagccaagattgcgccactgcactccagcccgggcaacaatgtgagactccatctcaaaaaaaaaagtataaaagatgtcttgttcagatctatttatttggggaaaaaagacatgaagaaaaggagaggcagcttctcaagattgcctgagatgttattaacaacaacaacaacaaaaaatgtaaacaaaaaacaatttcaaaggagagcctcaccaaaaaaagagaataataattttaaaaatggggataaaaaataattatctcaaaaaaatctccacaagaaaaaaaataaaattcttcctgaaactgaagcatactagaatatgcaaccccaaaatatgtcactttggcacacaggttatttggagctaaaggcactagagaaccagcagaccaagtaaaagctctttacttccccctaatcacctaacatgaactataacgtcccccttttgtacagaaaatttacatttataaaggaaatttccatttgtaagggaagagagctgctcctggagacagtagttatcacccgagagactcttatctgcataacaatacaaccgttatttactatacatttcttcccctcaccttcctagaactttcctcctcccttcagcagcccaaaaccccttttcctctgctcagcctaagatggtacagaagcttaaatcatctggctgccactttgagtcttagttctttgtggaaacttccctgcataggtatgtaatttagccgtccttctcttgttagtttgtcttttgtcagtttaatctccaaggccccagtcagcgaacctaggaaagaagagggaagtagtcctcctcaccaagagttttggcaaccattaagggacagcaaggacatctcacttgctcaggaggctaaagttgagatccaggatctctgacaaagtcggcaaaaggcaaaagttcttactaaagtcaccctcctgtatttctgtctgtagagtctgactgaaggaggatagtagaagtctctttgtcttttcctttccaaatttgcattagcaagagaaaaatatttgtaaaatttagttctttggatggtgactcttgtaaatttggtttttttcatgtgcgtccatgtgaagagaccaccaaacaggctttgtgtgagcaacatggctgtttatttcatctgggtgcaggcgggctgcgtccgaaaagagagtcagcaaaggtggtggattatcattagttcttataggttttgggataggcggtgaagttaagagcaatgttttgcgggcagagggtggatctcacaaagtacattctcaagggtatggagaattacaaagtaccttcttaagggtcggggagattacaaagtacattgatcagttagggtggggaagaaacaaatcacaatggtggaatgtcatcagttaaggctatttttacttcttttgtggatcttcagttacttcaggccatctggatgtatacatgcaagtgacaggggatgcgatggcttggcttgggctcagaggcctgacattcctgctttcttatattaataagaaaaataaaatactgttgaagtcttggggtggcgaaaatttttggggggtggtatggagagataatgggcgatgtttctcagggctgcttcgagtgggattggggtggcgtgggaacctagagtgggagagattaagctgaaggaagattttgtggtaaggggtgatattgtggggttgttagaagaaacatttgtcatgtagaattattggtgatggactggatacggttttgtatgaattgaaaaactaaatggaaaagtctaagaattgggaggacctaggacatctgattagagagtgcctaaggagattcagcatagtcctgccagtaaagattatttatttacttcaagagttaagagtggcagtttggggatagcaccaggagatatcagctgtgatggctcggagaaacagtgtaaaccggcagtgtaaacaagagcagggcatgtatgagtagttgagaacggagaataggagtatgactagacagaaaatagtagggatgacaagttttttggggcacagtctaagttggtccagtgtctggaatgagactggggcctaacaaaaaggagctcaaatgggctgtaccttgtagcattccgaggacaggcctgaattctgagaagcaaaagtggtaaaagtattgtcctttttaatttggtggctgagcttggtgaggtgtgtttttaaaagacctttagtccgttctacttttcttaaagatggaggaccataagggatataaaggtttcctgaatactaagagcctgaaaaactgcttggctgatttgactaataaaggctggtctgttatcagactgtatagaggtgggaaggctaaactgaggaattatgtctgacagaagggaagaaatgactgcggtggccttctcagaccctgtaggaaaggcctctacttatctagtgaaagtgtctacttagactaagaggcattttagttatctgacttggggcatgttgagtaaagctaatttgccagtcctgggtgggggcaaatcttcaagcttgatgtgtagggaagggagggggcctgaataatccctgaggagtagtagaatagcagatggaacactgagaagttatttccttgaggatagatttccacaatggaaaggaaatgagaggttctaagaggcgggctagtggcttgtactatagcatagcctgcctttgctggtgtgtggcgattaggcctggtggaactgccatcaataaatcaagcgtgatcagggtgaggaacaggaaagaaggaaatatggggaaatgcggtgaatgtcaggtggatcagagagatacagtcatgggggtcaggtgtggtatcaggaataatgtgggaggccagattgaagtccgggccaggaagaatggtaattgtgggacttaacaaagagtgagtacagctgaaggagccagggagcagaaagtatatgcatcaggtatgaggaagaaaatagattttggaagttacgagaaatgtggagagtaagttgagcatcgtttgtgattttgagggcctctaaaagtattagggcggcagcagccactgcacggagacatgacggctaggctaaaacagtaaggtcaagttgtttggacagaaaggctacagggtgcggtcctggctcttgtgtaagaattctgaccgcactaactatgcctaggaaggaaaggagttgttgttttgtaagggattgaggtttgggagattaatcgaacatgatcagctgggagagcacgtgtgtttttatgagcattatgctgagataggtaacagatgaggaagaaatttgggcttgactgaagtaatgggggctgtctgtgaagccttgcggcagtacagcccaggtaatttgctgagcctaatgggtgtcagggtcagtccaggtgacatcgaagagaggctgggattaagggtgcaaaggaatagtaaagaaagcatgtttgagatccagaacagaataagggattgtggagggaggtattgaggataggagagtatatgggtttggcaccatggggtggataggcaaaacaatttggttgataagatgcagatcctgaactaacttgtaaggcttgtctggttttaggacaggtaaaatgggggaattgtaagaagagtttataggatttaaaaggccacgctgtagcaggcgagtgacaacaggctttaatccttttaaagcgtgctgtgggacgggatcttggcattgagcggagtaagggtgattaggttttaatgagatggtaaggggtgcatgatcggtcgccaaggagggagtagaggtatcttatacttgtgggttaaggtggggagatacaagaggaggacgcaaaggaggctttggattgggaagaagggcggcaatgagatgtagctgtaatccaggaatagtcagggaaacagataatttagttaaagtgtctcggcctaataagggaactgggcaggtggggataactaaaaggagtgcttaaaagagtattgtctaagttggcaccagagttggggagttttagtttagaagcctggctgtcaatacgcacaacacttatggaggcaagggcaacaggcccttgaaaagaaggtaatgtggagtgggtagcctccgtattgattaagaaggggacggacttaccctccactgtgagagttacctaaggctcggcgtccgtgatggtctacggggcttccaaggctatcaggcagcgtcagtcttcagccgctaagccgagaaggagtcagtcagagagccttcggccagagttccaggggctctgggagtggctgccaggtgagttgaacagtctgatttccagtggggtcccgcacagatgggacatggcttaggaggaatcctgggctgcaggcattccttggcctggtggtcagatttctggcacttgtagcaagctcctgggggaggaggttctggtggaatgccgggctgctgcggttcaggcgtttggaagttcttatgtgctggagatgtggctggggtttgtctcacagtggaggcaaggaattgcaacttttttctattattgtacaccttgaaggcgaggttaattaaatcctgttgtggggtttgagggccggaatttaatttttggagttttatttaatgtcgggagcagattgggtaataaaatgtatattgagaataagacggccttttgaccttttagggtctagggctgtaaagtgtctcagggttgctgccgaacgagccatgaactgggctggatttttatatttgatgaaaaagagcctaaacgctatctgatttgggataaagaaaaaggagcattaaccttgactatgcctttagctccagccacctttttaagagtaaattgctgggcaggagggggagggctagtcatggaacgaaactgtaagccggaccgggtgtgaggaggggaggtgataaaaggattatagggtggaggagcagaggctgagcaagaattgggacctagctcagcctggtgaggagcagcctggggagaagggaagaggtcagatgggtctgtagaaaaggaaaattagaaagactcagcgacgcttggggttgggactgaggggacaggtgggagggaaagaaggaagatttgtgatgagttgcattgggaacagagactggaaagggaccgatgtgtaaaagagtgcctggacgtcaggcatctcagaccatttgcctattttacgacaagaattatttagatcttgcaggatggaaaaattgaaagtgtcgttttctggctatttggaactactgtcgactttgtattggggtcaagcggcattgcagaagaaaataagacacttagattttaggtcaggtgagagttgaagaggttttaagttcttaagaacacaggctaagggagaataaggagaaattgagggtggaaggttgcccatagtgaagcccagagaaaagagagagtagagacatggagggaaggggttcgggggttcttaccctccagaaaagcgggaaaggggtcagggcacagagatacgaggtcggggtgcggacataagggattggggcgcagagatatgaggttggggtgcggaaataagggatcggggcacagagatataaggggttggggtacttgccccttccccagaaaagcgggacttgccgctaagggtgaaggaccaaggcaggcgtccctgcgtggtctgacacctgaataatcagaaaggcatcccagcaatgattaaacaccaagggaaggctgccttccctattccgtgactggtgccggagttttgggtccacggataaaacgtgtctcctttgtctctaccagaaaacaaaaggaattgaaattaagagaagggagagattgaagagtggaaaggagaaagtggttgagggtttagtgagagaggttggagaagagagtaagaagaggccgcttacccgatttaaaattggtgagatgttccttgggctggttggtctgaggacctgaggtcataggtggatctttctcatggagcaaagaacaggaggacaggggattgatctcccaagggaggtcccccgatctgagttacggcaccaaatttcatgtgcgtccgtgtgaagagaccaccaaacaggctttgtgtgagcaacatggctgtttatttcacctgggtgcaggcgggctgagtcccaaaagagtcagcaaagtgtggtggattatcattagttcttataggttttgggataggcggtgaagttaagagcagtgttttgcgggcagagggtggatctcacaaagtacattctcaagggtggggagaattacaaagtaccttcttaagggtcagggagattacaaagtaccttcttaagggtgggggagattacaaagtacattgatcagttagagtggggaagaaacaaatcacaatggtggaatgtcatcatttaaggctatttgtacttttgtggatcttcagttacttcaggccatctggatgtatacatgcaagtgacaggggatgcgatggcttggcttgggctcagaggcctgacagttttgagtactcattggttactgatctctagcttcctaagaatagtcattgttttcctttgtttctgtcctttgtgtgatttattataatgaggagaatagtcatagttttggagaattgtcatagttataggcataggccctataagcctgctgtttaagccagcttcacagacccttgagtttacagtttatgctagagcagcatccatttagacaaactttgctgcggacaaccaatgggaaaaaactggatgagattcttcttttatctcattttgtgttctgagagtttagctttgtgactactatggtctctggtaatcagtctggtttctgccagctgagatggcaaggttgtcacacttgaattgggcagctagccaaccagctaggaacccaaagcacaaaatgcacaagcagcattttctttgaccaaatcttgcagctgtcaggagagtttgccttaataaggcaccccagtccattggggcctttattgtcattctttgttgccttgtttgtgctgggaaaagtaccatcccagtattacctacctgatatcacagattagtgagtctgtgattgaaggcatctcacttttatgggagactgtagtttccttattgactgcgacaatgaatttctttgcttttcaggctatctttgggagtaactctgaatcttggggaggaggagtgggtactgcctcctttgaaccctctttgggaaggtctcttatgtctatggttaagctgtaaaaaagctgattggtttagagtcacattggactaggtatacctttgaaaatttggactttatatccaaagggatttttttaagagagcttgcaccctaaaacaaatgtcctactggtactgataggaaaatcagattgcaagaaagacaaaaaaaattttaataactatttggaaacaaactagacaaaaatcttaaaagtcttgtgtattatttcattctcacattggtataaagaaatatccaagactgggccgggcgcggtggctcatgcctgtaatcccagcactttgggaggctgaggcgggcagatcacgaggtcaggaaatcgagaccatggtgaaaccccgtctctactaaaaatacaaaaaaaatggccaggcaccctagctcacacctgtaatcccagcactttgggaggccgaggcgggcggatcacaaggtcaggagatcgagaccatcctggtctaactcggtgaaaccccatctctactaaaaatacaaaaaattagccaggcgtggtggtgggcacctgtggtcccagctactcgggaggctgagacaggacaatggcgtgaacccgggaggtgaggctcacagtgagccgagatcatgccactgcactctggcatgggtgacagagcgagactccatctcaaaaaaaaaaaagaaaaaaaagaaatatccaagactggataatttagaaagaaagaaggcttaattggctcatggttctgtaggctgtacaggaagcgtagctgtttctgcttctagggaggcctcagggagcttacagtcatggcagaaggtgaaggggaagcaggcaggtcttacatggtcagaacaggaggaagatggtggggagatgtgtgctatacacttttagaaaagccagatctcataactcacttactcactatcataagaacagcatggaggggatggtactaaaccatttatgaggaatccgcccatgatcccatcacttcccaccaggccctactgctgacacttgggttaatagctgaacatgagatttggtggggacacaggtccaaccatatcatcttctctacaaatactggtgaaagattatagccattatttagaagtttaccttaacttgttccatctgccaagaacacaaagtggatccaaatattttacataaactagtgagttttgtaatatgatgcctgactcatggttaaaagtttaaaatgaaagctatgagatttctattggcatctgtgtgcttacatatgcttatgtgtgtattttgcatattgatcgttttctacctccggatggtattgccaaaatttatcaaagagctctgcattaattggcttagaaaacaataactgctcatatacattaagtattattaaaatcctcagaaaaaatagaaattaacccaaaatttgttttcaaattcacatgctctgggctaatctttggtaaataacactagttcagtattgttagttaaatacaaataggtatttctctagatttgtcagcattcaatataatgtagacatgcaattttattctacttgagtttactagccaaataagctgatgttatctctatttgatgttttggattataaaattataattcaaccaaagaatcaaatgtacaataaaaatgaattgcttgatgtatgtcaaagatggcagttaagaagaaagacagagagcgagagcaatataattaacttttaggttctttacttctgtgatttttgatagctacctcacatgcctgtcacaaatttgttaacaagaaaataaactttagatgatgattagctttatttaatcttgcatgaaattttcatcaataatccaaacataattgttaggaacaagttaattaaatagatgtaagtgggataaaactctatagctgaactttcaacaatagttatgttttataatatgtctgcttaaatatagtatctaaaatctttctggtaacctaaaacctcaaagatatagaaagtttagttaaatgagagatagtcatcaaatatttgatcatttctatatatgatataatactgaaaatttaattaagtttatctatatttggcttcttattacagagagactaaataatatttaagtctgttagtcaacatattcttcttgccacactgaaaaagtgtactatgaggaaacacatgcctctagaaattgtgaaagggtgtattcataaatatgctaatctacagaatgcccctatatataacagttcacaatttcctacttccttgttttcactggaaattaaggtattaatcattgaaaactctaatcaatatacataaatgaactattaggaataataagggtgaaggagaaaagtctacatgcaaagtatacaaagaaactaagatgtgttgggcacagggaggggaacatcacacaccagggcctgtgagggggtcgcgggcaaggggagggaaagcgttaggacaaatacctagttcatgcaaggtttaaaacccagatgacaggttgataggtgcagcaaaccaccatggcacatgtatacctagataacaaacctgcacgttctgcacatgtatcccagaacttaaagtaaaataaatttaaaaaaagtaagatgtgttttgacaaggaaatatatgaagtatgaaggatgcatttttgttaaggaaaagggagagtaattttgtcctacagtagtttaatgttatttaaagattatttcagagtgagaaagaggaaaataaaggacaaaaactaggcaggtataggaaattgtcaaaggagagagagagaattttgtgtagtcaaatatctaaaatgggctgggcacagtggctcaggcctgtgatcccagcactttaggaggccaagacaggacgatcactttagactgggagtttgagaccagcctacacaacacagagagacctgagaccctgtaaattagccagacgtgctggcatgtccctctagtcccagctactctggaggtaggaggatcacttgagcccaggagtttgaggctgcagtgagctatgatcgtgccactgcactccagcctgggcaacagagtgagaacttgtctctaaaaaaaaaaataataaaaaataataaaattattataaataataaaattaaatggatttattaaaatgtttaaaaataaactctaatatcaatagtgtgctgatgcagaactggaatttggattgttgatttgttcctaataagagatcataaaagggtttctttatctgttgagtactttgcataggaaacaaagattctgtgacttaccagaaataatttcccacatgtagtcccagctacttgggaggttgaggcaggaggaacccaggagtttaaggctgcagcgagctatgatcacagcactgcacactagcatgggtgacagagcaagaccccaaatctttttaaaaatttaataatttcttatgcttaatgttgtctttaccatatctttgattacttttttaaaaaagagtcttctcactatggaaaaagctaaggttttgttttggttttggttttttacaattatgtgaccttctgtatttacctttacagtaatattttccctttgattaaatagataactaagtattgtttcatagttacctgttatcctgttttatcaagggttcaaaccttttgcaatttttgatagtcttccccaaatcaaattctaaagtcttttaaaattttttttgttaaattttattttttaaaatttttatttatttatttatttatttatttgagacagagtgtcactctttttgcccaggctggagtgcactggcacaatctcggctcactgcgacctccgtctcctgggttcaagcgattctcctgcctcagtctcccgagtaaccgggattacaggcacccaccccgcccagctaatttttttgtatttttagtagagatggggtttcaccatgtttggccaggctggtcttgaactgacctcaggtgatccacccacctcggcctcccaaagtgctgggcttacaggcatgagcaaccgcacctggcccttcctcgtttttttgtttgtttgtttgtttttggtagagatggggtctctctgtgttgctcaggttggtcttgaactcctggccttgagtgatcctcccaccctggagcaaagagctgggatcacaggcgcatgagccactgtgcccagcctgattctgtagttttgttttttttttacttttgttgttgttgtctgtttgttttttgagacaaggtctcactctgtcactcaggctagagtgcagtggcgcagtcttggctcagtgcagccataacctcccagatgcaagtgatcctcccagcgcaggctcccaactagctggaactacagacatgcaccaccacgtctggctaatttttgtatttttggtagagatggggtttcaccgtgttacccaggctggtctcaaactcctgagctaaagtgatctacctgcctcggcctcccaaagtgttggggttaccggcatgagccactgcgctggccctagtctttttcactttgaactaactttgacattccacagaactctccttgaaaatctcaaaggatttgctctttcacattgaaaaaaagagatgttacactaattagatttatttgatacgctaaattacatgagaatcatcgtcaactaaaatatgatgcttaaccttctttatgttatatttgtataggtacgtaattaatatgtgtttcaaaactgtataaagttcctagatatttatcaatctttgctgttcatatgtcctgatacagtgttatctggacagttactattataaaatgctgtaagccacagaaataaccaaatttccttgttaattgcactataatgaactctcatcagatctttaatcatggttatttgtaagtcttttgccattcacagccaattattgttttatgataattcttctctgaatgcttttgcaatcaacaagtgaaaatgcttcatcttcccagagaccatggaaaagactcagagaggtattctcaagtatttaagattataccactggattgggtaaagatttccaaaacactaaagaagaaacatgaattcataaagctgcaaatacagcatcaagcaaaacaagaattaattccatgggactgaatgaactgataagaataattctaatgtgtatggcccttttgtttgaaacattactggttccttaatgtttttccatatttaagaaaccctttttctctgttttcttaagctatctataacttacagtaacttggtaaagtatacctttgtgaacaaagatgaaaagataaaacatttactttttttgagacagggtctcactctatcatctgggctggagtgcagtggtgcgatcacagctcactgcttccttgaactcctgggctcaagcaatcccccaacctcagcttcccaagtagctgggactataaatgtgcatcaccatgcccagctattttttttttttttaagagatgagagtttcactgtgttgcccaggctgaagtgatcctccagtgaagtgatcctccagtttcagcctcccaaagtgctgggattacagatgtgagccaccatgccccgccagaaacattcactttttctccccacccgatccttccagaattcggaaatctttattgaatattcttattttcatggtgatgtatttacatatgttcagtaagaatctcttgtccttataacagaatgcaatttgaaatattacttatattagcaaggctttcactggaatatcatattttaggatgatgcacataaaatcagataacatcagacagttttaaggaactgtcagaagcacttgaacaagagcaactccatcttgaataggggctgagtaaaatgaggctgagacctactgggctgcattctcagatggttaggcattctaagtcacagaatgagataggaggtcggcacaagacacaggtcataaagaccttcctgataaaaacaagttgcagtaaagaagccggccaaaactcaccaaaaccaagatggtgatgagagtggcctctgggtgtcctcactgctacactcccaccagcaccatgacagtttacagatgccatggcaacgtcaggaagttacactgtatggtctgtaaaggggaggcatgaataacccatcccttgttgagcatatcatcaagaaataaccagcagtgctggcgctgatctgtctatggagtagccattctttcattcctttactttcttaataaacttactttcactgtaatctatgaactcgccccaaattctttcttgcttgagatctatgaacccattctgggggtctagatcaggacccctttctggtaacaaaactaatgctgactttatgaagccagtgcttaaaaagccccttgaaatattggcctggtacctgattaacagggttcccaacctaacaggtgagtaaaaaaggtcacttcttggtaggcccaggaagctgaaaatattttggggacctcaagaaaaaaggaattcacccaaatctgtaggtattgctggtgaaggctgatggattggtttccagctttgataggctttaacagtctaacctgaaattccttattaaaagttgcaacaaagcagactcaaaaagagcttacattgtcaatcattattcttgctatttttatgtaataatcaggccaaggtcaatgagattgacttattttgcaacaaaaatagtgttactttgattatctttcatagaaataggggtgattgtagagagaactatgctgtttcaattgaaaactatagcacacccttgtggattgtcaaattctagccgtgttcactgcctttcagcttttttaacctctctgtaaactgactcctgctgtgttttgcattttgtcagtaattaacatttctgattttaatctcacctgatttggcaccactgagaactaaaacctgactgcctagatccgtattgacactacccagaaaaagccctgcaagctgaaactgggcccttccgtgctctgctctgagaaataaccataactgtcacattgtatatgccattcccagagacattcaaaccacaaacccagaaacacttcagactgccacggcccgtcctccttctatcacctagagatgcgttgagcccaacattcagaaatcttctcaactgattgccctctggcctcagaaactgggtttataaacagttctatctattaaccttggttttcttttgtttccatagaaaggtcctcattaaatgtcttacagcaccatatagagacctaaccggtgggcaccctattccctctggcaacacaatctcttgagatacaactttctgagtaaactgaactcttatacactgttggtaggaatgtaagctattcccaggactgagagactggttcagtgagatggggcaatgtgtttaaatttgtccttttctgcttactcactctcgttccaatctgttttccttccctttgcagatctcttatcttgcaacacctaatccgaatctctctcaacagctacaaacttggcttttgatgtatgaaacgtcctgagaaaaagaaagtttcaaagggtgggataaagggttccagaatatgccacccaatatatggattattttgagctaaaagcaactgagaaccaacagacacaggaaaggctctttctgtcccctaactgcctaaaagcagaatataaatttccccttttgtaaaggaaatttatatttataaagtaaatttctcttggtgaagattcctctgtaccagaaagagagctaggcctggggataacccatcacctgagacactcttacctgcataacccttatttacatacacgtatacatttcctgccttactttctcaggacttgtcttctctactcagaagccccaaacccctttccctttgtttagtctgagatgctatataagcttcaatcatctgggtctccttgagtcttttctttgtgatactcccacgtgtatgtatgcacataattaatctgtttttttcctcttgttaatctatgttttgttagtttaatttccagggcctcagccatagaatctattgggtagaaggagaaaaagttatttgtctcccctagaagccaaaatgcagtcctagccatagcaatcaagcaagagaaagaaaaaaaaaaaaggcatccacattggaaaagaggaagtcaagttgtctctctttgcagatgacatgattttatatatatgtatatatatatgtatatatatacatatatatatacatatatatacatatatatatacatatatatacatatatatacatatatatatgtatatatatacctaaagactccaatttaaaaaaaaaaaacctctaagaactgataaattcagtaaggttgcaggatacaaaatcaacatacaaaaatcagtagtgttctatacaccaataacaaagtagctgaaaagaaaatcaagaaaataatcacatttacagtagctacaaaaataataaaatatctaggaatagatttaatcaaggaggtgaaagacctctacagggaaaactataaaacactaatgaaagaaactgaagaggaaacaaacaaatgaaaagacatcccacactcatggattgaaagaattaatattgctaaaatgaacatactatccaaagcaacctacagatttaatgcaattcctaccaaaatatcaatgacattcttcacagatattttttttaaatcctaaaaatcatatggaaccacaaaagaccctgaatagccaaagcagtcaggacttaagcaaaaagcacaaagctggaggcattacactacctaactttaaaatacactacaaaactacagtagccaaaacagcatggaattgatataaaaacagacacatagaccactggaacagaatagagagagccaagaagtaaatccacgtatttatagccaactggtttttacaaagacactaaacacattgggaaaaggacaccatcttcagtaaatggtgctgggaactcggtaaccatatgcagaaaaataaagctggacccctgtctctcaccctatacaaaaattaactcaaaatgggttaaaaagttaaacctaagagcagaaactataaaactactagaagaaaacatagggaaacactccaggacatcagtctaggcaaagattttatggctaaaacctccaaaacacaggcaacaacaacaaaaatagacaaatgggactatattaagctaaaaacttcttcactgcaaaggaaacaatcaatagattgaagagacaacctgtagaatagaaaaaactatttgcaaactattcatccaacaagggtctaatttccaaaatttacaaggaattcacacaatttaacagcaaaaatataaataatccaactaaaaagtgggcaaaagatctggatagacatttctcaaaagcagacatataaatggctaaaagttatacgaaaaatgttcaatatcactagtcatcaggaaaacacaaatcaaaattgcaataagaaatcatccactccagttagaatggctattatcaaaaagacaaaaaacaacagatgttaatgaacgtgcagaaaaaagggaactcttatacaatgttggtaggaatgtaagctagtataaccattatggaaaacagtttggggttacctcaaaaaattaaaaatagaactaccatatggtttagtaatcccactactgaatatttatccaaaggaaaataaatcagtatatccatgggttacctgcacctccatgcttattgcagcactattcacaatagctaagatatggaatcaaactgccttcatcagtggatgaatggataaagaaaatgtggtatatatacacagtcattcttctattctctgtctccatgaaatcaactttttagcttccacatatgagtgagaacatgtgttatttgtctttctttctttctttttcaagacaagatctcactctgttgcccaggctggagtgcagtagtgcaatcaaagctcactgcagactcaacctcctgggctcaagtgatcatcccaccccaacctcccaagtagctgggactacaggtgtgtggcaccatgcctagctattcagcctttaaaaagaatgcaatcctgtcatttgcagcagcacagatgaaactgaaggtcattatgttaagtgaaataggtcaggaagagaaaaacaaatattcatgggtgtggtggttcactcctataatcacaacactttaggaggccaaggtggaagaattgcttgagtccaggagttcgagactagcttgggcaacatagtgaaaccccatctctacaaaaaaatcaaaaaattatctaggcatggtgccacacacctgtagtcccagctccttgggaggttgaggtgggatgatcacttgagcccagaaggttgaggctgcagtgagctttgattgcactactgcactccagcctgggcaacagagtgagatcttgtcttgagaaagaaagaaagaggcagggcacggtggctcacgcctgtaatcccagcacttttgggggctgaggcgggtggatcaccaggtcaggagatcgagaccatcctggctaacacggtgaaaccccgtctctactaaaaacataaaaaaattagccaggcgtggtggcgggctcctgtagtcccagctactccggaggctgagtcaggagaatggcatcaacccaggaggcggaacttgcagtgagccaagatcgcgccattgcactccatcctgggcgacagagccagactccgtctcaaaaaaaaaaaaaaagagaaaaaaagacaaataacacatgttctcactcatatgtgggagctaaaaagttgatttcatggagacagaatagaagaatgactgttaccagaaacttggaaggtggagaatgcaaggatgaagagaggctggttaacatgtacaaacatagagttggacagaaggaaaaagttctagtgttgggcagcacagtaaggcaactatagttaacaatatattgtatatttcaaagcagctagtagagaagatttgaaatgttcccaacacaaagaaatgataaatgttcaaggtagatttcctaaataccttgatcattacacatcgtatccatgtatgaaaatatcacatgtattccataagtatgtacaattattatgcatcaataaaaaaacttttaacccaaaatgcaaactggagaattttacaaagaatttgttatttaagggttcagcaaaaggttttctagaaagaaaaatgaacagacggcacaagactcttttgcttcaggagaggaaggatccaggcccggtactgctgcaagacagcaggatttataccaaaaattattgtgtaagtttactataaatattaatagacggaagtcgcagagttttatttaagatcctgaccagtgccaaaacaacagggaggcagtaatgtggactgttaacaaacctcagaagaaacaattggatatgtgtgtaattcacatacaaaagtgagcagagtagggtgtatgtcttttctgtgtcactgatgggttgggtcactccgggacaaacaattcaattctctaaggctcagtttcagccatgaggtgaggaattgggctgattctcaaagggttatccccagaccaaaatcatcagcatcaccagggaacatattagaaatgcacattttagctgccttcctggacttacagagtcagaaactcagggcgagtgtggtgactcatgcctgtaatcccagcactttgggaggctgagatgagcagatcacctgaggtcaggagtttaagaccagcctggcctacatggcgaaaccccgtctctactaaaaatacaaaaattcgctgggtgtggtggtgtgcgcctgtaatcctagctactctggaggctgaggcaggagaattgcttgaactcgggaggcagaagttgcagtgagccgagatggcaccactgcacttcagcctgggcaacagagccagactccatctcaaaaaaaagaaagaaaaagaaactcaggatggtgtccttcaacctatgtcttaacaagctctcttggtggcatccagtaaagcttgagaaccactgagcaagccactggacagatgatctctaggtccctaatagctataaacacacaaatttaattgtaagctaaggaggaaaattataagctgagtggtcctagtatttggtatagtaaatttttaaaagatattcaaaagaatgacataattatttttggaatggtacgaatgtttgccattgaattttacgagatgtgagaatggcgtgtacacatacaaggagtattccaaccatgaaatgacctgagttgaaataaagctaaagactacaagtgctaagacaaggatggtcacatacgcagtgggagtaatttccatacgaggaatgtacataccaagactggctcagtgtgcggacagccaagggaagtggaactttcagtgttcaaagttctacagtttttttaaaatacacgtatagattagttaatgaactactttataattagctgctttgtattaacattgcaaatgtttaaaaaaaaaatcttctaggctcattgaagttttagtggtatcatagggcctaaaactataaaacaaaagaaatcaacttctctctgtccaggcttagttgaagataataggatctgaaactgagaggttttagtttgatttatttctttctttgtttttgagacagggtctcattctgttgcccaggctggagtgcagtggtgcaatcacagctcactgaagcctccacctcctaggctcaagcaatcctcccatctcagcctctcaagtagctgggactatagatgcgtgccaccatgcctggctatttttttattctttgtagagatggggtcttgccatgttatccaggctgttcttgaactcctgagctcaagcgatccaccagctttggactttcaaaatgctgagattacaggcatgagccactgcacccagccacatctagtatgacttcttttttttttttttgagacagagtctcgctctgtcgcccaggctggagtgcagtggtgcgatctctgctcactgcaagctctgcctcctgggttcacgccattctcctgcctcagcctcccgagtagctgggaccacgggcccccgccaccacgcccggctaattttttgtatttttagcagagacggggtttcactgtgttagccaggatggtcttgatctcctgacctcgtgatctgcccgcctcggcctcccaaagtgctgggattacaggtgtgagccaccgcaccaggcctagtttgacttctataccatcctgtttctggccttctcccttcaccttcagatacctgctctttaatttattttccttgtcagtcatgtgtgttggttaattcattgactgcttacacttgtatatgaataaacttcacaatgctctttcaatcaagcattttcattttgtttttaataatgaattctaaaaggaaagatcctgtctatctattaaaggagctccagatatctcttaataggtagggaaattgttggaaggagcagaaaagcctccaagacagtaagagttcttaaagtagactgagtgaccttcttggcgtagggttgggaatagcagttgtagaggagatggtaaaggacgcagtccaggaaattgtggtaaaaattaatacagaatacactggctgctttgctaaggaactttctcccccagcaaggacaatctgccaggtggctaggcaagatggtctgtatttgttgtcatgaaacctgtgtggagtttcttccaggagtgaagccttcctgccctacagttcagctctcctgcctccttcctgcttctgtgccccatcttttcatgcatgaatacagatcagcttctctctccttcccctaatcataatccatctgctgtcccaggagccagggctgctgtgtcagttctttgagtggtgccctacacaaaagaactggcttaagtggcgccctgccaagtggactaatgaaggctgaaatctagcccatgcttccctcaccaaaccctgagcttgtgggttacttatttctaactcacacagaggtactctatgggctagctgcaaccatggcataacccctgtgttgtgttttgggacactatagtagtgctcttaagaaacaaaaacaaaaaacaactcctcttaacatactctctagaccgagccatgcttttcatgtcctctgtaaaacacagtgacatgtgtctgtggcacacccaagccagctgttggtaggctgctcctagtatgccccgggcacctccactccctccagttacgctttatgtatacaccaagcatccttacgtgttcccagaatggtgtatacaccaagcatccttatgtgttcccagaatggtgtctgctcattgtgcttgttattttaattatccaaattaatgaatgaactgacaaaattgtgtaaaaaaaacagtgtcatggtttctttgaaaactaatttcaacacgttgcaaagattgaaaaagggtaagtagtagaaatagctgttgatttagttgtggggaggcagctataaaagattggcaaaagaaaaatgcaatgcctaagattctgtgctctaattgctttacgtgcgttttgaagtccttgattcactttaaagaaactcaagcttagaagtcatagaccatgaattatggatgtagtttatgaaaaaaaagatgtgtcactataatcagcagacccatgctaaaaataataaaatatatcttttcaaaaagctttggccctacattaaaaaacatatatttagatgttttaaggtaaaacacaatgttcaagatatgtgtgtgtattattttagtgaatttttctattaatcgattgttgactatacccagttcagatcatgtcatataagacttctacagtattttattttgtgcctaatgagatttgtgtgtggtggtagactgttgccctttgtgatgcctttctatgtaatttcaaatatgctatattatatgtgcctttggtaacagtatttctgacaacaaagcaatattgtctcacaagaattctcagtaacaatcatacaatcacacctaggccaatccaaaatattttttaaaagcttttttaagtctagtttgacttctaaaatatactttactacagattaccacaagacacacatttggtctggcaaccactgaatcaatatttggcacctctgctgggaattttgtaaaaattgccttttaagttcaaactgactaggaagctagtaatgtattcacttctaaaaaaaagaaagaaagaaacctcggtataacaaactcagatcctttcataggaaggataatttaatatgaggttaattattcattaagggaggaaggaagaagactagaaaagaagttttgtttcatcatttcccaaccatttggaatcaaataattgtacaacttgggaagtgcggaggaacttacaagtcagaaagctgtacctttatcctatagcagaaatgtcttcttcagatcaaatggttccccactctgttttgttaccaatagtgagatgttcccaggtctagaaaggcacatgctttattgaaaagctcaacttagaaaaatcctttcttggccgggcacagtggctcatccctgtaattccagcactttgttaggccaaggcgggcggatcacctgaggttgggagtttgagaccagcatgaccaacatggagaaaccccatctctactaaaaaaattaaaaaaaaaatttatctgggcgtggtggcgcatgcttgtaatcccagctactcgggaggctgaacaggtgaatcacttgaacttgggaggtggaagttgctgtgggccaatattgcgccactgcactccagcctgggcaacaagagcgaaactccgtctcaaaaaacaaaacaacaacaacaacaaataaaaaaaaaccagaaaaattctttcttagagtgagtgctagtctgtcactttatcatgtccactttggggtattagttctgaaatttgcagatttgaacatttccacccttgtatattttcagagaactgagtatatttaacctggagaaaagatgtatgcatgtgtcctagagggattggtgtgaagggtacataaggaaaaactacctagctattaattttgcaatggaaacattgtggaggtttgccttaaaaagtagtgagctgaggtgttccaggagagagcagtgattatttactgagaggtctttagggtgagattcttactggatagaagattagaataagaagcctctcaagttacataatttgaaaagtctatactatacttggcattcaccatgacattctactctatagcatatttggtttctccaaattttcttcgtatgctatagcttccagatctttttacttttctagtcaatctgttatgaaaacatattaacgtaataaatatcctttaaattttatattcaaaattaatttttttaagagacagggtctcactctgttgcccgagctgaagtgcagtggtgcaatcgtagcttactgcaaccttgaactcctcgcctcaagtgatcctcccacttcagccccccaagtaggtgggactacaggtgtgcatcaccaaccccagctaattttttaaattttttgtagaaatggggtctcgctacgttgcccaggttggtctccaactcctggcctcaagcaaccctcccacctccacctcccagaatgctgaaattagaggtgtgagccaccatgccagtccccaaaattaaattttataatcaataaacatgatgcaggaatgaggtcatgaggaaataacctctctgtggggaccctgatagtgttagtaaaaactaatatgaaattaactgctgctaaagagccttggaaaacacagatttccactaaagtgatgagaattcatccttaggactggaatgcaatttacaaatcaataagtgaataaattattttgtagcttatttaaagaaatataggtcaagaatcccatatctgcaatcccaaaaaaatattaaaaacaagtttttttcataaccaattgagtggcagaacctgatgtaaactactggaggatacttaattatttgtatttatcctcttcacacatttggctgctgaactatttgagtgtttgacttggaagtgtactatatggcctttctaaatccaaatatccgaaatcaggagcacatctggccatacaattttggcttgggcactaggaacctgtctcatacgtgaaaggagactgatggtgggtggtatctgtgttatccgcaagaaaaaggaaaagggattccactttgaatagcatggtgtagcactctgaagggcacaataatacaaataaaaacaattagatactgaataaaacctacttttaattccatgttgggggccgggcgcggtggctcatgcctgtaatcccagcactttgggaggccgaggcaggcgaatcacgaggtcaggagatcgagaccatcctggctaacacggtgaaagcccgtctctactaaaaatacaaaaaaaattagccaggcgtggtggcgggtgtctgtggtcccagctactcgggaggctgaggcaggagaatggcgtgaacccgggaggcagagcttgcagtgagccgagatcgcgccactgcactccagcctgggtgacagagcgagacctcgtctcaaaaaaaaaaaaaaaaaaaaattccatgttgggcttacaagcagtaatggaaatctcccacctacccctccttctgcccacactaaccacagagtaaatagaaatagaccaaatacattccaaatcaaggaaaaaaaggggaaagaagactttaaaaaccagtcattccgaagatttcaagataacatattagtcacaataggctacattatgccgtggtgataaattaacttcagtactcaccaacatcacagaaaatttatttctcactcttgccgcataccagtgcaggctggtaggagactctgctgcacatagtcattgaagggcttgattgatagacgcttttccattcagcatgttgtaagttgttgcaacaggataaaagaacacatggagacccccaaattcaaactcagccttggaccagaagtgacacatgtcactttcattcctattgcccagcatcattcatgttgcctcctctaaatgcaggtgtcatgtagggcagacaagaaatatttgctgatcattactgtctcttccataaaaggataaaagagaaacagcaaaagtgagaaaaatagaaattttaaagtgatgcagtataaacaaatccaaataaatctataatcacaacactcaaaaagcaagtaatgtcataatagatctttaacatctacttatatgttcagaagagacccacctaaatgttagaaaaaataaagcttgaagtttagaagacaagaaaaggatgtaataagcagatataactaaaagaaagccaatgtggctgtatttttatcagaaacatataaaattcagactaaaaaattattaggtataaaaagggacactcataacaatttttaaatgctcagttcaccaagaagatataaaaattctaaacatgcatctaataagatagtattaatggtatcaaattatgtaaagtaaaaaattagtacagtgaaaaaaatgaatgaaacttacaaagcttaaaatacttactatctggccctttacagaagaatttgttgacctctgtacatgaccgtaaggtactttagcaatgttcaaaatattggcatcaaacaacaacaatctttgaaacataatgcaacaaaatatggagccaataaaaaataaataatcccacactcttgaaaatttaaaaggaaactatatttttaaataatgcatgggtgaaaggagaaataatgatggaaatttaagaatactatataccaaataacaaaactattatatattaaaacttgagaggtggctaaggatggccaattagaacactaataagggcattaattgcaacacattgaaaacagatcaaatatgtttcaattcatgagtttagatatttgggggaaaagctagttgatcaccttgggaagatgatagggaactatttaaataaagagagaaaaatcaaggatttatcatgcctttcctacatgaaccataccactgagcagtcagtaatgaatcacctgaaaatattggcacaaggggacaagttgaaacatgcaaggaaacccaagaggccagtcatttccagctgcccaaatgggactacagaaaggcagcttttagagagatctatggaaaactattgcctctgacggcagaacatgaaatttaaggagagtgaggacaagcttggttccaatggggacctctgcatccatcactacatccaactgccagaaacttccgaaagctacacctctacgtctgccttccagatttcatgcaggctcctcttttggccaactctcattcagaatcacaagagaaagggaattttggaaaatgtcatagcaattcagtgtagtccctctttttcaatttggtaactatatatcctcttttaaccacttccagataaagataatagcaaaagtatgtttccacttaagatggaacaggccttcatatacctaaaaagatattgatccagtctcctacagcagggacccctaacccccatgccatggaccagtactggaccatggcctgttagggaccgggctgcacagcaggaggtgagcagtgggcaagctagcattattgcttgagctctgcctactgtcagatcagccatggcattagactctcacaggaacatgaaccctattgtgaactgcatatgcaagggctctaggttgcatgttcattatgaaaatctaatgcctgatgatctgtcactgtctcccatcacctccagatgggactgtctagttgcaagaaaacaagctcagggctcccattgattctacattatggtgagttgtataattatttcattatatactacaatgtaataatgatagaaattaagtgcacaataaatgtaatgcccttgaatcatcctaaaactatcacccccacctcctggtctgtagaaaaattgtcttctgcaaaactggtccctggtgccaaaaaggttggaaccgctgccctaaaggatacacaaatgagatccatctttggatgatgtcgatttatcttttagcccactctcattccccctttggtacgctgtaacttaaatactaatggataaagttaatacgttatgttagatagcagaatgagagaaaaaagaaaagacgaacaaaggtggtgtgtgtttaaacatacgtatttaaataaattcatatcaaagaaaaaatacactcataactactaccaaactcatttctgcaaattggtcacatggtcatagctggtatttagagtttccttttcccactatccactcagcattctctgctctcaacaggcaccccagatttcctggaggatgacccaaaccttcattcctgaagggtctgtaacatttacagtcctgctgtattgggtgttgcagttttctatcaacttttcatcaaagtagtataaagaggtgcccccaaaggacctgttcaattctaatgatactcctctctgcttccatcatgtagtagcaacccaattttcccttaaggatcagaataaattatgctagctaggagagtaagccgcaccttccccttgcttttttttttttttttttttttgagacagaatctcgctgtgttgcacaggctggagtgcagtggcacaatcttggctcactgcaagctccgcctcccgggttcacgccattctcctgcctcagcctcccgagtagctgggactacaggcgcccgccaccatgcctggctaatgttttttttttgtttgttttgttttttgtttttgcatttttagtagagacggggtttccccgtgttagacaggatgatctcgatctcctgactttgtgatccgcccgcctcggcctcccaaagtgctgggattacaggcgtgagccacgtgcccggcccgtttttttttttttttttttttttttgccagtaggttcagtggcataaggagctaaaaatggccccattagagtctcagattctggtttgatagaactgctgttgtgttcccagtagaggcactcttcctttgggaactaaaacctctaaaacagcagataacaaagttgggaggatggaaaacccaatttttgctagcaggccattaaagttagtaataagaggagccaatcgcattttctccctttaattctctgacctgagggggaaaataagcaccacacagttattgcgtgctcagtgcaacaaattgcatcctgggacaggtgcagtggctcatgcctgtaatcccagcactttgggaggccgaggcgggtggatcacctgaggtcaggagtttgagaccagcctgaccaacatggtgaaaccccatctctactaaaaatacaaaactagatgggtgtggtggtgcgtacctgtaatcccggctacttgggaggctgagtcaggagaatctcttgaatccaggaggtggaggttgcagtgagctgagatcaccccattgcacttcagcctggacaacaagagcgaaactccctaccaaaaaaaaaaaaaaaaatgcatcctggaagacactactgtagccctgcaacgtgttgccctccagctgataccacagctgagtctccaaagggccatctactatcctatcaaccaactacctaaaaatgatgaggaacatgacaagcccagtggactttatgagttctagcccattgctgtaatttacttggcataaaattagtttcctggtcagaagcaatgtggtgtggaatattatgagggtgaatacggcattttgcaagttcggaaaggattgtttttccaggagcattgcaggcagaaaaaacaaatccatattcagttttgcccattggaaggatttcccttaagcactgtaccttagggcgccccttgagggcctgcagtgctgcagctgtccacttttaggtggtgcccgcatgccttgaaaaaccatctgtaatcaggcctgaattttctcttccttagtaaagtggacagagagaacttcccatgaggccatgggtgtggactgagagagagaagccaatttaatatgaataagagccataggaatctgagccagttacacatgcagcttacttatgactttgggacctacataagcccaatcttggatatattatttctacttatattggagtgctgctgtggacgcccaacctatggcttagtgagtcaaacaacatcaagttcataatggggagttcatattgcataacaacttgatagtccaaagtcaagcattcagtcttttctagggttcagtagcaaatcagaagctatttattaaaaagagaaagttaatctttagaagatggcacatagctttgcttcccagtcctgaaggtctataactcacagatagggtccagccaagggcccacacagtctcccaatctgtcagagacatttcaagtatcagtggatcttctgtatcaaagggctccgagggcagaggagctggcatgcagcgtggacctgttgaagagccttcccttgtgttaggccccactgcaaactggaagtccactagcagttgtgcttttttctttggggtagggctagatgcagcaacttgttcttcacttttgaagaggtatcttgaccatgtcccagatcagagggggcagtcactgaagtggagggctcctaaactttggtgaagttgatttctcgtcctctggctatttgctacttctcgcttatccagtccagtcaacagcgtagcatcaccataattgagtagaataataacttgtggaattgagaggcaatcaatgtcttttcagactagattataacagagggcttcagggttgataaaggctcaaaataggacagtggaggggtagtgctggccgtaacaattaaaagcagttataatctttaccatccatcctctaagccttttatcgtagcacattctctgcaatccctccaagaattctatgctgcctttgatttactattttagcaggtaggcacagttctagggactccttcctggacttttctatcataaaattccttactgcccataatatggtttaactgtgtccccacccaaatctcatcttgaactgtagctccaataattcacatgtcgtgggagggacccagtgggagacaactgaatcataggggtggtttcccccatactattctcatggtagtgaataagtctcacgagacctgatggttttataaggggaaagcccttttgctcggttctgattttctctgttgtctgccaccatgtaagataagcttttcaccttcttccatgattgtgaggcctccccagccaccctgcggaactgtgagtccattaaatctccttttctttataaattaccgaatctcaggtatgtctttatcagcagtgtgaaaatagactaatacggcccataatttggggaatcaatttgggaatctgccatttgctgaatatgtgaattccacctctgcattttagaattgggaaaataatcctagggttcaggtatccaccagacccactatgagttgcactcaggccaaaacctccacttatttcctgacctcttaaggccctactgtgactggtgcaccacagtgacattttgggtttctaggaacagtgctagtgtgcagcagtcctcccaaagtctacttatttcccctcccacaaggtacaatcacactgataagtggccacagatccctttgggaaaggatagtaagatttacaatacattttttgcagtctagcagcattcttccacaaaaggccttgcttccccttgattcaaggggctctgtgtctatggactagatcaggtgtggcaatcaatcagctgaggatccgggactgctctggaatttaactcaagacttttctactccacacctagaactttttttgtgtgtatataaatcaagtaaggctttagtaacccatcattttattttattttatttttgagacagagtctcggtctgtctctcagactggagtgcagtcgcccattcttggctcactgcaacctccaactctcaggttccagtgattctcccacctcaacttcccaagtagctgggattacaggcccgcgccaccatgcctggctaattttttggttttttttagtagagacagagtttcaccatgttggccaggctggtctcagactcctgacctcaagtgatctccccacttcgaccttaattctagggatatcaaaataaattagccaacaccaaagatcaaaccattctgattatcactttagttctgctgtccattattacaaccatgtttctcttgtccctagcagtaaagatagttacgtgatgtcacttggtgcctctgttccagtatcccactatccccagtgaattgtgggatggtggcaacattaatggcttacagagaatggctactatagaactccaaaagggttctggtgtttgcttcagcaatgctttctttctctctttctctttcttcctttctttctttccctcttttcccctctcccctccctccccctcccctcctctctcctttcctttccctcttcttgctttctttcttttctgtctctggctctctctctcttttctttctagtgatgagcccctaactctgttgcacaggtcggagttcagtgccaaaatcatagctcactgcagccttgaaatcatgggtttaagcgatccttccacctcagtgtcctgagtaactgggactacatatgtgcaccaacctgcccagcaacaatgcatttcttaaagctttgattaaaggagaccctcccaggtcctaacgaagggatcttacacaataaatccactccagcatactgtctgcttatcttttggataccttctgtttatagcaatgggagaagaattcatgaaagatgtagttttcaggtactacttaacagaaaacaaatggtttcgtagtgtgtgtgtgtgtgtgtgtgtgtttgtgtgaattttgaatatgaacaaggactaaaaatagaaattggaataatgaagtaaggattgtgatggttaattttatgtgtcaaattgactgggccaagatggccaagtagctggtaaaatactactttaagtgtgtttgtgagggtgtttctggaagagattagcattggaatcaataggccgagtaaaaatactgccttcaccggtgtgggtaagtgtcatccaacccattgagagccctaatagaacaaaagggtggaggaagggcaaattctgtcttcctcttcttgagctgggacatctgtctttttctgacctcagacattgaagcttttagtgctcagaccttcagccttgaactgggagttacaccattggctcctctccttctcaggcccttggactcagactcagactcaattataccaccagtttcctggttccccagcttgcagatggcacatcttgggactttttaatctccataattgcacaaaccaattcccataataaatctcctcttatgtatctatctatttatccatccatctatatcctattgattctgtttctctagagaaacctaatatagtgttttagcagagacgaaagattcaatagtgaaaatgaactacacaatttggtggtggaaaaagggacatggcaagaatccaaaccagaaaattgttacttctagaaagataactggaaatatagaggagaatctgtgaataaaacagaaaaagttggcaacaggcaatatatgaagcatagaagagatcaatatgtcaaaacttattctgaggttcattaattcaaaggttaacaatatggtggcattggtaagaaaggtggcgaagccataaagagaaaacatatggaagacagtagtttgaaggtcaggtagaaaaagatgtgacaaaaattgtgaaatattctaaaaatatagctgccaaagagtgggctgatggaaagttgattagtatatgcagtgactttataatgtgacaacttggctaggttgaactacattcccagaattccctttatgattctagttatggtgggccacagagggagagtctggagtgatttggagggtagatataaagcagcaaacatttttttagctcatgcacatggtcatttaactgttggctcacctcatggggatgagccagtgactggggctgcaactactccacctttaacatgatccttcttcagcttctgcaactcctgggccgggtatgtgggtgtttagttctgtggcaaaggactccagctcgtgtggaacacccaggccatcaaggtcagaggcaatgagaattaatatgggttttggttcactctcacgagatccacttcatgcttttgagttctagcttataatttgtttcacccactttacatccatcttctcttcccaaatggctgccttaaatatatttcttttatgatgtcagtcagcatgcaatcaaagaagcagaatacacacacacacacacacacacacttctgcttctctgattgtatgatgactgtataataaagtctttattatacagtatgccctaaacatacagcttagggcactaattctcaatatttaaaactccatgtcttatttggataagcatacacacttctcctctcctttcccttttcaccagttatgacagacccttcttaaggaaacatgcccattaggatgaggaatttctggtctggcatagatatagcgatagcatctgcttttgtagtttgtattgtttaacatgcaattactttcattttttcaaatataacattatatgataacgactataaattttcaaattaaatgcatccacttccacttttttgtttgttttttgtttttggttttggtttttttgcgacacagtcttgctctgtcgcccagtctgaagtgcagtggcatgatttcggctcactgaaacctccgcctcccaggttcaagcaattctctgcctcagcctcccaagtagttgagattacaggcatctaccagcagacctggctaatttttgtatttttaatagagacagggtttcaccattttggccaggctggtcctgaactcttgacctcatgatccacccacctcggcctctcaaagtgctgggattacaggcgtgagccaccgtgtctggcacttccacatgttcttaaatgttcatccttccccactctttgcccctccacatgactctttttggagaatgaagattagacatacaggtttgtctaatcatacaggtttgtgtgtagaaagtcttaagagatcgtaattcactctctaacacccaaaacaaaccagataatctaaataattatagtttaaaaaaatcggagatatgaaagcacaaagaaacataggtgaactaaacttcagaaagggacaatcattcaattgagaggaaagagccacagttctcatccctgactgaagtggaaagaggaggaatcaccataattaatggtaaggagaaagcagcctaactttcaacatattttaaagtgtgtggctgatgcgacaggttagaatacacaggagccacaggcacagagcaaaaccatactacctcgcaattatttctcattgatattcactaactcctggggtaggaccacaaaaacaagggcaatacagagttattaaaactttcagagacacattggggtttcagctaagaaagacttgtagagggacaagagagctgaaagaaaatccccagcactccaggctgtcagctaagaaagactggtgcagggaggggagagcaggagcagaaagatcttcccgtaagacctgaagctagggaggacactaaccagggcagaaaaggtgagaataacaactctaagacaatatttgcttataggaaaagttctaatcctgccttcaaaatatttgaagcctatagtaaattgaatcaaactaaagttgaatcaaagcccaaacccagcccaactccagatcatatcaactgagccccaacttccttcttggaagaaattttttaaatttaatttttaatttttaaatttaattcattgtctactgtatttttacataaaaatgtccagcacacagtaaaaaaatatggaaacacacagatacatataaaaaaagaaaatatgggccaggtgcggtggctcacgcctgtaatcccagcactttgggaggccaaggcaggcggatcatgaggtcaggagatcgagaccatcctggctaacgcagtgaaaccccatctccactaaaaatacaaaaaaaaaaaaaaaaaattagctgggcgtggttgtaggcacctatagtcccagctactagggaggctgaggcaggaaaatggtgtgaacccgggaggtggagcttgcagtgagccgagatcgcgacactgcactccagcctgggcgacagagcaagactccatttcaaaaaacaaaaaaagaaaatatgatctgtagtcaaaaaaggaaaccatcaggccgggcacagtggaacactcctgtaatcccagcactttgggaggccaaggcgggtggatcacgaggtcaggagatcaagatggtcctggctaacagggtgaaaccccgtctctactaaaaaatattaaaaaattagttgggcatggtggcagtcccagctactccggaggctgaggcaggagaatggcgtgaacccaggaggtggagcttgcagtgagctgagactgccattgcactccagcctgggagacagagcaagaaagtaaataatgaattacataggcttaacggtaaattggaaaaaatcagaggaagaaaacttagaaagaaataagtagaaagcgttcaaattgaaacaaggcaggtgtggtggctagcactgtaatctcactttgaaagctaagacaggaggattgcttgagaacaggagttcgagaccagcctgagctgatctcaaaaaaaaaaaaaaggaaatacaaggaaataaaacagagtatttgagatacatggaacaataatatatggtctaatacttgtattaagaataaaaaaaggaaacagaatgggtgtaaaaatattcaaacagataataaatgacaattttctaaaactaatgaaagataccaacccacagatccaataactgcagctgacatcaaggtgaataaatgataaatgcaaagaaaaccactcctgtgtacatcatagtcaaaattctgaaaacctaatttaaagagcagatcttaaaagcagctacagaaaaaagtgtacactgtacacaggggcaccaaaatatgtactacaagtgattttttagcaaaatatgaagtcagaagaggaatgacatgtttaaagtgctgaaagaaaagaaaatgtcaacataaaattttacgtacagtaaaaatacccttcaaaagtgaacatgaactaaagacatttagaggcagacaaaagctgagagacttctccaacaaacagcacacaggctatgctgagtgaagttcttgaggccaaagggaagataccagatggaaaaccagatctgcaaaaaggaataaaaaagtactagaaaggataaatatctgggcaaattaaaaagagacatactttaatacattcattatatgcatatatttacaaatttctaaataccataaaaatacaatgtaaaatgaattttataacatatagaagtaaaatataacacaacaatacagaggatgggagagggataaatggaattacattgtaacttttttacagattcataaaatagaataatattatttaaaggtagcctgtgataataacatacgcaaattgtaatttctaaagcaaccaccatatttaacataaagaagaaaatctaaaaagacaatctagtaatttaaatggaatatgaaagaaaaaaatccaatttacccataagttctcagaaaacaaggaacagagaaacaagcgacaaatggaaatgaatgaatgagaaaaacttccctcaaccactgttattgaacactgaatggctctgcaaataagcttttactacagactcaataatgtttctttatgaatttaacctaaaactacaaggcaaaatagagcttatatgcaaaacttaaactgcagtaaaatcattttgacacaactaacattgtttgaatcacaaataatgtcaagctgttttacacacttctcatgctgtcaaaagttaaaacaagaagcaagatctccattccaacacaaatttgcagcagttatgtttttctgaactcaaactacagtaccaacagtgttttctgaatttcaatgcaagtgcaaaggaaattttcatatttaaaatttacttaactgtgcaactgagaagcttccatttaaccttcaactggaagtgattaatctgcaatgtaatggcatgctaaaggggaaatatcaagagaatttatagaattctaatagaattttagaaatgccttctaagcaatgaatacactcaagtaaaatcatgtgctcatgggttggtatcagtatttggcggtatctgtctgggtagaaagacatttcaaaaatgaagtacataaaatctcataaaaaatcagcattaatagatgaacatctgcagtcaatttttatgaaagaacactttgaacaccaagtgaaatgttactttccccccaaaagaattccatgcctttcattattatacctgtattaaaattgctattattacactttgaattgacaaaataaaaaactgtggacttttttttcttcgtgttatataagtatctacctgacattctcaattttgtctcttggcccacaaagactaaggcatttacagctgggccctttacagagattggcaacccctggtctaaatgtagtttttgctacagttgtcaactatgttttttgctttggaaccacaaacattctacttcaaactactacttctatgaatcacttgtagacgttgaggaggagttaggaagaaaagtcgagaactaatttagtcctggggttaaataataattgtagccaacttgaattgagcacatatattgtgcagctctctgctaaggaggcatttgtatatattttcttatttaataagataatcttatgagctaggtactatttctccccattttacagaagcttagtgactgtgttgtcagggatcacattgctaagtgatgtggaagacataacctagcaatgggacatctaaaccaatgtctgcaacatcaattaagaaaagcaaaagaggccgggcgcggtggctcacgcctgtaatcccagcaatttgggaggccgaagtgggtggatcacgaggtcaggagattgagaccacggtgaaaccccgtctctactaaaaatacaaaaaagattagccgggcgcggtggcgggcacctgtagtcccagctactcgggaggctgaagcaggagaatgacgtgaacccgggaggcggagcttccagtgagccgatatcgtaccactgcactccagcctgggcgacatagcagactccgtcttaaaaaaaaaaaaaaaaaagcaaaagaatacagaaaattgttaaaggggagaagggggtggtcaaaggcagaggagtcggtgtggacaagacagagatctcttggagagagggcaggactaccagttgacaaaacctgttcaggttcctggaggctcacaaccaccagttcccatcatcccagcaacagcactctttcccaccctagcctcgttcgtaatgatctgatcaatgtgtgaacaaaaatattgtgtgtacaagtctcaacacatttgataatgtgaagaggtgaaggaaagtgggtaggaaaaatctgtagggtggggagactcggggaaatgtgtcctggtccagtgcaggtaacatatatgggtatatatgcgtatatacatatttataccatatttaatatattactctattaagaaattataacaaatttccttttacattacacatccacatattaaacccccaatatgtgctaacaaggttagaatttaagtataatgataatgttctcagttttttgtggtggacactttaagagagtgtaaataataataaaaataatagagtgatcagatcacttgtgctcagggctagacccttcagccccaacggccttaacccccctcaactgcttttccaaccaaatattcctccccctgcaggatcccagggccatccaatcaaccggccaatgacggtttcagagaagcggtcctggggaggggtattatctgcaggaacacgtcctgccaactttgtagtcgagtcacctatttcggttggtagcggccgctatttctttaaaagggcagtggatttcgaaacaggagggggaggtcaggaaaaggaactcagctgcctttgataactgccctgcagccttcccttcccggagcgcgtgctcggctcgggaagcgcccgcggccgccgcatccccgagcgggcgcgtggcgccacctctttccggggcgcccaccttccccgggaatccccccgcccgacggtcccccagcgtctgcggcgcggccgccccggctttgtctccggcgtcgcgctcgggcgcccgctctccccacatttccccgtgtgcaggctgtaacccgatctcccatttcctggtggattctcttaaagaggcagcggtcgagaagcagaacaaaggctattgttttatttcctccttcggattccgcgtcctaaccggaatggcccttcatagataattactttcgttgcatctgcgcttagtgaaacgtttcaaaacccttgtgcacatcgatgtatccaagagacggagccaggggaggtgggaggagtttaataaaacctgttttgtggtgtctggggccacaatgtaacgttttttaaaggtgtcttccttaagcccggaaattggctcggccagcgggaggtctcgcggcgtggagggcgggcgcccgcaccgggggccggcctggggggctgcgccgctcgccccgctcgcagccgcggccccacgcggccccgctacccgggtttcctccgcccgcgcccccgcggccgcccctcccccgcgcagcttttatttccccgatgccgggctgtaacccgagcttttatttcctggtggctcctttaagaggcagagctcagtgctgggaattcacgtcagtttctgcactgaaactctcaagatcaatgagcaaagagctttctcagttctgcctttcagtttctctcttccaggaaggaaaacattcgagagagcgagggagagccgcgggagggcggggggcgggggcgccggctgcgggtgggaggagagaccgggaggccggccgggctgcgtcccgggtccccgcgccgcgccgcgacctgcagaccccgccgccgcgctcgggcccgtctcccacgcccccgccgccccgcgcgcccaactccgccggccgccccgccccgccccgcgcgctccagacccccggggcggctgccgggagagatgctggaagaaacttcttaaatgaccgcgtctggctggccgtggagcctttctgggttggggagaggaaaggaaagtggaaaaaacctgagaacttcctgatctctctcgctgtgagacatgtctgagactcctgctcagtgtagcattaaggtaaaaatcttctcccctccttctacgtggtggaaaccctgagctgcaccggccagggcagtcgtgctgggctcctcagagcaggctgttgcagttgctctgttcgcaggaaattatttggggcgagagggaaagagatgcagctcgcggtggctgctgtaccctttagcgtaaccttgctactcccccccaccgccgagcccctgccggctcctcggcccccacccccttgctttttgacaatgaaatgccggtcacaattggtcagagcaacccggattgtctccagaaccgtaaaacacccccgtaattagtgcgcttaaaaaaaaaaaaaacaaaaaacaaaaaaaaaaaacctgctccctattcctacacccaacatgtgactgaaatataacttttgttcccgaggggtggtcgtcttagaaaaaaagttgttcagtttccactgcgatagaatctttttatttttttaaaggactctctgggtctgatcagacaggatttttttccccctcgtctgattgtaattgcaagcgctgtcggagagacagtcctggtgtcagcttttcctaggcattgcacaatgaatttttttttaaaaccaaggtgaataaagttgctgaatagttattttactccgatccatatgaaagttgagcaatcccaaagtagaaaactcctgtgatggagggagaggaagaactaagcaaccaggcaaaatgaccttctgtgtttgacagtgcagagaggctatctaagcagcactctgtaaatgcagggcggtagatgtttgtaaacacactgctgggctacccagtagttgtgtgtatgcatgtctatatatctgtaaagactgtggtgctgcggtttgttgcttctaaaaagttgttgtaaagtttgccaccattgggaggcaggatgatttatccatctacccgtgttatttttcccatcgctgcatttattgtacactttattcatttcgctgttccaccagtacccaggtagaaagccttccgctcttgtgagaggctgaagctgctgaagtttgtttttggtttggcctatttaatgtgtgttcactgaatggacactacagcaacaatgaacaaataacctgttttcttcgtctgtggggagttagaaaaacccttcctggtttaacactgcctttcaattagagtctgtgtaggggaaacgcagtagttcatcatacgtgcttactaggttttttataattagaatcacattttggtgtttcttatcagaaaagatattcatgggtttgaggataggctaatgtgaaatcaaaaggtggtttgggcttctttgtttttgcctcacaaaaatgcctaatggaacttttaggcttttgtgtttgtacataactggaggtagcagtatgtatgtctgtgggcatggggcgtgccacactaaagaacttagggtactttgatattaatacttcaaaaccagtttcttttgcggtataaattagattctacacagagttcaggaaaatcctgcggtatagataatctaatttatttgacgcttcataacatagaggtaactaaatagtaggatattcaataaataaattgtatttggctcagtggcaataaacccgacatcaggaaaatctgccaactacagatcagtaactttagggcaaaaacaacaaaaaacaatgctttctgtgacgtttcttgatcctcttctatactgcatccccaccgttttgatgggcttatggtggtgtgctggctgcagactgctactgagtggtttgtttcattgtgctccagtcggaaaaagagtacaacagtcccttgccttactcacatacagaaccaatcccaagcaaaacgcgttcttaaatgcaacatgaaaattgtctgtaatttgcatatcatttttttccttattgcttacaactcagttctttcagggtgcctcttttcattactgtgtacttctatgtaattaaaatagatttaatgttctttaccagaaaggaaagaatcacttttattttggatcgttctttatggaacgagtatgtatttgcttagactgcatgtgtctaggtgaacgtatgtgaagagtatctttccatggagtttgtttaattcagtgttccaataataagcactagagatcaaggactgggattattccaggtcatctgaaatgttctggtgatgtgtgctgcgtttcatttagtccttgggatgtggtacggtgactgcataataaaaaatgtttgctggtaacccacaagcaagttgcttgcttctagagtccagtaaacaatatgcttttctgtgtagtgaagaacgaatgtcagaggttttcaaggatgagctgatgaacctgatataccgaactcctgtgacacaaaaggctctcactgtggagaggtttttcccagtcctcctctccactcctgaaaccgtcctcacttgctttcattccttacaagtagcgggtcagcaggcagacagttcctcagcggctggtgagatgcagccacagagggaagtactttgtttatttctgagcagtgcctgctctgctagaaaagagtagtgtccgatttgggtggagtttccaaggtgaaagtttctgaattggtcaatcagtgacgcctttgtaaagatggctcatgtggtggtcgctcgcaatgaatgcctgataagggcttttctgtttcttttgcactgtgtaagtttgctcccatcgcctggggaagttaatatcagacacacactttttacggtagaagagaggttgactactccaagggcactgaaactctcactgagccttattgtttctctacacgcgacttgcagaaagcaggagtgctcgagcactcctgggggggtctgtcctacaacccttgaaggttgtggcactgttgtcatggaagttcaaatgcttcaattcctgaccatttggggtcgtttaaatggaaggaaaggatcaactctctataaaaagtcaaattgttttaaagaggattgcctggctgactgtgctggtcacaggaagaaggaagaggctgtcttttccatcatcagccttcaccttcaagtcacctcttcagttctaagtttgaccaagttgcagcggaaggtggttgtggcctagcagacacggtcccttgtcaggcttggcacagcttgttagtgggccaggactaaccagaatccaaaaacgagtcacacagtgtctctagtcccctccttccctgctgtccgtatcagtcagctttcatagcagaaggaaatctggtttttaaaattttgctactaactgggagactctttcgagctccccttctggactctgggctccttgggtttagtgatgattatcttggtgtcctagtagttagcttggcagctggcatagaaatatttctcagtaatgtttgctgatgtgaatgaagtgagaggtgggaggaggccagccccctttcctctttctgtctgcgtgtaacctcagggtgacgtaacactttcatccactggcttgcttgcagaaagcactcaatagggcccactacagccttagagagggctagagcactcctggggggtctgtcctcaaatgcttattaatagaattttgatacaataatgttttataatttttttttggagacagagtctcgctctgtcgccagactggagttcagtggtgcgatcttggctcactgcaacctctacctcctaggttcaagcaattctcctgcctcagcctcccaagtagttgggattacaggtgcccgccaccatgcccggctaatttttgtgcttttggtagagatgggggtttcaccatgttggcaaggctggtcttgaactcctgacctcaagtgatctgcccgcctcagcctcccagagtgctgagattacaggtgtgagccactgcgtccagcgtaatgttttattattttgataaaattctcaaaaactgcttttgtgtcaaaaataacaaagaaggaaattgaggaaaaggtacaacaaaggggcttaaggaattgctttaacaggttcagattagcaggcttctaagtgccccccagtttttctgacaatagaatcagggaactttcaaacattcagagttgagagaccttagagatcccctgggccaacctcctctattttttacagggaggggatccagagagctaaggggtttgcttcaacccatgggtgagtgagccaggtttggaggacacaggcctacaggttcttaggccactgcattctctgggttcatggtgtgtccctataaaaggccaaggaaactcgatataataggcttcgctctctctggcacttcctagcttggtccattttaatcacaagccagctggtctgagggcacgggggtatgtgccaaggaagatggtatgtgggggtagaaatgggccactggggtctggtcaggtgtgagaagaggaagtagtaggagggaggagatgagagaagaagggcctgacggacttgtattggcaccactatttgcatcaatatatgtatatatatatatcttttacagtgcacaaaggcctgcaagttctgttttgggctgaaggccccctatctgctgttaggactcctttgaggaatccttgggtgggccgtaggctcttttatcaagggtcagacaatcctatttatactttaatttctgtgtagtaagctccctgtttcaaacagtcaaagctaaaaatgtggcagctggccctagagaagtagctatcctgctcaggataagtaagtcaagggcaaaaaataccccagatgtgagcaccagaggcaggtagagctaagtcacattctgctcctctgagtgcagctgtatttgtgcacaccaggaaagagctgggggcaaggtgggggcacagggttgctgagagtaactcacacagcagtttcatttttttcaccaatttttaaaacttgccctttggtgtggatctcccagccaagtgattcagtgtcagatgaagccccgtaaggtgtgccatatagaaatgacatgtttgttctatgtgaatactactttagagacaatcctggagcttgttttcaggtaagggtccaccacttccatatttgttgttagatgtgtgttgggaaccaatctccgtgtgtatttgttgaatagaatgagtgtgcatttactcagggttcccacgccaaaagggacccagcttaaagactgttcactgccaaacctagtatttggggacagaaagactagactaaattagtaaaaagttagaattatagcctattaaaaaacaaacacatttttattgattttccaaacatacaggaaccaaactaataaagtgttgcttactggggcatctcagggaacgttccaatgaataggcaagaatgtgttccacattatccattgggtagaaactagtgctacgatgtgcttggaactgttcctttagtgtcaaaatattaccacacattttatttgctctgttaatttgtttgataaccttttcttcttagtaaaaatacagagttcagcctggtcgttgtctaaatgatctggaattcccagagtgtggacgaggggcttgattagaaaaggtattgccccgtgttaagtgtggactctcagatgagcataactgctcactcagccctatggatttcgcttacaggaaacggtagaatgcttgcatttctgaaactttgtaaattctctgtaattaaaggtgttcgtctgctgttttagtggccgttgttctacaacaaccagttgtagcttacagctatatagtgatttattacaaaacactttcttcttctccttttccttcttcctcttcctcctcctcttcttcttcctcctccatcatcatcaccggcatcatttattgaatgctactgcatgctggtccttgtgctgttttatatacattatatacattatctcatttactcttcacagctctctatggatgcagtttttctctccattctacaaatgaggaaactgaagcccagagaggttaagtgatgtattggcctaagacctcgcaggctgtaagtggcaaagctaaggccagaatctctactgtgggactctaattccaaagtattttctatgagggcattccaaagtgcagccatttttgcgaagaaaattaggaaacttgaagtgacgggtggctggtggattgttacataagccgagatgagaggcaggaatagagctggcagaagtgcttgcagaggttctgaatttcctctgcttcctggtctcttctgaagatgggtcttcctagccattacacaagtagcggggacaaccagatggtcacacaaagccaccacccactgtggaatgaatgtctaagttttccatatttaccccagtctctaatgtcctctggtgaaattttgtctttgatgggtttcattttgggcccttgttgtttttctcagatgcctttcttttccttgtgtttttcttgcttcctccggtgcttaatggcttcttcatgaagcggttggaaatctgagagattgtgtcatcctgcccggcctcgggctagacaccttctttgcctgctttttacttcctggtcagttgcttctccttatacaacttttttttttttccttttaaagcttttcacacaatccataaacacaaatttttgtttttcttaaaccatctctcatgtacatctttaatattatgtgatttccaggaatctatttcagatattccctcattttcccctataacaaaaggaatcatctttttttgactcctgtctcgatggcttgacccaactcgcctgttctaatttcctggaatgaagagagcatttcggccatctgactttatacatttctgattttgaacgactctagtgaagagagtcttcagagcaaatgtagggaaagaaacagagaaagagagagatgtgttgtggagataatatgaggggattcagagagcattatccaaatttgtcatgaagcaaatgaggaaactgagtcttgtggcgtttaaagagcttgcctgagatcacattcctaactgatcaagccagagtcagaatcagtgttccatcctaggtccatgttcctctaacaccatagcagaggaaaaatgagaaaaaacaggcaagaattcagaaagcatagcttccttttgaagattcacatgacatattagtgttcatcattgtgacttccaagtgaaagacagagttcatgttatgagatttaagaagtgaagaaagaatgcaatgtattttggaaagatatctaacaaaaatggttggcataagaataatgttaagttttaaaaggctaagcttcagttacgtggatgaatgatttatgaaaagtactcccccatgaagacacaaaagaggtagccaatgcatctgcaagttcttgaggcctgatggcctccctgggggtattttccctttgtatgtgggagtcagatatacggaaaacgacttcatttcctgaatgacccaaaaaggacgcattgccctgctgagtgccagttggtgagtgtgctcaatggtgttagtgttgccacagtgtagttccagtcaccacgtctttcgattttgacttacattttcttctgtcttatgttgttctttggttcttacctgtaaagctgacttcccttcaggagattgtaaggtgctcagaaaagggctttacctcactgccatgctgtgaattctcctaggggaagagtacagacaatggagtagacagacccatgaatcctggttcctgaacttgaacttgttcaagctacttaatcatgaacctgttaactcatctgaagtggtaataaaaatgtgtctcttagggttgttgggatatgtacattgcccaatgtagtgctttatactgttaaaaagttagttctcctcctcctttatacatcctccataacacatggatctggaagaggctagagattttctggttctgtgcccacattatacagttgagaatacagaggccaggggatggtttgtttttgtttttgtttttgagacagagtctcgctctgtcacccaggctggagtgcaatgccgagatctcagctcactgcaacctctgcctcccaggttcaagcaattctgctgcctcagcctcctgagtagctgggattacagctgtgcaccactcacctggccaatttttgtatttttggtagagacagggtttcaccatggtggccagggtggactcaaactcccgacttcaattgatcctcctgcctcggcctctgaaagtgctgggattacaggcgtgagccactgtccccggcccccggccagggatgttaatggccttgctcaagctcgtgtggctagttggtggtgccatctgaactaaaatctaggcctcccgagtcagctgactccctgcacagtgctcttgtcactgtcccattgagttgttcacagggctggggtcactcagtcagtgctcaaaaaagctcttattttaactttaattgaatacaagcctcaacaataggagagatgagccaagtgcaattatatgataatagcaaatgccttttgcatcttacagcagaattttgaaggaatagctaatgtggttctgaataagtttccagagatgaaagaaaaggaaaaaacctaagtctggaagtactgtacagtgagtctaactagcattattactcagcgctcaagtatttgaacctattcagggatctgctccttcatacagttgcttattatttgtgactggggtgagacttgaaagagagcatcaattctccagtctgcttttgtttaacaggcagttccatgtctgtctgaccacagaacagacactgtttgctgtgggctggtgaatgttcactttcaagagcagggagtagatggcccttcgtggaagtttaattatacagaagagtttgaaaaggccaagtttgttactttggggcatggggaaaccttcctctctagcagatgtgaggggaccgaagtgtctcttttcagcagttgtattcttcttgctgtggacctaaattcgatcctaagtcattctttgtatgtacatggcagatgagaagatgaactatagactggaaaataacccttttttgaggaattgtggagaaaatgttacccacctgtccctcctaccaccatgcaataagtgtgggctacttaatactcttgaagcaagagtttaggtttggagagaaactgctcctctgatcttctcctggaaaccacaagtggaagtttgtgattttcttctcagctgccctgtcccctctcccttgggttatgacaggccgtgtaactttatctttcttaggacttatctctttgatgaggtcagtaatcctgcttcacttacgtcccctatacgtaagattgccataaccaaagatgacatgcagactctaaagcatttcctggaaaaaatgagctacagatagaagtaaggctcgtaatttaaaaaatcgaaccccagagaacagcctgtctctgaagttaaccattcccccagtactttctcttgtttccctggtgaaagtgtgaatctgggttgtggcaggggaagttctggcactgctaagaggtgaggaaggaagagggagggcccagagctgcccacctcacttgcaggtgtggcctggaagagtgccggggtctctaatgaagaatcaagttcaagggatgaagaggagttggcgaaggggcacaaaaatacagctagatagaaggaatgtgttatagtattcattagtataatagggaaattagagttaacaatttattgtgtatttcaaaataactagaagaattgtactgttcctaacacaaaagaaaaatgtttgaggcaatagatatgccagctaccctgatctgatcattacacatctgcacagatatcaaaatgtcacatgtacccccaaaatatgtacaactattatatatcaacaaaaaaaatcaaagagacaatttagaataagtatggtctcaagcctagtgactaatatgtggacaagtagatctgcactagggtatacaggaggaagtattatggagacttcataaaaagggagatggggcggggcgtggtggctcacgcctgtaatcccagcactttgggaggccgaggcgggtgaatcacctgaggtcaggagttcaagaccagcctggccaacatggtgaaaccctgtctctactacaaaaattagccgggtgtggtggtaggtgcctgtaatcccagctactcgggaggctgaggcaggagaatctcttgaacctggaaggtggaggttgcagtcagctgaggttgtgccactacactccagcctgggcgacagagtgagactctgtctcaaaaaaaaaaaaaaaaaagggagatgggggacatggtgggaatttgctaagctcttttgttaactgctttaaagaactcagactagggaaggaaacttctctcaagtttattgctggttgttatttccagaccatttgtctttcccaaactgcccttggccatcaaatcagactcctgctagagtaagcctcatggtagtgtctcttggctcacctctgtggttttgctaattattttcatgtattgacctgggatcacagaccaggcacccaaagggacagaggtgagttctttttctttgggcctctttggatactcataacccaagtccctgtgacaggttttggaaaaatggcacatctgaaggattggatccgtggtgcattttgtaattgctgtatcctcttttctttaaggtcttgctgtgtcacccatgctgaactacagtggcgtgatcatagctcaccgtaacctcaaagtcctgggctcaagtgatcctcctgcctcagcctctggagtagctaggactacaggtgcaccaccttgcctggctacttttttaaaaaactttttgtggagacgaggtcttgctttgttgcccaggttgctctcagaactcctgggctcaagtgatcctcccacctcggcctcccaaactgctaggattataggcatgaaccactgtgcccagccattttgtcctcattttgacttgagatctgggagattttaaagatccgtgtcatgagttcacttgactggtgctttgcacttttgagacccgtcactctcctgactaataggtcttgacggccactaatggccagcaatggctgggaacagcaggacactctcactttgtaccttttgatctggtctttattcaaagtggggtgaacccagtaggagagttgttgttttggggataaagtctgggtgacagattcttcaggctgggtaagtctcctgttctccccgactttgagacctgaatgacctgatttggctgactacacctccagtcccctggacaacagccagctcctttgattttgtgccatttagtccttcccttcatctgctgacgctgatactttcgggtgaggtggaaggagagagcatacctgttggtgaggtaagagtgttttccttcagagaaccaaagaaacaaaggctccctttctgaattttgtgttctgcctctttgcatttctgaggctccttgtgtctggcagggctgtgagtgaggagatgagggtgtgctcctctgcaggcagaagtcagctgtaggtcagatgtggctttggaacacaatggaatccagggggaatgttggcgagcacagcaaggctggggtgatgatcctctaatcttttgcagcgtgctgtaagagtatctttaactttcgccgagacaggcagggcaatgagcaaaaggacctcggtgttaggtaacatctcaagtagggcacctggtagtacacctgtcttgcatgttcccacccttcccaacactttatctttttgaagccatctacccttagaaaatgaacaaggagccactgacatagacagcaagtatatttacttatcttttgggtgcaaggcagtttgccctgctgggagagatgtgggataaggccccagagtggaaaaaaacaaaaaaccttaaaaatgcaagaaggaagaaaggtaggtgagccagcaggtcccactgaaaggccttgttattgcagcaaagagggaagaggtgggcccagtggcacaaatcactaacattcttctgacagtcactagccagttcttctgagaatttctctgtcttgaaaaacttggtaaaatggccaaatggagcttctccgaactagggggaatgcctgtgtgtgcgttcgttgttagccatcatgttgaacagtctgatttaagggaaagttggtctgtgtacattttcatttcagctgtggtctttgaaggttcaccatggaggaggtgtgggtggatgagaatagagtcttctgcctcttggttggcttatatgtaggttataggtgaatgtgagttcacaacccccagcctatttcttatttgggtgcacttttggatgacttgcagggctgagtttgggaaaacccagttactcttcctttatgcacatatttctgccagactaaatgccaaatagataattggaaagaattttcttcgcagccctggtccccaaattggtgtctgtgattcttcctagggtctcatattatgagagtgcactccctttaatcttttgggacctcaagtggggtctgtgtggacaagattgtgcttctttgagaaacttcttgctgcacaccagccagggtaaggcaagagttagtcctgttggctgggtggttcttgggcagttgagcatgcttagcacttgagaggtttctgttataccatttgccaaaagggacatctctccgctggtcctagtgccccagggcacaaatggcaggctttaggagaaaatgcacaatttcaggttcagtctctatctgcatttgtgtgcatgaatggactaataattgcagtgcgttgaacgatttctgcatattccaacacctagaaagtagcttcctggattagggaacggttcctaggtacagctaccaaaggctcaagcttaagcaccaacactggaggttagaattagcacgctctagggaggacagcgagagggcagctgacacaatgcctttatgggctatttttagctttagtcaggcctatctggagtggcttgtgctttcttgggcaccgtcctgcatttattccagggtttgtgcttgtgactctgtttgcatatatgccacatgtatcgcatgctcatgggatgataaattgcagaaattatggcataatctgttttctagcatatagaggaaaagattacacaaaatccagccttgttgtggcgaagaaacctaacatatagatgtaaaatatatctccttggaggcctggctttgtgatgggctatgaacggattgttaaacagcaatgtgaggggctgttagcaagctgtttctaagagcatctccctggtctggtctgaaaaggtgatgtgtacatattgtacatttgagatagtttgcctgtggtgtttatatgttggtaggttgtgtgtgtgtgtgtatgtgtgtgtgtgtgtgtcttgtctgtcttcagtggtgaactgaaaaaataaagtgttgtttacgtgcttctatgttagtgtctacattccaaactgggcaatagttttctttaagctggcttaagtgaagaggtgtttggtcagccacagggtatgaatcaaccaaacttcaaaaagcttcagtgtgtttttgataacactcttaagtatttaatagctgctttaaggatttgtgccttagtgtacttggatgaataggtaaatcacctccccatcagcaaactagcgtttgggttcccacgttggcaaagcagggttcctgttatgtgtctggtcatatttgaacttcttttcacattcaggtgacatagttgaacatcagtccgtgccagtttctgctactattgggtttttaatggaagagaactctttcttgttactacgatgccatgcttctgctgtgttagcagctgctgtattgaaaaacaggtgtctcttataatcctctgactggatcagtttgctagcctggcagagtcttattgttattgtttttatttatttatttttgtcccacataagtcagaaactgccaagagatgttgatgagtgggattagtatgagaggagatggcagcttttcttggtggaggtttctgttacaagaatctaagagtcttatgaagatagggctaaataaaaccaggatacgaaccacaggggagaaccgccaaaagaagggtagtaaatgaatggttctgtcaagtcacctctctgtcattcttcaaaggccaacttaaagccagcactgccacaaaagccatccaggactaaggttagcgaacggtgacccttgtttggtccacgatgcactaacagactcttccccttgttgcttcttactgctactggaatggaagctttgggagggcaggtgtgccatcttttccagcctgccaggcagtctggtgcatactcgtctttctcctccataccggctgtcactgccttccttctggccccagacctttcagttgtctcctctctgatcttccttcctccattttgtccccacccccaacacaacttggaatgattctttgcagataaaaatgtgatcttgttactctctgtctcacaccacagtaccacagtgtagcatgaaccacagcttcttgtcacctgcaaggccctttactgcctacctttctagtatcatctccacattatgttccaaccacataatgaacttttttctcaggaggacatggtctcgctctgtggccaaggctagagtaatctcagctcactgcaaccactgccttctgggctcaggtgattctcccatctcagcctcccgagtagctgacaccacaggcacgtaccaccacactaggctaatttttgtatttttagtagagacagggtttcaccaggctggtctcaaactcctgggctcaagtgatccgcccaactcggcctcccaaagtgctgggattataggcatgagccactatgcccatcccatgtaacaaacatttatgcctggaatcttccctcgatcttctttctgcctggcagccaatttgtcattggaagtccatttctcaagcctccctgttgctgctgggcacagtgttcccccagcttattgaacttgcttctgttattggcaacaatccagttatccttgaattatcatccacactagactgaaagcctgctgaggacaggagtctgatgggttcatttttatatttccagtgtccagctcaaggtctggcacagaggacagccaatggctattaattgaatagaatttcttaatcagtaggtatttattaagcttctgttacggacttaattggtgccaggctctttgatatgtaagataaagacctcacacagttgacatcctgagcaaatactctgtgagggttgaggaaagaagaaaggtagagacctgtgttttgaaacatatcaggactccatgtcagggcgaacatactgccacctcccatacctaaggggctcctgtgaggcataagtactgacatgtacacacagggcactcacaaatgctctccttctcagttgcctactttctagaggggaatatagatagctggagaagaagcttgagaaccttcaggctggatgtgccagaaacagcagagacagcccaagataaatgaatgtattaactgatcatccttttttttgatgtggctcaggatgcctcttgggtcagggagagagaaccagtggctgtttgttgtagctgtgtgcggtcttggccatagctggctgtggtatctgggacccagtggcaggtcaccaccgtatggggctgccagttgctcccccaccccattcctctaagagctagtagggagagagaacccggaagagcagcacggcttgctgaaacttctctgaggtctgtgattggcctttccatgtcaagggaagaatccctctcttacttgagtcagctctttccagtcttctcttgtacagcccatgttctctcctaccctatctgagatgaagatctctctggagctctcattttactcctaatgggttgcctggagggactaaaccagtgagaatgactgggcatactatgggactagaaaaacaactcaaagttatgtcttacggatggtaggacagcctcaatattgctgtttacagtggatagcccagtgacatttatttaaagagggcagtcttaagagagtgtgttagggttatgaatctgattaagtgtgatctgataagtgggaaatggaccacttgggagaaatcaggttactttcagatataagcagaccaaactgggccttccacacaagcctgaatagctcgttttctccctatttctgttgccattgaggtacagctgggattcagggcattaggatatgtgaaaacttttagcttcctgaacccaaccagaccccagcaagagtccttttacagtttccccgaaaccgtcacaagttttcctgaccgcctgctgggggctttctgttgcagacctacgcggcagctgcctgccagccctgccagatttgacttcatcttggctgccggtgggtcagtctccacgaggcttctcttggcctgtctgtccactcagggcatttaagggtcctcttgctttgctcacatgggctcctcgagggcttgtgcagtaggttgagagttgttacgggtgctgatctggaccacttagggagcagaaagcataggtctgtatatgaatgtgaaaatacacatttaagaagctgctcaggtaggggcagccacggaagttgtgctccctcttaaacactcagcgtacacacctcatcctcagacaatgtgctgcttacatttccagtgtccagcacggtgcctggcacagaggaaggccgatggatagtagttgaacagaatttttttaatcatcaggtctttattaagcttctattatggacttcaagtttcctccatgaatgctaccagaacccttgctcaatgtcttcactgttgaggctgttgagtgagaagccatttccttccccttctacttcccctccctttacagccttaccaggcccagtgttcagaggactcgatgctcatgaacctagggttcctaagaattagcatgtcacaatctaatctggagactatccgccatttagttccatggcggattatggtcttggttctagcaacctgctgaagaacaaacctggtggtttattttcttttttttttttttaaatggggacttgccttgtctcccaggcttgagtacggtggcatgatcatagctcactgcctcgacctcctgggctccagcgatcctcccacctcagcttcccaagtagctgaggctacaggtgtgtgccacgatacctggctaattttttttttttttttttttttttgagatggagtctcactcggccgcccaggctggagtgtagtggcatggtctcggcttactgcagcctccgcctcccaggctcaagcagttccttgcctcggcctcccgtgtagctgggattacaggtgcacgctgccacgcccagctaaattttgtatttttagcagagacagagtttcaccatcttggccaggctggtcttgaactcctgacctcgcgatccacccgcttcggcctcccaaagtgctgggattacagccgtgagccaccacgcccagccaatttttaaattttttgtggagacaaggtctcactatgttgcctggctggtcttgaactcctggactcaagtgatcctccagcctcagcctcccaaattgctgggatcacaggtgtgaaccgccacacccagctgagaacagacttttgaactaccacaactataggtctgttggacattgttttcagttgaaattgcttaaaaattgacctgccttggagaaaatttcatgagccttttcttaaagagtgattgaaatgccaataagaatgcaataacaagtgccctgtgtagatgtgtgggagggacaccctccccttcctccacccagcaaaagctaacgtactttccaaattctaaattgtgatgtgtgacttggtaaaggacttcgcactgttttgttttttttttttaaattgatgtggcaagccttacaaaaggatatgccgttatattctaacaaattatttctatcgaaaagagtatcatgtgagattagggctgtagaggaacagcctttcaactagtcttctatgtggtaaaggtggcacccagtttccaaagacagcacagacgccaagggtcttttctgaacttcttcgatttttatgatccctggctgggtcggagaagggctagttagtatgtttttctttcttctggatgaaagttgcaaggacacttaagccttatgcttcagggcggaatctgatcacaagttgagatcaggaagaaattttccccctgtggcttcctattgcacaattgcccggccaggtgtgctacctctgttaaacaaagacacacacaagtgcacacctccttactggctatcttcagagcaggatgttggacgttgtgggccagcagactggttcctttggcacatccctgtgctcaaagatgggaggcagctgcccgtctgctcctgtacttggctgtcctctgggtgtgctgtactgagctcagggccacgtcttcagatccctacaactctttgcaactcttactttgtgggacaattaaaattaggtctaattctgtacacacccgcatgcacatgcacacatatctttttaaaagttttccttaaacttgcttcccctttcctgggctttgcttcccccttcccgggctttacaccacatcaaacctatatgcattcccaaaacatcaaaatgactgttcacaaatcatagtagaactctttaaccataaggtgcgcagttgccaatctcaagcttggattgtaagcgacttcgaagtctgatccaaaagactgtgggaggagggggaaggaacatggatggacttctttccttcctccctccctccctcctttcctcccgtcctcctgtcctcccttcctcccttcctccctccctccctccctcctttcctcctttcctcccttcctccttcctttcttcctttcttccctttcttttctctcttttctttctttcctttcttctttttgaggcctcggctgtgctgcctcttgtgcaataggataattaccagcgattcccaggctcgcctgcttttctgcctttacatctctatctcctgtggcgcagtacttccttctgcctctattattagcttacttagctttaccattcagttctccacctcctccccgggtccctccccatcttcttccagcctttctttcccttcacctctgtaaaggtattttggggagctaccattcatgttctgttcatacaggaaccctctttttctttattaatataaaataatcttggtcctgcctcattttatcatatattcattcgtattcccaaaatagaaaccgtcgccaccagcacgtaatgtctggcctgtaaacctttaaagtaggatgtgccgaaatgagatcttcacaagcaggtgtgcctcatcccctgacctgcaggcccttcttccccggcggccattcactcatcttcacaccatcttcttgcccttctctctgcttttcgatgattctaccccaatcacattccttcccaaaatgactgtgttagtacttaattgttcacctgggcttgttcatgttgtagttcatcgtttcctttttatctttaaaattttcttgttcttcggggatacactgtattcttgtaattagagattatatcagttttcatggccaaaatttgccacgtggacataatagtatttggtatcaagcacgcctttcaggaagaagggaaaaacagtagattttgggcagcttttgattacaataatttcaaatttctaataactaagaagtacttcatgtgattcttgtagagtaaaagcttaaaaattacccttttctttgtaagtgatatgagtcttacttcgtttgggtaagaaactcagtttgaggctaccaatttttcaaatagtggtcttagaaactaattattgctgtaatttcaataactaaataggcattcctattcaaacctttactcaagtagttatattctttaactatagttactcatttgtaacatttttcactgtaagggtagtgacatcctgtttgtaacacaccctgtcctgggactaaatggaagggattgaggaaattctgctggagtctaaccccaccatagggcagcagcattttaggaacaaaagcagagaagctcacactcttctgagtataactggggagaagatttagggaggtggcttgtaggatcagttttaagaccaggtcagacatacgtacaaattctttctttgtaaatgagaagtggcctttaatagctttcatatggatagatgggtagatgaaatattattctacctaaagcatgacatttcagtaagtactacactttgaaacttgccttgcagggttttaaaaatattcttttctgggttctaatcatttataacgaagagtcactagcattttattaaaacccatattttttggagagggatattaagtgagcagggattgtgggttgttcttgcttttccttaactgtcctgccccaaaaaagtgatgggaataacccaaaccttaaaggttcctggggctttctttttccctagacagggacctcctcctctcccctgctctcatcccacttgttcctgaaaaagggtaaggttggcagggcggggaagagagaaggaaattagggttctagcttaaaactgctgctagagtggctagttctgggagctttttgagagaggcccaaggtggcagccttgtctcttttgcctctttcattaaacctggggtttgctgtacaatgctttgggtctcctgtcccaaaaataaagggctgtggcaagtatcatcctgacaactatccaatcagttctgactgagaggcacttgtaattcagaagatagtcattagatttggatagaaagaaatgagatgtgatgttcagtagatcagtagggtgactatagttcatgttaatcgattgtacattttaaaattgcttaaggagaataatttgaatgtttctagtataaaggaaagagaaatatttaaggcgatggatataccagttaacttgatttgattataaatgtatcaaatcattacatgtaccctgaaaatatgtacatctaatatgtatcaataaaaataaataaattcattagaataacagaatttagacatttagagctatagttttaaggaatttcagaccaaggcccaaagctcggttaagtgacctactgaaggtcccaaggctattattgccatattagaactagaagtcagatctcctgactcccaccagtgtatattgacttttgacccagcagttagttttattttaggctgtattttcgaaataacagattggttcaagtcaaaataatcttattcgtgtgaaaaactcaaccaggtgaactgagtgaatgaacctactttttaattgggtgtttttaggtcatgtgaaaaaaaaaaacacaaatcagaaggtcctttgtgcttcatgtttggatctgatccttttttttttttttaagctgaaaatgaatgaaggatggtagagtaggaactaggatgtacgcataaaacacttgcctgtctgccttgtcacctgcactccagtggggtgtttccagggctcattgtaaggtgagaggtgacttctggacccttgactaccctgttccttctgtcgcaaaatataatcaggaggtttctatttgacaatgtactctgagtattgtaaggaaccaactcccaacccaaatcgaatcgcctctgagatcctattaaacagaaaatgccctgaacaccagtatatgaaaatgctttgctaggatgagctcaaagcatttcatcctccaaataaaatctatctgctcacacttagattgttcaaaggcagatggtaggcaattgaaacagagagacaagctggcaaaaggaaaaataaaaccacaaatatctgcacgtgaaggtgatttacgctcttgccagcccccctcctaacttcgttaacacaacgacgtagcaattaagtagcatgggaactcgggctcagatggctgatacagttgtcctccgttaatggggtgagacaaagcttgcgtataatatacagtgctcttcaccaaaatgcagagctaaaagagattttaagagataatcagcaacatagcctgtaaatcatgctgctcataacagacggccaccttactgaaatctcactgacccccaccacacgtgttaacagcagggccactgctctgaaatattagctattaccgagtggccaagtcttaagaaagggaccacttggcagtattgaacttcaaagtggaagtaagatccccttggggtgagggtaggaaggcggtgaacagggttgatcagaaccgtggaagagtccggagcagatgctctgtgggaaaccctgaattagccaagagcaaaagttatcgccatcctactgctctgggaaggctgcctgttggagaaaacctctgtgttcccttagccttttcactgactggaggactttccagacgaaatctggcacttctcagtaaccttgaacttgaacattcagtgacagaagggaaagggagagggtttcagctgctggagctgggtaactgtgcagggctctcgcagcgggccatttgtggctctgagggtgccaagctgcagtgttctgagggtgtgtgaatgagggtgttgatcctggctgcagaaggggcagctttctgagcaggtgggagtggtgaatgaggaggggatttggcggggcaggatgtgagatgagtttactctgctgggaaagaatttggagatgtccatgaagaagaaaatctggatgactattgagggagggctgatgttggagagaagggctcatactacaaatcagaataaaataaaggatatcttagtatcaagaggaaagcactgttaagatactaaaccttctgctgcccaggtatctgaggagagaccatggaagagttctatatggaacaaatgaaaaagcagtaaagtcaggtctagacctggagtttttagtaataccaagtttacataggaagtgtctgggaagtagtgattagagggaaagtatgttggatgagtgaatcattccttcagaaatcaatattttttcctactaggccctccgaatgtcatctttgtagttgcccaaatacatcagtttctctcttatgtaagagagcttgtctcatttttattgctgtattccattttcaagtgtcttcttgggtaatgatcctgtatttgatcttggccagatattatctgtgactgttgttagagtgatccttttcctttcccccgagttagtcaaactgtgtgcgtggtctctagactgagatttggcagtgattccatggctcttgtgagtggagttgactaacaaaactcaggaatggaatggccatattttggaatttggttgaagcaagtaaagtttttattcttctaccaatgcaaatctatctcagggaatttctctttattcagaaagaatgacctccatcccacctttctctaaaaggtacaaatcgtaatgcatatttgacacattagttggcttttaccttggggaccagcagaccaccccgcagatacaatgcacggaatctagcaaacaataaagagcagtgtgctcgcgtggccagatcgttcgcttccttcctttttcgccttcatttttgggaagtccttgcctcgttagttccataggccatgagacatagcaatataaaatgccagaggatgttcaaatgggcgtgtggaggaagagggaaagcaggaattctgggccaaagagcagatggccagccagtgacctaggaagggaagctcaggcttttaaacaatggcaatgtttcttttatgtgcagttttcattaaggagtaccgagactccaagttggaggattctgaaagtggtcatagagtccctgccctcgagatttaatatccaaagaggagacagtggttttaatataatgaatatatgcagaaaacagccggagacaatagaaacactttggcaccttctgtggcgctgctaaaatgtgtgctgtagctcaaggcccataggggttaatgtaggggttatttgtgtgtgtgtgtgtgtgtgtgtgtgtgtgtgtgtgtgtgtgtgtgtttggtgttttccccatgaagccctgattgtgcgaccctgggtgagccagctgcttccgctgttttccaggaaagcatgagtgtccaccacctagagagatgatgatgtgagaaggggcagggagagacctctctggctgccactctctcactgccccaggagcggaggcccctggtgctcaggagttctttggctgtgtccggatccaccaattccccgcttccctaaggatgacgggtaaatctggtgagacccgctgccctcctaatgttggaggaaagctggagcccctcagtcaacatttatggaagggatttaatgcatcatgggctgtgaaggtacagccaggccctccgtcagctccctgagacaggccttgtctttttgcacgcatatgtctgttaatagttgtagacctagctgtagccatgggggtaagcctagtcctccagcccctgagagtttattaccacaaggagtgagaacaccaggatgtgtttttttagatgttcttctgtaacccccaagcacctgtagctcccaggtgtttttacattgatctcagaattacccagaaaacattctttgaagaccttgtagagtctgccatttgtacttctgctacaaagagcaaaaataaagcaaataaacaaaaagcccctggaaatcctatagttatcctaatacatattttaaagtattacctatcactgagcaagtgcatctatacatttcaatccttttggaaaatatactttctcaaacttcatgttgtatccctctaaagttagttagcacatattgtacattcagaagaaatgttcatttacagcaaggcataggttttttttcctctaaaagaaatttgaccaggtatggtggctcatgcttatattctcaacattttaggaggccaaggcaggaggatcacttgaagccaggagttctagactatcctgagcaacaaagtgagaccctgtctctataaaaaaataaaataaattagctggatgtggtaatgtgtgcctgtagtcccagttacccaggaggctggggcagtaggatcccctgagtctaggagtttgaggctgcagtgagctatgatcatgccactgtacttcacgctgggcaacagagtgagacctctgtctctaaacaaaaaggaaggaaggaaagagggaagaaaggaagggaagagagagagaaggaaaggaagggagagggagaaggagggaaaagaaaaagggagagaaattgatgcaggaagaagaaagaaagaaaataaaagaaagggaaagaaactgatgaaggaggaactgggtacctagaagtggttgaatgaaataatcctgtaaagtcatctaaggttcccatctcattccttgccttttatttcttgccatcacctatggccacttcttgcttgttcatgtcactttctttgtcagtttggaatgggccctgcctggctgatggctttggagaggacagcagacagtcattagagactagaagctgccaagcgaggcaacgtgacagagcacacagctttatgcctttttcttagtctactctcagcttggaaatgtaggagttatagtgacacagctcagtcagcctcttcctcccccgatcctggatcatccactctgcctctccctcccccagtcccagatcatcctgttttcctagaccattccttgccctgacaaatttctattactctcaggttaaagcccaactaaccctgaccaggctgcaaggccctgcgtgatctggccctgtcccttgctctttgtcttggactgcccttgcccacaccaactccttagcattctacagaggtgccatcctcttctctcctggcctttgcccatgccactccctgaaacactccttctatctctcttatcccagctgatggctctttcctaggtcttatctccctggggtcttttcttgaactcctcaaatctggatgagatgtccctcatatgtgccctcatgacatccgttttgaaacttctatcacatcaccttgtttgtatgcatcatttgtcaataagcccacgagatcagagcccatcttggttttgagcttatgaacatagtgttgggagtaggtttggtgctccataaatatctgttgattgaaggagtgcgtggaaaacagaatttggtctttgatttttttctgtgtttggctcagtgtctgatgctctcccgagcattcttatcagtccacaggattttgcaggactattagcagagggtaatgcatatctgcaatattgtcagacatcgcctgttgttagacgtttgcttatgcagggaaaacaatatggagtttttaatttttagttggaaattcagaatattaagttacacataacctgcagtggtttggtttttaaattgagtttctgcttgttgttaaacccaatccgaatcaactaaagggaggtctattctctctacaaggacactgtggctctctggatattcctgtaagacaggaaaaacgatcacagatcaattctagttgctgcctctgagaaagaagaacaagatagatgggtctggctttgtgaggaacctttctctctctcctccctcctcctgcctctctctctgccaataattacaaagctgaactgaactgctactgagaatccaagttctttcctggctctgactaagagaacatagatagcatatgcatctagattctttggctgtatacggacatatatacatgcacacacatacactctgtctttggcctgaaatgacggcactgcactaagacctgttgtttgtttcttaagcagatggatggctagatttttctttatatgaatctttcatgattacttttactaggacagagctaaaagaacatgggatgtgaagtccagtgagttggattgattggatgtatgcgtattgagcacctgttacatgctggacattatcagaattatccgggtgaagaagatgaggcctctgattgaagtggcttgctgtgtaatgtggttacactagtgccacttactctataactttggcggacaaattactggacctctttaaacttcccattgcttaaccgtaaaatgaggatagtagcacctactttatagtgtttccaagagcatctaccatgataatgtttgtaaaattcacttgacatacacctgctcatccttgacatctcccagtgcagtcaccggagcgcctcccagcgtcctctggcacaggtaggtgcttcccctcgtgcagttctctgcttggacacttcactccgtgctgtcagcaccctttgcttctgttcctgcacttgtgccaaaccctttggatgaagagcctcgttgtgcccatctctggattcctagtgccaagcatggggtccagcacttgacacatggctgttgctgaataaattaaagaacaaggattatggatggccaggtaccatgcatataacatccttattataagaactttgggccagaaaacagaacaaaaagggagagtgctttgaggccctggagatcagagcaaatctcggcaatatcacgctccaatttgaaggctgtaagtgtgtgctgctttttagcatggatgctgatcaactgcccgaggtaaaggaacctcttgaggtcaggaaggaggtctgtatgtttagtctggaggtcagtctacattttggttagctaacaaaactaacagacctaggtggttggcaattagaggcgcattttgattgttttatgccatatactctacaactcacatggcagcacttttttcctcctgatttcctttccctttgcaggaagaaatgtgtttctccttttcttggaatctccttattttctgctccgattatatcccttttttctgctgttcatacaatttcaagaattaatatgagttatgagggttctccagagaaacagaaccacaaggagataatgtatttatttattatgagaaattggctcacgtgattatggagactgagaagtcccatgatctgccatctgcaagttggagacccaggaaagccactggtgtcattcaatcagagtccaaaggcctgagaaccaggggaattgatggtataaatatatcccagtttggggattggagaagatgagatgagatgtcccaatgtaagctgtgaggcaggggaaaaaaagggagtgactggtgaattcttccttcctctgcgtcttgttcttgttctgttcaggcccataatggattagatagtgcccacccacattggggagggagactgctttactgttcaggagctaatctctccggaaacaccctcctagacacacccagaaataatgtgtaatctgggcaccccataatccgagtcaaattgacatataaaattaaccatcacagatattaatgtcattgaggttgaaaggagagtgttcttgtccttagtgtgtgtttgtgtaaatacaatttctaacacaatctgagtgtgcaggaaataaggaataagcactttaggggaaaagatcatgtctcaaaggatcatttttttttctttacccacccctttgactctcagcattgaaatcaaagtaaggccctgagcagctatatagtagaagaaagaaagaaaaaagtaagaccagatggttgtttggaaagaaacagccactcttagcagttatgcacagcataggtagagtaagttcttagtgctcgataaatgaatcaatggttgcactttttagaaagaccatttcttcttcggtaaagcttgctagttcttctcacagattctcttttcatccgttccataggttctgcacactggtgaagggtaggaacagagtgatcttttctttccttcttgctgggtttgccacaaagcatgttgaatggtcttgatgtttctccggtctataaataaatacttttttaaatggagccatcatgggatctgactctatttattcttgtcactctcttctctcctcccacagggaaatggcacatttaggaagagtttccattatttgtaacatttgatgatttgtgtctttcatagaccatgtatcagaggtggagaaacagcttcttaactttcagacttgcttgttcttgactccatgagccatctaggagagttaccccatttctgtaggcatccatcagtattcatcctctgtgttcacacgctttctcattatattactcttctcaagtttacaaatctcttctcattgatttcattttagtttggcatcatggtctagtgagactaacacttggctgggaattgggactaactgtgtccttggataagactcttaccattctgggcttgtagtttttctctgtaaaagttgagacatccagcttgatagttctctggctataagggcattttgacctccgaatactgaaaggatgcaggtaggggttgcaatctttcatgctctgtactttgcaagagtaatttggtcagctatctgaggcattcccatgagaaccaaatggaactactctggccccttcagatagaaactgttagaaataaaaagcttacacttgttggggggcaggcagtatattttacatctgctgataatatgctagaaccaaattgcaaagtgtacccatgtatgttatttagtattttcattgttcacatttttctcatttctaaactatgttgaatagtggaatattttgcttcctttggttttgtttgagaacctcttctccccttagtgatggtgctgtagctgtcgtcagcccaaaaggtccatactacatgttcagctaggacagggaccacatcagggcaggcatctcatataatttgactcagccctaatacactgattttcttacagccaaggattaactctctccattaaagactcatgtgaggggaagaacagatagcaaagtgtttgctaaaatgatgaactgtccctatttcaccttcaggcagcaaaatcatctgcttagaaactaattagagcattttccccaggcgttggtgatctacttctacatgcctatgatctcttagacagtagttgtaccatgttcaggaactggccataaagcagccctctccctagcctgtctccctctaatagaagaaggctgagagtggctcattccttcagatgaatctcagaccttttatttcagattcatttaagggcatttacttctctgtgatgctccttactttctgttctttaaaatcttctttgcttttggatcccagggtagacaaggaaaatgttgcaccatcatatataggtaggtaggagactttaaggtgctcaaagcctggtcgacattttctggtggcacagatgaagccattttctatggaagcctcctaggcaagactctgtcctgcatcccactgagtatagacctaatttctttctaatatggatggaggaataagcatggtcatttatcatgctgaggcagctgtaagccgtctgcatccgggttccattgcaattggaacagtagcaaatccattgggtttctttgtttttcagggtaattttctttcccttacagtgtactacagatttggggtctgtggtcttaagtgaacatttacataaagttagctatttatgattttaaacaaatttcatgcccctttctgctgtgttgttggtatttttggtttctatgtatcataaaccacagaagttcagtgacttccatggaatgatgtggaaaatcaggaagtaagactgaaattaagaatgaaaatttctgactatatgtgtcatgctcattttcaccgtttaaggtctttcagaccacaatttagtgaataaatctatatagcaaattttttaaattctcacgttttatttattattattattatcatttattattatactttaagttctgggatacatgtgcagaatgtgcaggtttgttacataggtatacacgtgccatggtagtttgctgcacccatcagcccgtcatctacattaggtatttctccttatgctatttctctcctagcccccacccactgacaggccccagtgtgtgatgttcccctccgtgtccatgtgttctcatgttcaactcccatttatgagtgagaacatgcagtgttaggctttctgttcctgtgttagtttgctgagaatgatggtttccagcttcaaccatgttcctgcaaaggacatgagctcatccttttttatggctgcatagtattccgtggtatatatgtgccatattttctttatccagtctatcattgatgaacatttgggttggttccaagtctttgctattgtgaacagtgtcacaataaacatacgtgtgcatgtgtctttatagtagaatgatttattaccctttgggtatatacctagtaatgggattgctgggtcaaatggtatttctggttctagatccttgaggaatcgccgcactgtccacaatggttgaactaatttacactcccaccaacagtgtaaaagcattcctatttctccacatcctctccagcatcttttgtttcctgactttttaatgatcgccattctaactggtgtgagatggtatctcattgtggttttgatttgcatttctgtaatgaccagtgatgatgagctttttttcgtatgtttgttgaccgcataaatgtcttcttttgagaagtgtctgttcatatcctttgcctacttttagatggggttgttttttccttgtaaatttgttttaagttccttctagattctggatattagccctttgtcagatggatagattgcaaaaattttctcctgctctgtaggttgtctgctcactctaatgatagtttcttttgctgagcagaagctctttagtttaattagatcccatttgtcaattttggcttttgttgccatgcttttggagttttagtcataaagtctttgcccatgcctatgacctgaatggtattgcctaggttttcttcaagggtttttatggttttataggtttttatggacctaaaaccataaaaagtctttaatccatcttgagttaatttttgtataaggtgtaaggaaggggtttcagttttctgcatatggctagccagttttcccaacacaacttattaaatagggaatcctttccccattgcttgtttttgtcaggtttgtcaaagatcagatggttctagtcgtgtggtgttatttctgaggcctctgttctgttcattgttctatatatcagttttggtaccagtaccatgcttatacagcatatttttgtttgcactttcattgtgaatgctaattgtttttacttaaagattcctccttgagtagattcaataattcaaactggacatgaacatgtgactttttgagatggaatcgctctctcgcccaggcttgaatgcagtggattgatctctgctcactacacccaggttcaagcaattctcttgcctcagcctcccaaatagtggggattacaggcgcgctccaccatgcctggctgatttttgtatttttagtagagacggggttttgccatgttggccaggctggtcttgatcccctgacctcaagtgatccgccagccttggcctttcaaagtgctgggattacaggcatgagctactgagccaggccatgtttgaatttttacaagactaatttaatttcacatttcataggtaacacatagacttagccacatttttcatattggtgcctccatggtagataagacattgaaactataatgcaactaagatcaaattttttaaatgtcagaataactttaataaataaatttgctcatccttttttgatggaccctaacaatgatcagtttttagccatgatgttatctgccactagactgtattattttctcatttaacatagcttcatggtactaggaatggaaggaggaaagggggcatgaacttctcaagactgctttgtaagtctatttctttctttgattcccatacctcaaggaactgagagcaaactttgagcctgagtgtaaagtttgttttcctggaaatgtcaccaggctgtaaactcagaaacagattgcccccaaaaaattccctaaagggctctttacttttttcttgtgttacctttttttcctgtggcattctgtctcataatatgaacctcatatagttgcctcccaaacttttctgtttagcttttttttttctctccaagaggaatttctttaagtacactatggaaatgtgcataaagatgaaagcctgacttttctaaacactgtgttataaaattaattgacaattaattcaacagatgtgtattgccacatggatagagggtaaaggtagtcatttgtcactgacttcgacaactgagaaaaaagtgattcaagggagttggccctgcatgtaaggaatttcaggaacaatgtggtcaattaattttacttaagatgaatgtaaacatcatgtgtacatgcagttctttcaataaatacaaaataattgtaaatgataaagtggcagataaatcttagtggcagataaaccagtgcctctaacaatccgcttctgccctgtggcattttttgaaatgttactaatttgacagactaaatgagcatccagtattatttagcttttaaaacatattatttgtgtttttttcctttaatattttgcttagaaagtctttctctactctaaggtcaaataaatgttcagttaaatagatggaatattacctgtttcatttttacattcaggccttaagattttattagagaaacttccacacatattcagaagtgatgagaacagtataatgaattatatgtactcatcactcggcttcaacagtgatcactacgtgactaatcttgttttatctgtatgcttacatccttctcacccttccccttccctattattttgaagtactagtcactcagaatttcagctataaatacttcaggttgtgtctttaacagacttaaaaaccaagcaagcaaaatgtcattattacacctaataaagctaacggtcatgttttcatattatctaattaatacctagagttcaaataaaatgcctagtatttttggggctgaagatacaacccataaaagtaaagccttggtgttataatacccaagagccaatattctaacgtgaggaaacagacaaaatgtaagtaaaatacgaacaagataatttctgctaacaatcagtgctcggaaagaaacacagtagatgacagagagagtgacgcagggccagggggatcctattccaggtcggtggtcagggaaggcctaggaggtggcatgagtgtgaggaccaggtgaagggcaggagctggcccaggggacagtgtcctaagtggagggatttgccactgcgtgaagagcttgatgggcctgcggagtgtcatctagctaggcacctttttccctgttaatgctggctttagttatagtcatttgtaatgtgtagattttcagtgtcttaacttttcaacagggtaaataggaccatccggagtacaccaatattgagctttgtgataccttttggtcgatttgttgatcagttatgcttcattgtccatgaacatttcagaaaaaaaaaaaaaaaggaaaaaaagaaatggaaaattcaggctacttaaatcacgcctttgaaacctagaaacccttaggggcacagacccttcttgtgtaataacagagctctattttctgctgggaagttccctattgagatttgggacacttcctaattttttctgggtaaaataaaagtgacaacttttttttctaatgactttttaatacttcttcttatctgagtaaaaaccaggaagtgggaagcaaatgtacaaaaaccagcaatacacacacacgtgtgtgtgtattttcatgtacatatgaatgtgtatgtgggtgataggaagaagagaggatgcatagagaagatgatctcgatcaagtttgatgtaaatgtaatagcaaattagagtacattcttgtcttaatcttttctgtaataaagataaaatggggcattatgttcatatgattgaacaaaagtggatgatttcaacctttttcttctcagccattaaaagaagaatttgaaagaaacagtctttgcatacatatacagagagtttgtcagcctttcttcagacacagccagccacagtcagactaaacattcgaagacgttacatttagtccacagtggaagtatttgttgattcacatattttctttttacaagaaaatcttcagggttagtattcacccctgaattggacacaaagtaaaattccattgtgttataagacagcttaaaatatctttgatttaatccagaaaattctatcactcttactcctgaaaaaggtgctggtattttaggctttaccagtcagctacattaaaagctgtggatagttttgcaatttatgaaataattactcttcctcatttgtcttcttgatttgcccgacatcaatgctcttgtgttcaccagggactaatgattgtatttttcttcccagtgggtgggataggataccagtaggtgggatagagagtttatggtagattcagtttgtctttatttactcaagcactcttccagggcctggagctgtcaaaggtgaagtaggaaattactgtttacatctgtcgggaattcactgttctgtctttcatgagctttcatgccctttagagaccattttgcacaccttgattgtcagaaaagggtctgggatgtttttggagtggtacagagatgcatacagcaacttacactgtcatgactttttttttgagatgcagtctcgctctgttgcctaggctggagtgcagtggcgtgatcttggctcactgcaacctctgcctcccaggttcaagtcattctcctgcctcagcctcccgaatatatgggactacaggcatgtgccgccacacctggctgatttttgtatttttagtagagatggggtttcaccatttggccaggctggtctcgaacccctgacctcaagtgattggcctcccacagtgctggtattaacaggcgtgagccaccgcacctggccctgctatgactttcaatgctctgttgtagttttttcttaaaatttaagtttgcttggcaatacctttttttttctttcttttctattttagacagagtgtaactctcacccaggctggaatgcagtggcaaaatctcagcttactgcaatctccgccttccaggttcaagtgattctcctgcctctgcctcctgagtatctgggactacaggcgcacaccactgcacccagctgatttttgtatttttagtagagacggggtttcaccatgttggtgaggctggtctcaaaactcctgacctcaaatgatctgctagccttggctttccaaagtggtgggatttaaaggcatgagccactgccccccaccccaccgccccaccttttttctgttcttttttttttttttttcagctcactgcaacctccggctccccgctccccacgccccccaccaggttcaaacgattctcctgcttcagcctcccaagtagctgggattataggcacatgtcaccatgcccggctaatttttgtatttttagtaaaaacgaggtttcaccatgttggccaggctggtctcaaaactcctgaattcagatgatccacccgcgtcggcctcccaaagtgccgacattacaggcgtgacccgcacccagcgccacaccccctttttttcttaataagaaaatgagtagacacatccctgggtgccaatcactcatgtatcaagattgctgagtatgagaaatcagtaaattaatatgaagaacttaaaacacagttctagccaaagtaatgcttaataagtacagtattgtgcaattattgctaaatagcatacatttattgtgttcctccatttaagatactttcaagcattgtagggaaagaaaagcacataagctgtagtctttagctttaacggacttgtagcctagttgagagaagccatatgtgtaagatgacgagtaatagcacaaagcagtgtgtgatcagtgccaaatgcaaatatgtactaaaggagtttaaagcacagagaaagtttgctgtgaactggaataatgataacaatggtagcaacagcagccagcatttactgagtgcttcccgtgtgctaagtactgatcaagtctcttacaggtattcgctcatttattctttatgtcagccatataagaaagatgtttctattagttttcctgctttacagctcagaaaactgagtgaggttagctaacaggcccagggtcccacaccagggaaatgtggagtctgggctgcctgttagagtcttggctgcctgactccagagccccagtcttagccacgtcagggtggtctaggagaactggatcgaagtagataccttacgggcaaaggaagccgaccacctcatggaagagtctggtgtatacaggaaaagagtgaaaggtacaatgttggggcatgattaaagggcctttagcccccgttaaaggcactttgacctgatccagaaagtagtgggagaaccagcgaatgaacttagcaagaggaatgttgggtgcattgcagggcagccactatggctcaagttggggctttctgatgctttctgcttcagtctcgtggctgtctagtggtttgattttccattagccctttctcccttggccttaagggatggatatctacaaaatcttagctatcaggcaaaacctcactgtcccactggtgataagctgggcttcccagcagttcatacgaggcctgcatcctgctgtgtaacctgcctcaagactgcagaaggcagagttaggtgtccttccccctcagggccctctttatgcttctctggatttggtgccaaagaatccacagtttagggcaaccgtagaaaccccaggaggagtgtggtagcgtgtggagaccctactaagataaccatagccttagctgctccttgaggtctggctctgggtcccaggggctgcttagaaggatccttagtgatcccctggtcaggacatcatatgtttagagagcaaggttagaggagttaccacagttttcttctacatgctgattaatctaggatttaaatacaggctccaaaataaagtgtaagtggtggtagctcaaagaagcaaagcaagcttcacattaaatgacatgggcttctgaaaatgtgggaaggactaggaacacaggctacttactgcatctataactctctttagacaaagaaaatatgtgattaggaaatgttttggcaagatctcaccaagattatttactgcaaaggaggcccaggactcagcctggcagggaaaatggggcgggggggcgggagtgtttactgggagtatggaagagcattttaaagtatggaagtagattgaacccctgtgctggggctggggacagggagtaccataatacaattttatgctgttaggggatctctgcaaaacctagagtaagtagaggaaggagtctgtttgaaattaggaatagtagggtcagggtccagatggaggtggggaggagtggggctcagacctgaccactgcttctctaggcgtcgtttgaatatttaaagacaaagcacagtacatttgctattttattttattttatttcattttatttcatttcattttaaaccatggctaactcttctccagtcttctccaggagaaaaaacttgattgtcatcctggcacaaaaatgtccacagttaggctaacaggcaagcttccgtgagcagatcaaatttgctattctggttccaacatttaactccctagctttttttaaaagaaaaaataagctggcatcaactgaaatttcaggttaggggcttggtttgaggatgtttggggaagcgggagctttctgccatgtcttttgtggacattggatgtatttccgcattctggttggccacatttccccctggggcagattcttcagaatcatttgtctcccactgggagtctttttccctcccccccccccccacccccctttgtctttttctctgacatctgccgcacactctctccagggcatacggtccagaccctcctgggagagcttcatctgcttagtataacttctagcagaagatagaactgatggattttcgtgcgcaaatacagattcacaagggtgttcggtgtcacaagcatggatttatgatgcagtttgaaaagggtcagaatattcagagatgagattaatgccagcccatgagtgctttgtggtgctgaggtaactgaagtgcatctggtggtgtccagagctcaagtccccactgcagacgccaggaagaaagaggtggctcgcagactgagaaggggcgtagggatgcacccttcttgtctccttctgcttgataatttagatagaggatggcaggtgtaaatcagtttgtggtagatgcagtgtgagctgtcctttctcccccttcctcacgtccttacaagacacctgtctgctttgtatcgattccggcactgtgttatgatattcttgtagtttcatttttttgttgtttctcttttgatattggactttatatgcaaagaatgggattagtcataatctttacttcaaaacacattatcttcatatttttatgctggttgtgatggcacacacctgtagtctgagctactctggagactgaggtgggagaatcacttgagctcaggagttcgagtctgcagtgagctatgattgtaccaccgcaccctagccaggacaacggagcaagactctgtctctaaaaaagatagaatgggctgggcacggtggctcatgcgtgtaatcctagctctttgggaggctgaggcaggcagaccacttgaggtgcagttcaagaccagcctggccaacatggtgaaaccccatctctactaaaaatatgaaaattagccgggtgtggtggcgggcgccggtagtcccagctactcgggaggctgagccaggagaatcgcttgaacctgggaggcagaagttgcaggaagccaagattgtgccactgcactccagcctgggcgacagagtgagactctgtctctaaataaataaataaataaataaaattatataaaataaatagtgtaataaccaactatgtagtcacttcaggctgctataacaaaacacataaactgagtggcttataaacaacagaatttgattctttccgtctggaggctggtagtctgaggtcagggtgcccaaatggtcaaattctggtaagggccctctcctgggtttcaggctgctgacttctcactgtgtcctcacatggcagaagggcggggagctctctaaggcctcttttatacgaacctaaatcccatccatgagggctctaccctcatgacttaaaacaccttctagaggccccatctctaaataccatcacattgagagttaggatttcaacatacgaattctggggtaacacaaaccttgtctgtagcagtgaccataaacccatccccccagacaaatctaggacctggagcataacctgcgtctgagcagattgccatccttcccacacctcctctcccttcttttctctacccaaggtaactattatctgaaccctgtatacatctatgtttccttttctgcatactttatttcgcttacatatcgttctaaaatggaacacataaaaacataagacatacacacataaaaagtatgtagctatatagatatgtatttaattgttatcacctttcaactttataaaaaggatatcagaccatatataatcttttgggacttacttttttacttaacgtctcgactgccagcattcatgtgtattgctatgcatcacggtagttaatttgccttgtctgctgtatgatgttccatcatgagccgattatacacagtttattcattcactctctcattgatgggcgttgaagttggtgctaggatcttggcaattgcaaacaggtttgccataaatatattcatgtatgtataatcagttgtccacgtgcaaaagagagtcctttgtgttcgtgactccattattttgaaaccagcagtagtactgcacactgggagaatgtttgtgggaagcacaataaaggtaagtcctcagtactttgtatttcagtttggtgtgaagaagtagcatgtagacttcataggagacaagacacttctatggtttgagtatttgtctcctccaaaattcatgttgaaacttaatgccttaatccccggtatggcagtattgacacatggggcctttaagaggtggttgggtcatgagggttctgccctcatgaatagattaccccattcatgggttaatggattaatggattaatgggttattatgggaatgggactggtggctttataagaagaggaagagagacctgagctagcatgctctgccccttaccttgtgttaccctgcactgtcctggaactctgctgagtccctcctagcgtgaaagccctctccagatggggccccttgaccttggactccctagcctccataactgtaagaaataaatttcatttctttgtaaattacctagttttagggatttggttataagcaacagaagacggactacatatcttattttaattttgttcctcccactaacttcccagccccacagtgcttggagcaactgtttctgcagtcatgacttcagtacagttaatgcctgttgacttcatcttatgttaaattctttgcaggtaaagccatgttccttataagatcagtctttttttgttcctctatgtgtctaatcaggtcaattctttgcattattttatttagcatcatctaccaggaactaggcaggcattgtcttaataaagcctggttcttgcagttggagaacttgctatctagctgggagaggcagtatgcaaactaagatttagaatgcgttatgaggccaggcgtggtggttcacgcctgtaatcgcagcactgggaggctgaggcggatggattgcctgagcccaggagttcaagaccagcctgggcaacatgacgaagccatctctacaaaaaattagccaggcatggtggcacatgcctgtggtcctagctacccgggaggctaaggtgggagaatcacctgagcccaggaggttgaggctgcagtgagctgtgattgcaccactgcactctagcctgggcgacaggatgagaccctgtttcaagaatagtaataataataaatttaaaaataaaatagaatgcattattatatgtaccttagaacttaggtcttagagagtgcctacctctccttgggagagaagacttacggtggtgggagacagtgttgcatctgtcagataaattagggaaggcacatggggcggacgatttcagagaagttaaaggcatgggagaacatttgccacgcaggccgtggcaagtggttggctttgactgtaacatgcagcgtatgcagttcctggaggcagatgagggaagtcatgcagtacttgtgtttctgtgagtctcttcagttttggggtttgtagacaggtcatgttcacttactcctaacctgtctcccacaatagtcatctgggtctgtgctacttagtgtcatcctctcactctttcccttggtggcatatccagttggctaagaggacaggcctgaccttgtgcccagagtagggagaagatcccgatcacctctggtccttgtcaggctgtttgcttggatggtagagttcacccaagttcggactcaggaacggcctgtggtcatggagtagtttttttctgtccagggtctggaccaagataactccatcacaggggtagcaacagtatgtgctggggcaattctgctacccacttctggtgtccttcagtgctttccctgcactatctctgtccccagctgcttccatccatttgctttctagtgatgaagcactgggggaagctgcagggatggctgctgcacccacatccatccctgcccatctgttctcagagactctatggctagcagagggagtgatgatttcagggaagagtaccagagagggccagtgggtagcaggagtctcacttcttggagaaaacagctggtcctctgtgaccaattctccctcaaactagggagattatatggccactgcatacacaaacacacatgcttgcgaagataggatggagttgtaccaaataaaaagtttattgaaagggatggtggtagagaaacactgtatcatgccgtggcataacagggtattatatgttggatggctttttggaaatcattttaggccaaccttattagagatctaatttatttgtattcttgtagctacctagcacagtggtaagaacacagaccaacatttggtaaaccttggtttgaactctacccctgctgcttctgacctctgtgagtctgcatattatttaacccctgaggctcagtgtcctcggttgaaaaatgggccactaatttagtataagggctatgtaagatgtaatgcacatgacatgttttataatagcttcttatggaattatctgaattggggacccatctgttgcttttataaaaagttcaccccttaagacaagtcagtccaatggccatgtttaaaccaaatgtactgtcttctgtaatgctcaatatatttttcatgtcattgagtgcagagactaggtgggaagatgatcatatacagacagaatgggcaccactctgcctaaacatggctctcgctttcaaaacagtactttaaaatatctcctccctattaaacttttccagtgaagactctttttccacctggttattgtctctgtgtttgttacagccttctctctgctttcagatattcaactctgcaaagtcgtaatcatttatccacatgtacttttgtgtgtgtttgtcccatctctctctttagaagacatgttcctgctggtgcttggaataagacgttcttttccctccccgtggagatgctatttttcctctctttaaggagctaggagagaatttggttcaacatgtcttatgtatcagtttagcactgtgcttttcttcccttagattgacgtgtgatttaaaaaaacaaaatttggaaccggtcatgtaaagatggtgtatgtcacttagtataggtcatctctgtaccctttgtatactgaattttgctgtgacctgtcaaaggataccgaagacaggcccatgcgaaacatttaatttctggcattttcgtgcatgtgagactcatctgatgtgaactgaaggtatgttatccttccttttaatgataccaaatctggcccaaattcatatgaccccttagaaaattactgtgataggaacagattctaatgaattgaaatagagatttctccacctcacgtaattaggatttgagagttaaataagaaagtcagggatagggacagggatagaatggcatggagaaagttggagccaagaacactgaggaaaagaagggagtgacagcagcaaggaccattgctgttaggaagggaattctttcatcagacactggaattctcctgccaggcactggagtttgccctagcttctgtctgcttttactggatcctgggtcctccagctgaagtgagttgtattacaatcccttccagttttgcacttcagggaagtgaaatggagcaaatcctaatggcacaggctggagggagaaggactagtttctttaatgtgactcaacacctggcaaggctgtctttttctcaaccgggtttcatctgttagttctgcaacatgcagagtcagattttgaggagtttccagctctcgccttcatggctgtccttgtgtttgtgtttgtgttctccaggcgcctccttctccactctttctccagtgctggagacctaggggtgtgcatcctggaggattgtgaggaacctcagctgctcccctcgtcctctgaccaggcggtgggctcagggagctttggagtctcatgcggtcagcagcgcttagcatgttcagttggctttttccatatcaccagtgacatctttcttcttcctaatcatcgactcatggaatattagaattaccaagcctcttgcagttcctgtggtctaattccttcattttagagatgaggacccctaaggcctggggaggggagatgataggtgtagggaaaaaaaaaagaaactttttcctctaaataagattagcaaaacgataaattaacaggagaaaaatagagagtttattaacacgtgcagcacacatcacacaggagaaacctcagtgatgagtaactcaaagtttcaagagtttttatttcttttttctgtatagcacttgtcagtctctgatattgatttttacttgtttcttaatgtttgttctccttccactagtacgtacactccatgggaacagtgattttcatctgtttgtcactgctttattcccagcacatagagctgtgcctagagtggtaggcagatcattgttaaaacaatgaatacatgaacttcgggcaagttacttaaccattctgtacttcagttttcttgtgagtaaaatagggattaaaatagtgcctacttcatggagttgcaataaaaactaagggagttaatccatctaaagtaccaataacccacctggcccatagtaaatgctcaataaataggttcccagccaggcgcagtggctcacacctgtaatcccagcatttgagaagccgaggcaagaggatcacttgagtcaggagttcgataccagcctgggcaagtggtgaaaccccatctcaactaaagatacaaaaattagctgggtatggtagcaggggcctgtaaacccagctattcaggaggctgaggcagaagaattgcctgaacccgggagatggaggttgcagtgagctgagatcatgccactgcactttagcctgggcaacagagtataagactctgtctcaaaaaaataataataaaaataaataagttccttattataattactaaatattgtatttcctcactagaatgcaaactccttgagggcagagactatttcttacatcatctttttatttctagtagcaatttggctgacacatgattgatattcagtgtttgttgaacagatagataagttatagaaaaattgtaggtaatacttctgtaaataattgttaaatttaaatgaatagatttccttcctgtctttttccctaagctgcaatcagtgaatctacatggattacatagattgtgactacactgtgccttaactcatcacttaggcagtggagtcgatcatttattttgttgccatgacttggctgaaatttcttggggactgacagcaatggcagaaacttgatgggtcctgaatgtcaccatagcctgtaagctacacaggagccacccgagaactcctccattcgtggttgtaacttcacagaaatgcttcccagtcagaggaggtacttagcagaggctgcaggcatctgaacagacaggtgcaggaaaagttgaaagggaaggttaagggagaaacatactcctcatctccgttctcaagaaacggcttaaaggttgtaaaaggattctgcttttaagcttgagtcactcatttgacttctgtgggccttgcaatttctctggtaaaattagagaatatgaccaagattatctccaaggacctgtcttactttttaagtttcctaattctgtgaaaaatgcttaagaaggcctcagactgattaagaatttaggggtgtaagtttaagtggggatactgataaaagggcaggggatgttactgtaagagcaatggaaaagtgtctgagtagtgtagcatatccatttgtgagaggagtaattaattaaaaaatgaaggcagaatccacatcttcacaaaagtttcctatctcctggtttggatgagtgtatttaatgtgaactaagttgcatgtgggctgtctaatctgggcatctgacttgtgaatccttcccataactaagccccgagagatttccaatcatgcccataaggtaatgcaatttggcaagaggatttggacttgacgaaatctcttgttctatttggcatccagaaaaggctgacttgcctaatttgaaaataaattgaaaacaaaaaaaatttaaaaaaacctctggttgttccttgtttgatgaaataccatagaaaactattactctttttccataccccattactatggagaatatgtttttaccactgactcttctaagtatctgtccttagtttcctgtccttccctgccacaggttccaggaaggctgaatcactacagcatggtattaaatcatagaaatacgtgtgtattttgtaccatgtgggtctgcttgcattcctaacatctgcattagtattagttttctattgctgcataacaaactgccacaaatttagtggtttaaaacaacattcatttcttatctcagtttctttgggtcaagaatctggacacagtttacctgggtcatctgcaaagggtctcagaaggctgtaattaatgtgttagccagggctgtgttctgatctgaggcttgactgaggaagaacccactttgttagcagaatttagtaccttgtggttgtaggacagaggattttagtttcttactagctgttggttggaggcttccctctgttccatactatgtgggcctcccaacctagacacccacaacatggcagcctgctccttcaacaactagcaagggagtttaatgttttcctgtagctcatatttctttataggtgtgacctcaatttttcccctaatacctttgtaagatagaagtagggagaaccaagatagatccaaaaaggctgaatgaaatgcctgagattgagctggtggttgcattgaacaatataaattgatgaataacaatttattaattgtgccaggcactgtgctaagagcttcatgtcagtacattcttgtttagttcttagcacaaccctctgagttaggtattactactactaaactatttaacaggtagggaagttggggattagagaggttatgtaacctgcctaaagttcacagacagaaagtgcacagcccagatttgaacacaggcagattccagaacccactatcatcgcactctgaagatctctccattagagcacgatgctgccatgttcaggattcttcctatcttttgttaaatacttaagttcctgcaatattgcaaagggataattgtaataggttgcccctttcaaagtgctttaataaaatgaaaggacaacattctttcttttctgcttgagccaggctttctcatttttctgaagacatctaggataaatggaaggaaaccagaatttagtggggtttgcatgtattgataacagttttgctgaatacacatccaagagctaaaacatgcaaactcttcaaaattggtagaatacagcttgctcattttaattcatttaaaaatgttcattttaattaagcattacccattttattattccataaaacacgaatcatctggaaaaggcagcataggtctatttttccagcctataaaactatatgtagatggatcttgatgagggatgtacaagatttaattagaaactgaaattttagagtaaaaaaatgcaggggtgtgtgtgtttcttctatatttgtggaaacccaaagagctatcctgcaggatacttgaaaatatatataaatacagaggagaaataaagtgcggagaaggtttgttgattattgagctttttcatgggtgatagaatggagcagctgtaggatggaggtaaagaggataggaaaatgctcttctgggtcagacccagccccacatcccaaaatgttgtggccaccctctgtgttatgtaaaatgtaggaaggtcctcccagctggaggaccttcgagtatactgcgttccccctcctcattcactagggaggatgcaaaggtgcaaatgggccaaggtcatgcattggacttccttcattaaactgttatgaatttgccttccctgagctcctgttggaaaaatgtcttgaacttactgttgttgtttctcctactgcgtttgtatttctttttataaaccttagtccaagtcagcccagtgctgtagttatttgtgtatctgtgtcattctccctaggatgccctgggccatttttaatcaactttgatcccctttcagtgccttgcatgaggcctggaacattggaggtacacactgtgtattgactgaatcgagtgaaaggtatttgaatatacagttgactcttgagctacatgggggttaggttgctgacccctcacgcaggaaaaatatctgtgtataactttttaaaaaataaatttgggggtacaagtgcagttttgttacatggatatattgtgtagtggtgaagtctgggcttttaatatagccttcaccctagtagtgaacattgtacccaataggtaggttttcaaccttaacctgcctcctatctttggagtctccaatatatgttatttccctctgtatgttcctgtatacccattctttagctcctgcttataagtgagaacatgcaatatcttactttctgtttctgagttatgtatataacttctgagtccccaaaaacataactactaatagcctactgctgactagaagctttaccgataacgtaaatggttaattaacacatattttgtttgttatatgtattatatactatattcttatagtacagtaagctaaagaaaagaaaatgctattaagaaaatcataggagaaaatatatttaccgttcattaagtggaagtggagcatcataaaggtcttcatcttcatcatcttcatgttgagtaggctgaagagggcttggtcttgctgtctcagggtggcagaggtggaagatgcggaggaggcgggaggaaaggcaggccactcagtgtaaatttactgaaaaaaattcacatataagtggacacacgcagctcaaacatgctgttcgagggtccactgtatttcatctgtttgtttcctactgtggaagacagggcttccaggctttagttctaaaacttccattgtaaggccttgaggaggatcctctcattccagtaatctgagagttggtaaacaaattcaaagccactgtatcactgtcctttatgtccctatgttttttttttttacttttttttgccatttcttttttcttttgcactttaaaaatcgtggtaatatatacataatataaaatttgcccttttaaccattttaagtatacaattcagtagcattaggtacattcacattgttgtgcaaccatcagcgctctccagaacttttacatcgtccccagctgaaactctgtccccagcaaacgctggcatgcccttctcccctcccccagcccctggtaatcaggggtcttcttcctgtttgtgaattatgactactccaggtctctccgtaagtggaatctcatttgaccttttgtgactggcttatttcacttagcatgatgttaaaaggtttatccatgttgtagcatgtgtcagaatttcattcctttttggcagccattgtcttaagactcaagagtttaagtgtttttagtctctgtagccagaggtagatttttcttccagctctgtgcttgggcatttcccaaagcgaaacttccaaaggcacatcctgtcttcctgagtggtattctttgaggcagctgagtagcaaaactgaggctattaatgttcgcttagcaactgagcagctactgtgtatcaggggctctgcctgtgaccagggagtacacggtcttgtagaagagaaaaccgggtactcagctaactgtggtaccatgtgctaggtgccaaaggaggaacagagggccctgcgtgatctgctcaggaccgtgagggagaggtaagaagagttcaaaggagaggtcatatttcaaacagaccttgaagctgttcaaggcagagaagaaaaggatggtgttccacgaatggcctgagctaaggcaagtggaaacacgaggtttgttggaagaatcgcaaggacagcctgatgtttatagaaagtggagagagtgtggggaatgacattagggcgtatatgaatgccatgctaaggattggggtacaggtaacttggaggcctcatgcagttagactgaccccgttcgatctgtgggttgacaggggggtgtgaatggattggaatgggagagaccactgtgtggggcaaatgggaagggagcgtggttgcagcattttaggccagagatggtgagggcctgaagcaaggcagtgagagagaagaatttgctcatggtcaggtgcatcgggcctgttgacagcagagtttgttggactgctcccacctattgctttttgtcttctgaagtttttataatttcaattccagtttagaggtctgtttttagaacatttctccgatcttattatacccatagtggcaagaatgaattgatttgtacaagatagctggacaggttcctaccttcaggctttctacccaactgggcacttggaaggatagtttttcatagtcttcatgggctaagtgattgcatgtaatatacaatagctggagtctaactgtaattaaaacaggttagccaagctacaggagaagtatcccccccatccccacccccatggcccttccccactgcctgtaatctcttggtaacaaaagaagtcaaacaaaaatttcatgcaagggtataaacatactttgagtcatcagaacctacctagtggtccatagaaccttggctcttcatgaagggcttaccaggaagacatagtcgttgttcatatgcagtttctattctgaactgtaaaatgtgagcgattactttggaaaattagaagaaaaaatgaatttactcaggatccttaaaaggttacatttgtcatgcctgtaatcccaacaattttggaggctgagccgggtagatcgcttgagcccaggagtttaagaccagcctgggcaacatggcaaaaccctgttgatacaaaaaatacaaaaattagctgggcgtggtggcacatgcctgtagtcccggctacctgaaaggctgaggtgggaggatgacctgagtccggagaggttgaggctgcagtgagtcaagatcgtgccactgcaccccagcctgggtgacagagtgagacctcctctggaagaaaacaaacaagtgacatttataggagggtcccaaacatacaaatatggaaagtgaaaatactacttgctacaggtactgaaagaaaatactcaggagtcattattcaactgaaagcagattgaggcaaaggtgctgaaatatactaaaaataatgagtttcaaagaaaatcatcttttgttaacctttgcattagtcagtccttattttttcgttttagtcactcctttacaacaatgtgtataaatatagaagatgaagagaagtgtgataaaaataatttaagatttggaacatgggttttcaaaggaaaggttagagaaatttggggattaaaatggacagactttatcatcttcaatattaaaaaaaaaaacagaaggatatttacgagcaagccaatgaaatgataccaagaagtttataacacatactctgcccttatggggctttcacctagcggccatgtttccattgtgcagttaactactcagttattttttatttcccaagagcactaagtgaaagcaaatgcatgttaagtcgtgggggctattctgaatgatcaatagagcccaccagagtcccttataactaactacccattagcagatgtggagtttccttcttggggatggaggggactgagtcggggagcttcctggatgggagtttgaaccaaataatcttaattatgtaattcctttcaattttaagatttgagggcaactttagaaagagataagtaattgactgaccaactttataaagagatcagtaattgaccacccttggagtgtaagagtcaacacctaaaataaatgtatatttctaatattttgaaaatagaagaaaaaggaagaaaggaggaaagacaagttatctagtggagacgatgaattttcaggtcatccttctagtttttattttagacttgtgtctttagttgaaattattacaacttgcatgtattttgtctgtttactcattatttcgtctgtctcaccgttccaaggtaagcaccgtgaaaacggactgtgtctttttagttctttactgtgtttctgccatcaagcccagtgttgacacatggtaggtactcaagacatgctggctgaatgaatcagtgagtagtgaaggtggatcatggggagaagagtgctgcaaataccagagagaaggagaagaaggaagtggaggggatagcggaagaaggggaagaggagtgagtttacaaggcctttttttctttttttgacagagtctcactctgttgcccaggctggaatacagtggcgtgatctcagctcactgcaacctctgcctcccaggtttaagcgattctcctgtcccagcctcccgagcagctgggattacaggtgcacgccaccacaaccggctaatttttgtatttttagtagagatgggatttcaccatgttggccaggctagtctcaaactcctaacctcaagtgttccgcccaccttggcctctcccttgctgggattacaggtgtgagccaccatgcccagcctccaagccctttcttttaaaaaataaattttattgtttatatttgagatttacaacatgatattatgggatacatatagctaatagaatgggttgctatagtgaggtaggcaaccattctcacaggggtttgtgtgtgtgtgtgtgtgtgtgggacaagaacaactaaaatctacatatttaacaaaaattcctaatagaatatagttttattaagccttaaaaaaggagatcttgccatttgccacaacatggatagacctagaggacattatgataagtgacataagccagatacagaaagaaacatattgtatgatctcacttttatctgaaatatttattttaaaagctcaaatacagagacagagaatgaaacagtggttaatgccggtggaaatggggagatgtgggtcaaaggacacaaaatggcaagtgcacaggatgagcgtgtctagagacttaatgtacaacgcaaagactaaagttaacaaggccttttggttctgttgctgttgttgcattacgtaatagtgtgctaagaacaggagacacataacgtcatctaaaaaacaggagatgaagtgggccggtgctcaaacatgctagctccgggaaacaattcaggatgatttgccactgagtcaggtttgttaattttttctacaatagccaaaggctctcaaaaaatcaaggtttcctggtttataaataatctctggaggggtgtgtgtgtttcaggcatctgactcctttatttatattctctgccctggccttcagatgattttcgagcggctttcgattagattatctgcattgggataatggagcaattttgcagcaaactgctttggactgttcgactcttctcggcctgagtagccaaaaaataataataacttgatttagtctggtctagcctgctgtagtctgacttaaggatataatatcccagaccttagacacttgacttaatacattaacatattaacaaaagggtaaaacaaaatactagaagaaaacataataaaaacagcacattatttttcgggcatttgacttgaaccacagggtgccctcataatgaaaagaatattccaagggaaagatgagaaggcaattgagacaaccctaagcccctgtctgcccactcaaaccctctggccaccactgtactctctccaccatgagaaagcaggccaggagtcagttcagctgcctgtgtttaagtgcttttaatatccatggaggcacagagaaatgaaagcaggagccttgaatctagatttttccagaatccttttgagagacttattgtagcggcaggagctccattttgggggggtcaccccctgaactttgatggttttcaaatctttggagggccttggtcttagtggctcagaggtcccctgccaggacttctttaggatggggatgataggaagcgaacgttccttctgttgaggtgcatcagccttgcatctgagttcttgatgtcctcaggcctggcttcccagttggttaaaggaatgaaaataacaacgcctttcatttgcagtgcagctttaaaaatatttgcttttgctatctcattttatcctgataataaccgtgtgagaaaagcaggatggcagtcttactgtccttgtacacatggagaaatagatgcacagaggttaagttgcccagtttagtaaagggcagagcagggactagactccatttctcttcgctggaagagcccagcactatcacattgcaagattgtttcttgtaaaacagtcctgcataaaaataaaaaagagtagagagcatgatgtgaatttcagcttttagaggctgctgtctgtttttcataggttaaatagtgaatcagtgtgctccgagcttccatgaggggcagccctccttacctggcaggttactgagttttctaatgacttcagttttaggtgctaggagatagtagggccacctgcactgttttgtgagcaggacagataagaggcaagtggagagggtgggagagcactggcttgcatcatacaccccagctgcccttgcagggcccgactgttacaagccaggtatttctaggacgattgcattcctagccatatctgttttctttcagatggggcgtacaatttaccttttgagttctgtaaatggaatcgaggtgaaatctttactctggtgcacatatgacctgcaggttgatgctgcttgtttggaaagccctctacttcacagcgaacagtttgtactgtcaggtagacctctctgccaggggaccaactcctgtgtatttgaaaaggaagacaaacctgtattttgtagaaagggtctattgttcccagggggtggttgtggccaacttcttggactcctttggctgactctgaagaaggaattgaagtcagaatgctaatcactgacttgcacaggcctcaacaatcaaacctcagggaactcagaagaaagtaaacaagagcgctcaattgcagagtcttgaagaagagcagctgtgtaaaggaggctagacgtgaaaaaaacgtgttggagaggaaaaaaaatcacattccctgcttctcaaatgggaagtcttaaaaataataaagaatcctgagcagcgggctcatttcccatgagcaggcttgctgtggcaggcaggctcacctgctagaggtggtctcctggcttagaatgggagcacacctgtgggaatcgcagcgcttctctacctgagctggatgtagattgtttgaaaatcctagttgtgcactgcgtttccatcgatccctttcatgctcccacttgttcctttagttccaaatagcaggctggtgttgagaattctgtcatcatggggcgtttttttctaaatgtgagaaatgtcggaagcatgggtgttctcagattgctttagccactgatgattttccttttagtgtatggaaagaatgattttcttctcaatttctcccctctaacctcctgcatgtagatttatggattctaatcgggacctttctttgattcagtgccaggtacacaggccccgagtcgtatgtggcaagtggccaaggggatcggtcctggagaacgtcatggcacacaggcattggccatggagtggtgatccctggctctggttcttctccgtccagtgacctggcatgtcacctcacagggccatatttacctgttaactgagaaactgaactagaacatggttatgataattttaatctcaactttgtctcctcctatcttatggcagtaaagtgaccttttagcaggatcaatttataagccgtttgaagtctatcttttcttcccttagcagttgtatttgtgattttctcagcctgattttaagttattctgttataattttgaatgttctgttatgcttccctctgtggtgagcatacgtcgaaagctgtacatttccttcagggtaacctttgtttccaacaggagagagttctcactaccacatccagccttgatctctttaacctaaattggaataagccagacagagctggggttcatgggacagatgggagcatctcaagtttagggttggggagtctcagtgaaaaaaaaaaaaaaaagaacaagaatgtagacttggaatttgagaacagataaagcagtcctcacttgtgctctgcaagggagtgctgttgtcttctaaggtattgaacagactgggtgggaagctgctgaaagactggaaatttggggacttagcaagaagtataatggtgctgtaactgcgttttcttaaggaaacttggagctgaggtgccacctccctgggagggacttttccactggtttcttgcagtctggacatcacagacggcccagactcccccctgtcttgtgtacattcccttctacaagccttgctgtgttatcacaggtaccacttgtaggccagtatcatgggggatggacattgtttcattctaggcacattcaggaatcgtatatgtaccctgcctcgcttctgacctctcaagtcaacttttggagctgttagtgacttccagaaagctgacacccagtgccactcaaccaaccctgcttttctgctggtttatttttgttattcctaccccgactcatcttgcttttcagccatcaatgagaatttattgagttactcagacactcactcagaccctgtgggagagtagaaagatgtgtaagaaactgtcccagaattttgagggacttaaaatccattcgaaaaggcaaggtctaagcacatgaaaagttacctagcaatatcagctcatgaatggagagacagttgatcagagaaagagaaatgtctgttcaggagtggtcaggggaggctgcattgaggtgatgcacacgtgtggcctgaaagcttgattcgttccccaccccccattgtattctatatgtaatatttgatatataaccaagaagctatgtgagttacaaagcatgatgatacagtgaacacctatgaactcaccacccaacataagaaccaaaatgactgatattgataccctacctatatacctctaccttcttcctcattctacccctgccctcttatcccagttagccactgtcttaaattttacagattttattccgttcctttttttcttttttgaaagcgtttgatcttttcttctctcctcctctcctctcctctcctctcttcttcttttctttcttttcgagatgaggtctcgctatgttgtgcaggctggtctggaactcctgagctcaaatgatcctcccaccttaacctcccaatagctgagaatataggcctgtaccactgcacctggctagatctcatgttttctttggaaatctagtaattgtgatataggatctctgaatgcagaacacctagggcacaagtgatgcttaattttatgtgtcaacttagatgggccacagtgctcatatgtatgatcagatattcttctggatgtttctgtgaaggtatttatggatgagactaatatttaaattggtggactttgagtaaagcacatggccctccgtaatgcgggtaggcctcacccaatcagttgaaggcctgaatagaaccgaagagggaatgccacagcagatggccttcagacttacactgcaccaccggctcttctctgggtctccagcctgctggcacatcttgcagattttgggcttgtctgcctctataagcacataagccagttccttaaaataaatatctgtgtgtgtgtatgcatttatatatacacacaccaccctattggttcactttctctggagaaccctgactaatacagcatatcacacctctctgtatgccacgtaggtagcactgcagaattaatttgcagagtattctcacatcgggaggtcagcagtatattaggcgcatatcagaaaggcatttggatgattctggcctacaccatggaagagaaaccttgattttctgtaaaagcaaggccagctttttttggagaactcttttctcccttttagtattctgtcccctcccaaagctccgtggctttctctggtcattcagagaccgttattccctccccagcatacatgcacactcatgtctatggtttcccgtaccttctctgtggagccctggttctgcctgttacaaggaaaggcatttagtttctctgacctcctgtctcctcagatgtcagtctgtatttattatgtgtcaccatgtactagatactgatttaagtgctttgcctgtttattccatggtattttcacaacaatcccaggtggtaactactatcatcttgttcattttgcagtgagaaaatggcaagaaagtcatagaaatgggatttgagtcctggtagtccgactttagagcgcttgcttctgacgcttctgaaacacattatgaactggaaattgctctacaaatatacactactgttagtatcacaatgctagtattatagtgcgcctattgccttggggccctgcgctctgctagttgatagctagggcatttttggagctgatgcaggctaatgagggtcgttgataggaaagtattgcttttcctagaaagctctggttctttgacagaagccttctggtggccacagttcctgagccctaagaagaaatcctgtagggtacctctaggacatgatggttagtgtagggtcatgagtctgctctctggtcatgtcaagaaagctgccccctactttgtgtttaagcagatcctggaggctgcaggatagcccattgagactaagtggagaccaggcatcaggtgaggaagccttagcttggagggtcagaggcctcagctagacttggtaaatatttggcacttcctctccctcacaggaccacagcaaatgttaaataatcacagcactctttagtttgaccaccactaatcgattgagttgggcaaatagcatggaaggtctttgcctattctttgggagctctgggtgtccccagagaattgagtctggcattaagttttgcctctcctttctcgttttcttttcccagccatatttctccaggttttcagcacaaactcaacccgttatttttgtttcttcagtgtctttaactctttccctgcctgttgagatggagtctcactcagttgtttagtaatggcagtacatcgagaagaccatcacacagcaagagttctaggagtttctttgcctgtgaggttagttttctatatttcatttgtggagggaacagaagtgatcccatttaagtgtggaaactttctttttggaacattttccttcctttttcttcatacatcgtggttccttctctcctgcactctcacatagataccagtatatagagatactgtttctaatcctgaaattccttttttgaagaaaagagaacattgtgtgccattgttttctgcgggagatctatgctgcgcttctgttttccaaacatttatccttaaagcattttcagatgtcagttaaacaagggagcaatggcccctgggtcctgttagggacatactcttaatgactgtaaaatgaataaggtatagaggaatattcgtctgaagtcatgatttgtacgtcatttccttgctttcttcaacatcattatttctgaaccagaaagtattttgatcaacattttggaggaagaattgtatggtatttcccaaccttccccccgtgggtggaattgcatcactgaatcacttttctctatttttttccactttctgtctcctgttttgtcaaggctccagcaaactccagccttttttctgtgttttttagtcctaaaattctagcctggcatctgcgattgtgttagtttcccatcattattttctagcctaacaaggaagcctcgtgaaaacaaagcgttctgtttaatcctcaggtggacgtttgaaccctcgtaaacatgctcccttcacccccccatcttactttttagcaatctcagagatcaaaaagacagtcatctcatccagtgtagacaaagtgaagtacattcctttcatttgcctttgctgtagtccctatttcatccatctaatccgttttaagggataaaattgcaattacaaacatttcatgtgtggtcagatttttagtattttaatctggtctgagacttaagatgaaatgacagttctaacagaggtcctgtgtggaagaaaggacctaggtgccagtctcagtccagtcccttcttagacgtgtgactttggaaaacctctcagagacccatcatctcgtcgtagatggggatggtattacaggtcgtgctcatctgtgttaatcagggttctccagagaaacagaaccaataggagatccacatcgctgttgatgtcaatagatagataggtgtgtatgtagggatggcaggctggagaccctgggaagagttgatgttgcagtcaggaggctgaacttcctcttccttgggagacccaagtttttttctcttaaggccttcaactgattggttgaggcccacccatattatggagggcaatctgcttcactcagagtctactgacttaaatgtccatctcatctaaacggtatcttcacggtgttcaggcaaatatcggtgccacgtcctagtcaagttgacacctgaaatcaaccatccccctcgcaggagtttgtgagcatcaggtgtgaatggtcaggagctgcaggcgtgcacggaggaggccactgttcttcatgcttgagccttttctgtttctgcctcgtttactttccttctctctcctcactgttacccttttcctcctacctctgacacctgcccttcacctcccacctgctacctgagatgggagccacacgtgaagtgagaagaagggagaatgaccaggtgggtgatgaatttaaactggaaagagaacagatcctgatgccagtcaggatagaggtggtctagctcttatgtgatcatgggcaagtgaacatgcctcagtgagcctctgatcagtttctgtatgaggataattatatttatcctctaaaatgaggataatgatatttatctgatacagttcttctgccctaacacatacgtgtgcattgcctttgctttcaaatgtttggtaatcacctttttagatttaaatcattactcaaattgaactctccttcagcctttgtgtgtctagactttccgttaagattagattacttgttttactatgattgtaaaccattgtttccatgaagtctcatagcaaatgttcttttgctttcctcttttgttactagtctcttgttatttctcaaacatatcaagcgcacttctccctcagggcctttgcgtgtgctgtttcctctacatggagctcagatgactgcatgtctttttcctaaacttctttgaggtgtctgttcaaatgtcttccactcaggggggctttccctgagcaccttatagaaaataaataaaatgatataatatctgctctcacgttctgttgcacttgccttgctttgtttttcttcatagtctttatctggaatatatatttatttctgtctacatcctcccactaggacagtggttcttaaccttggatgttcattagaatcaccctgggagtttaaaaaaatcctctcctgtgttctagaacaattaaattcagtaatgttataaggaagagactcagcattagtattttgtaaaactcccaggagattcctatgtgcaaccaagcttgagaaccagtgttctagtctagaaccttacttcccagaggatgtggactggtggcatcagcatcacctttatttgaaagctgagtccaattcttctctttggcaggacccacagatgatgcatatgacattaaagcttgagatgcactgcactagaatgcaggggcgtcattttgcttgctgctgtatccttagtgtcagaacagtacttagcacatcataagcactcactaaatatttatcaaatgaattaacgttggagatgagaggaaggaggaggtaataatggaaagaggacaaagaaagagaggcaagggaagacagaaagaaaacagatttggcctccccacattttctgggcacagatataacggctctctcttgctctttgctcccaatcaaaactcagccagcctcatgtccaacatctcatgggcttgcctccagttctctgcactttccaaagtgatagctgactaatcaaagatattgtgataatgaattgcctaactacgcagcctgccttcttctcttctagcatgtatttgattaggggcctgctgaaaccaattaagtaaataattcagtatgactttatgaactacctactacatgcatggcttaacacaggcagcctcaagaggctgagaaccaaagacggaaaaagcacaacttatagtccagctatagagacagacttttaggtaagtaatcataccttgaggtgaaaaaaaaaaaaaaaaaaaaaaagatctgtgatggaagacacttacagacatgtagacagggtggtgtggaaggtctacagtaagtgactgtttcagactgaggggagggagtagactcctggtgaggagggcaggggcatgtgagttgcgtatgtgagtggctggaacacaaggtggggaggcatgcttgtgtgctttggcaatcacaaagacggttagaaggcagttaaagggttggagtatggtcagttctgtgttttgaagagatgactgacagtcgtggaaggtggattggagaaggaagaccatgggcccatcacacccagtttggagatgattaaagatgatacccacgttacatgacagagccgtggcaggggcaataggatgtaaaatgtggagatcgttttgagatttttcaaatggggaagaccatgtcttttttgtttaaccgaaatgagcaggaattcttggggtgacatcaaattcgatagttctatgagcatatacactgaaaaccacgatattacggaaatataggctatttctcttttcactggcctttagatagactggattagtggagagttgagcattcgtcttttcttagagccttgagtggagatggaccctagtgattatttattttgactgctttattttgaagatgaagagaaggaggccaaggtatgaaatgattatcagaaccaggaatgcaacttgaggtcaccattactagatacatagtgagtgccaggtggtttaaatactcattatcaccttcaatcctcacaaccattgtatgaaacagggatgctatgtttattttagggatgagaaaacccaaaactcaaggaggtaactcacccaaggttttgcagctagtaagtggtacagctgggatccaaacccaggtgtgtcccagctacgctgtgccatctactcctctgccctgctgctttcctaatcagtactccctgatgctgctgaggaagagtcgaacttatagaggtcacacattgttttccttgtttttggatgcagttttgttttctttgataatcataaattgaggatttatgacagccgatttctctctgttattttggtcacaatttcacaatgtgacctttggaagtaagggctttgagttccttaaaatagctaaattgagaggataaaggaaaactgactcaaatcagagaatttgcatcaggtttctgtaggtttcttataataatcaacaagtatttagcaattcttttttcacataaatagaagagccaagagaagaacagcgtctttgacctgatggtgttaagcctgcaatctgggtaaaaaggaatttgcggaacactctggatctgatactgaaaagttgaagaaagcaacatcttgcttattacccttgtgtttaagaccatttggggccgggcgcggtggctgacgcctgtaatcccaacactttgggaggccgaggcgggtggatcacgaggtcgggagatcaagaccatcctggctaacatgaaaattagccgggcatggtggtgggcgcctgtagtcccagctactcgggaggctgaggcaggagaatagcgtgaatctgggaggctgagcttgcagtgagcggagatcatgccactgcactccagcctgggcgacagagcaagactccttctcaaaaaaaaaaaaaaaaaaaaaaaaaaaaaagatcattcggaaccgaatatgtgaagatcagggctgtgatctggtgaattgggagtgatttatgccacccaagcgagttgacctgaaccgctggggtccatcatcctgcttctgtttctgcactggcatttgtgttagtatttggtggaaggtggttcacttttggctgaagttggtggatgtgggcagagcaggattagttcctttcttctgccctctcttctagcaatgctccaaggatgctttggaagactcattattcagagctgcagctggactgccttagacatctgcatttctctatctctgaaataagggactcaaacaagagcatcactcttttcctttccagctctaaaattatgtgatttttctttcacatggtaagtgaaatagtcatctgagctgctgtagtaggttgagcttattgtatcccagatctgagtggttcaactccatgttcatgctgcccagttccaagagcacctctgtggccttcaaacagttgtacacagtctgtaaactgctcagccacttctcccagtcttctaagcaggcaaagactccttatctcttagatctaaaatcattaggtagattttgattccaagggtcaaagcacagcatggtaggcagcaagctctcatccaagcccgtatttcagcaggcaggcgatgctgaggtgctttaggccttcagtgcacacagatagatgcttcccctgagcctcagggaaagctttattttgcccacgttgtattccttcctgcatcgtatatgttaatgttgctctgccactccaaatacagcagtgtctgctcagttccattttcttccttttgcaaagagcaggcaaccagctatgccttcctgagagcagacaaacctggagccaagggggccacattttcagcttcaatagcaattgctgcagctcccttatttcatcacctattaggatgcgcaggcggcgctaagtgacacatagcccataaaacatatctgcttcctgctgatttcatggttctggaggacaggctgtgcacagggattcagacagagtgtagtaacaagcaggggtgctatggaatattcatttatcctaaataaatatctttttggcaactgcttttccctatagtgtaatacagtaacgctatggggcatgtatacatgtgtgtgcataaggaacatccgtccatctctagctgtcatgtctgagaacattaataaaaggctcgacctcatgcgcctgcaagtgatcacaagacagttactgaagcattcaaagaagcaatgtctttgtcatctgactcattttgaaaacgcatgagaatgctttcccaaggcaatttcttacaaaatacaccgtgggacatttttcctatagtttattgttgttgatgatcatcgagaactttgtacccagagacactctacactgtgagtgtcccctgatattccctcccactcagcctgatcagtggtatctgacctccaactactcgctgcaacaacccgttctctagctgagtgggcctggactttgaacagaattaacagcctggaagtggagttctcaatctcaacagccccttacctcatgcaaatttcttttgagctgaaaagaacaaacagaatgccaccttttaaaacaaccttcttcgaaacatggggggaaagtcaggttttatataaatcagagagatagaaataaggcccataataaaaaacttgaaatagatttgggaagtttccgaaacttccaaaaactagtggtccaaagtgggcaatattttttgtgtgcattgagaggcccttcctgtttccttggtccatgctggtgtcttgccccgttccaggaaccctgggctcccctgtgctgagcagcccccacacctcagcccaaagcctcaccccttgcctgaccacaccccatttcttttggcacagcttcccagacttacaagatgtcttgaagtgactgaatggagttagtgttcggcaggactggctaggtaactactgggacttggtgcagaatgtagatgtagggctccttgttcaaaaattaggaagaatttcaagatagccacagcagagcattaaaacaaacccaggttggctaggtgtggtggcacactcctgaaatcctagcactttgggaggacgaggcaggcggatcgcttgagctcaggagtttgagaccagcctgggcaacatgacgaaaccccatcgctactaaaaaaaaaaaaaaaaaaaaattagttgggcatggtggtgtgtgcctgtagtcccagctacttgggaggctgaggtgggaggcttgcttttaagcctgggaggcagcctgggcaacagagtgagactgtgtctcaaaaaaattctcagacaagcacaggacctctgtatgactgcacaggtcacaggtcgcacactcacgaagccagcccagtgctcaatactgtattttagaataagcaggaatcagtttagggctgccagacttgcagaacaatcactgtgagggctgatggcagatccctgatctgtgattcagaaagagtcattcagacaggcattgcccagagtctgggttctctctctcctgaagttgttgaggctgtgcagaatgtatgtgtttagtgtttcatccagtctgttagggtaatcagtgtgatttctctggcatctccaggactggaagcagaccagatttaatcaaagctgttgaagctgcccagggactggctaagctgccaccctgttagtgaggccgctggggagagggaaactgaagcctgcaccacggggagccgtatactggagtctggaatccatttgctccacgcaggaggcctgcatctcaagtcaggaggcactgcctggaaatctagcatcatgttgatactctttggtgaaggaaatgtggtccttgccccaagttatctcacagtccctttgggcaatctcatgcatattaaaaataccgacaaacatagacccacgaaagatcctgatcttttaggtctgtcatgtgatagagacagtaagtgctctgtatagacatcaggagattttcttccctgaaggacaagctcttgtagcattttcctgcactgagatgcagtcatgctagcctgtctttcactcaccagggatggcaaggaaggaccagctgacaagtaataaagcaaaccagtttgtaattttacagggctctgaataaagatgcatttatctctggccaacaccaagaggcctcgatgtctctcacagggaggaacttgatgggctgtggcgtcttttgggggtgctagggcagagtcaggcttgaatctgagaaaggcaagtctgtgcattaaaatccagcacgggggtgggtctggggcaagggacaagagagaagcgggaatggaaggcagggatgaggactggtaacagaccctctgcctccttccttcctcttccctcacactggctctttcagccacttccctcactgagataggaagcggtcctgtggtgacgccaagggcacaggcttctgctgtctgggctccggcacagtcattggctctgagtcatccgggaaggaaaggcatcttttaccgccccctctcccaccgtggcctcaggctcccaccatgcaggaaatgcctggtctcccacgaatcagaagctataaacaggactggtggcagttcatacagatttggcaaaggacgagaagctgtgggttattggtatcagtgattatagaaggggaaagagttgatatctgaagataggaaaaggggcttctgaggatggtgttagcatgttcaggcacagcattaatctttaagagtcacgaagagccatcagcacagtcatctccctaataagccttgagagtgttgtcaaagacacttctggatataagtaagaaaccattgagactgagttgtatggttaaacagcacagtttttagggagaggcaaaggcaactctgtgttcagctcttagttctgacacttatgaactcagatttaaattccctgagcctcagtttccctgtctgtaaaatcaggataaaaatttcttgctcaaggccaacaaaaacaagcaatggggtaaaggactccttattcataaatggtgctgggatagctggctagccatatgcagaagaatgaaactgaacccttacctttcaccatatacaaaaattaactcaagatggattaaatcgaaatctaagacctcaaactgtaaaaatcctagaagaaaacacaggaaaaacccctcttgacactagccttggcaaaggatttttggctaagtccccaaaagcaattgcaacaaaaacaaaaaattgacaagtgggaactaattaaactaaagagcttctgcacggcaaaagaatcaacagagtaaacagcaacctaccgaatgggagaaaatatttgcaaactgtgcatccaacaaaggtctaatatccagaatctataaggaacttaaatcaagaggcaaaaaaacaataactccattaaaaaatgggcaaagggcatgaacagacacctcttaaaagaagacatacaagcagccaacaaacaagaaaaaatgcttattatcactaatcatcagagaaatgcaaatcaaagccacgacgagatactgtctcacaccagtcagaatgctattatcaaaagtcaaaaaataacagatgctggtgaggctatggagaaaagggaatgcttatacaccggtgggggaaatgtaacttagttcagtcattgtagaaagcagtttggagatttctcaacttaaaacagagctaccattcagcccataaatctcattactgggtgtatatccaaaggaaactagatcattataccaaaaagacatatacacttgtatgtttactgccacgctattcacagtatcaaagacatggaatcaacctaggtgcacatcaacagtggatttgattttgttttaatgtggtacatatacaccatggaatactttgcagccataaaaaggaatgaaatcatgtcctttatagcaacatgggtaaccatgttggaagagctggaaaccataattctaagtgaatgaatgcaggaacagaaaaccaaatgctgcatgttctcacttataagtaggagctatacatcgagcactcatgaacataaacatgggaacaataaacactgtggactactagagggaggagcgggagggggttaatgagtcagaaactacctcttgggtactgtgctcactacctggatgcaagatacccatgtaacaaacctgcacacgtaaaccctatgtctaaagtaaaagttggaaaagaaaaaatatttcctaaattgttctagaattaagcaaggtaatatttataagacatccagcagagggtctggcaccctggcatataatagatgcctaatgaacattagtttccttatttttcttacgagagtaaaatattaagatgtacatattctgttaggtcatagaaagtttgaatggtgggaaaagtcagctgttaaaatgctgtgggatctctttttgagccttttcacctgtgatcaaagttgtccatcaccctggcatttttgagagctgtaatttaaggaagaaggtatcataggttacctctgtggaaattctagaatttgaatattatgcccctgctcacttgtagactgggctgtcactataaagttaggctgacttgactgtatctgataattaggggctgggagagcatggaaaattgaagccatagataatcccagtgtcttgttttagccaataataattcttctcccaccaagtctttatcagaactgctaacaaggagaaaagtcgactggtttgagtttcctcaccttttattctcccctgggtatcttcagtagaggtgctaatgaacagtgaaatggccaaaaggtgagcagctccagggaggagaagaaggaggctcagataatccacaaactgtaatcgctttgaataattgagttaactccagtaaaatgtagagatacattcacctgctaggcattgttggaagctaaattaacacactggaagcaaagctttcttttaagtttcatttttaatctaatggtggacattttggggcactgcagcctattaaatctgctaactgatgttcagacgttatgaaggagttaaactattctaagaatattcaaggcctgttgttctctcctaggctttctacgtcaaagagtaaagtcagaaaagccaaactgatttctcctaaaatgaagagaattgaagttactctcccaaaccccagttgtaggccaggccctaaactgagagaaatggacaacccaaatattttgacctttgcccattgccaggtgaggccagatccggggaggaagtgatgttttcttatctgccttaacttagccactacgtggagaagcactgtaatgtaattaatgcagaggtgctcaaattctggtgttcctcagaatcacctcaggggcttttagaaacagttgctgggccgttctctcagagtttctgatttggtaggactggggtgggacaaagaatttgcaaatctgagaagttcccggttccagggaccgcactttaataaccacaggtgaaaccaatgagaagctgagctccgaagtcagactacctgggcttgaatctcagatctctcacttggtagttgtgtgactgggtagttgatagtttacagaatctctttgtaccctcgttttctcatttgtaaaatgggaatcctaatatctcataggattgtgagtattaaatgaattaatatgtgataagcccttagaacattccctgctctatggcaagtgtgcattgtaggttagtatgacacggttataggctctctgtaacaatgaatatagtgactgatattttttgagcacttactataggccagagattgactcagtactttgcaaggattatcacatttaatacccacaacgcactctccctcctttcccatgtcctgcttgccttctttcttccactttcagttattcctttttcccttccattctttcttgctcttcaaaagccatattgtgacaaaattaatccattctaaatgaaaaagaaaatgtaccttagttataaagtatgacctttgtgagttttttcaggactgttcacctgttctttgccttttattccagcgtggtacccggcacatagtaggagtttggtgaacattaattacttgaatctcgttatccttaaaaatcaaacagggtttatctatcagggttcccttctcttcctttgtcctatcctggcctctccttgaccaacacattggtaaatttggcctctgctctttcttttccccaactgcaggggcccacatgtcaagacaaggtggcatcaccaaccattgagaaagcttttatttcactagcttctacctggaccacccatcaaaaatctttaaaacgagtattccttgggacaaggccaggtgtcattgagagtccccaggaagagcataggagtcctggtctgggagggccggacctacactctcgggggtgcccagaggaagaacagggcctttaaagtcaccctatgttctctgacccgtgcagtggtggcatactccctcccccacccctgacctgagggtgctgtgtgtcagctctcctaactcttggtctcattagggaagctggttgtcaagtactgcccagttacagttggtttaaactctcaactaagggatcgtaagcaggtcagctgcctgagtctccagttactcttgcagctcaggtttccccttgacaggtcctgataggggctacttttgcaccattgatgtggccagggcttacagcaaggtttaaggtttccatgcgcagccttcttggcaggcagctcccagagaaaggagtatggtttgggagaaagctgcaaggcctgttcgtggatccttagtattttgagccgatcacgtggagtgggcctgtgcccatcagtaccaggagactttatacttaggggagaatctgtatgcggtgtgattttcaagggtctatttcctcattgtttctctttgcttgccctatggctgagtattaaatgaacattgaaagtctactatatgccggttactctgctagatactagcagagatggagggtaggatacaaagacaagtaaggcctagtcttcaggaagcctttatttgtgctctgtgtatcagaagagggttgagttggtgacaagaataaagagttgaggggagtgaggggctgaaaaataataagccttagagaactaggaataaagtgttaacttgggaaaattgttgaaacagttccttaagatatttgtagtagatatgtctctagataagaggcttgtctggctgtgaggtccttgcacgagacccttgcaggtttcccaaatctatttggactgggtgtcctgtattaacatgaaatcgtaggcagacactgaataaatcgcaacagagtttcggttgtggctgctccagtgtcttggagtggttgctccagacacataggtcttatcctcctgccctgaggttctccaaatttgcatttgggaagtgtatagttttatgactgtttcttttatcgtgaacttacggccaccccacttccctgcccacttccccatcagcttcaccttgggtcgcggcacatctgttctccagaacatgttccctgccaggaatctgcagggagctcttaagacttatctttctttttagctgttttttttttttttccactcaacttctaggctagtgctgagtacttatatgtcatgctgtgaatatgtgtgtgaatggattggtcagaattccaaattttagttgtaagaaaattcttttgtgcagcgtgcatggctcaaaatgagagaaaagacactgacgaggacttggcagccccgagcttttccttgggatgttatttgctttaataaattttgacctattttgtaacagaccaggttggagttccctttttaacctgctgtttcaacaaagttaagtgcattgaaggtctatctcaaaggcaatatatattttaaaaatttcagaatcctattctgaggctgaattatggctttttcttttcccataggatttacatgtacactcatctgtattacttcagatgttgctgctgtagtttggatgtttctctccccaaacctcatgttgagacctgatctccagtgttggaggtggggcctaatgcaaggtgtgtgggtcatggaagtggatccctcttgagtagattgctgccctccctgtggtggggtgagtgagttctcgctctgttagttctcacagaagcagattgctaaaaagagcctggtacctccccctgcctctctcttgcttcctctcttgccacgtgatctctgcacacgccggctcgcctcactttccgccacgagtggaagcagcctgaggtcctcaccagaagcagatgctagggccatgcttcctgtagcgcctgtagaactgtaagccaaatgaacctcttttctttatgaattccccagcctcagatattccttcctagcagtacaacatgactaagacagttaacttcccatctgactccctccagttgcttcaagggtaggcaagaattgtatattagctatttctacatccagctgtgtatccacagtgcctcttatatttggcctatagtacatactaaagaaatgtttatgtactctagaaatgtactcaagaaatgaccaaatgaatggataacttggctcatgagaattcttaagggcatttgaaatggcaaggggtatgtttggaagaaggagtgtgaggagctgaaggaaaagaggggagaccagctgtgttcagaacccacagtcatttcctcaggaaacagtaccagatatccttggatgtggggaaatgatccactcttgcagtagcctaggccacaggtaattttgtgtacccactatgcacttagctcatacagtaggtcgtaaaaatgaaaatggcatgattccttcataatctaggtggggagacactataaatacacaaataatttaaaagtacagggctgagcaccgtagctcacacctgtaatcccagcacttcgggagggcaaggcaggaggatcgcttgcccccaggagttcaagaccagcctggacaacatagtgaaacttcatccctagaaaaaacaattagccagctgtggggcatgcctagagtcccagctacttgggaggctgaggtgggaggattgcttgagcccaggagttcaaggctgcagtgagccgtgatcacaccactgcactccagcctgggtgacagagccagaccctgtcttaaaagaaaagtacagattatttcaggattaagcatatgagtacttaggctagagagaggcagagaaatgactcctgttttccagccactgtcacactgcagtgtaagccatcgacacacacatacacttcacttcatctgcacagcctttcaagataggtgtttttatctccagtttacaggtgaggaaaccgagctttgggaccaagttacttgtgcaaatcacacagctgggaaatatcattgccaggatttgaatctgagtctgcagcaattcagagaaagggcacgcacagtggcttttgtgtcagggaagagacattgtctgtattgtgggggtaggtgaactacggctggaacaccagcatgcagaggacttgccttttagctctgaggaggtcgcctgcccttgcatatctataaacaaccaccctggattgagagctgttgaatggggagtttgtctgactcccagaagagagcacagtacaggagaaaccttatataacgcagacatgcccggcatcccgcaggcgggcgcaagccaaccgcacacctcacagacccagcttttgttgtgtaggcgctgtggtgtaaaaaccatcctttagggccctctccctcgtggtggcagcgtgcctgggagctttctgttctatttgtggtatctgttccctttgatcattgtgcattgctttgttcctcatctccctctttggtgtcacctgtgaagtcactggagagccataatcatcctaaagaaagactcagagaagaagaagtaagacctaagaaaacagaccctttagcctccttggagctggttttctagttaagaggcttgattaaaagcgtggggggaatggatctgtgacgtacatggtcatgaaaagtgcagccagcgttacagcacacgtctgtataggttgcatcacaggcagggaagaggcctaagggcctggtggcccgcaggtgtgagcccctctggtggctccatgacaggagaccccgcggagaaagtagctcctcttccttttttaaatttttttttatttttattttttactttgagacggagtctctctttgttgcccaggctggagtgcagtggtgcgatctcagctcactccaccctctacctcccgggctcaagcagttctcctgcctcagcctcccgagtagctgggattacagacacgcgccaccacgcctggctaatttttaaaattttagtagagacggggtttcaccatgttggccaggcggttctcgaactcctgacctcaagtgatctgcccgcctcggtcttccaaagtgctgggattataggcatgagccaccgctccccggcctccccttcttataacacttgaggcctgtgcttcagttcatgggccttatgtaaaggcttctgtcacctgtctactccttcttcaagctggctgtttattcggcacagaggagtaaattacaggtggattatgcagtgacaagcacttttatacctcctgtaagaacagtttataccaggggtccccaacccccagaccgcagactagtactgtccgtggccttttaggaactgggccgcacagcaggaggtgagtggcgggcaagtgagcattaccacctgagctccgcctcctgtcagatcagtggcagcattagattctcgtaagagcacgaaccctgttgtgaatgacacatgtgagggatctaggttgtgtgcttcttatgagaatctaatgataaatgtcatgtgcttgaatcatcctgaaagcatccctctgcccccagtccgtggaaaaatgttcttccaccaaaccagtccctggtgccaaaaaggttgaggactgcttgtctatgccttaaaaaaaaaaggtccatttactttgcagtcatagaggacgcagggctggacttgaggaaatctacctagaaatccccttcaggttaagatttatgacattagcttcactattgaattggatcatagacatctataattaaaggaaaccatttacactttattgttcattaaatgtttaaaccacctgaaaagatttttttctaattgagcctttttgcatagttaccagttacccgtatctgacttcaagtctttagccgtatacctacatggttccatagttatcaatgtttatttacaatttaatattcttctttagcattatttaatatcaaaatgataatatgtactacggtaggttgggctttacagcttacaaaacactttgacatacattctctattatttttgatggctctgtgacatactgaactgaagcaacagtttaaggctatttctaaattgggctctgctcaagtgtgagaaagcgtgacagtcaacatgaactagctttagccttatcaccgtttcctgctcaggcaggtaagatctgctgaaggaaggaaccgttgccaactggccaggtgtgccagttcgtggcctagaaggggcagctgtcagttgaactttgcccatgttttcaggattttatctcaactcctgagtagtctcatctgggtgggagcactagaattgaaggcctgttcaaaggttttgtgcctttaactggagaattttttggaagccccttagaactgccaggcagccatgtgggatcaggtgggggggactgggctgctgtgtggtagatttgagttcatgtctcataaatggactctccccgaatctgagagggttgctccctaagtcaactacttaataattaatggaaaggagatgtgacaggaatagccaatttccctgtcctgtttggtatgactgttggcaatttgatgattccttccttaaccttgaagcaatctcagtttgactgactcatactatggggaagatagtggcctttgaactcttgactcaatacagtcttgaccttggttagatactaccttgacctctggataaaactgtactgggcattactattttattgattgttctctcaacaaaacaaccgtatctttaaaaaatttttttatcttacatgtctgaagtagaaggtcacctcttttgtagtgaaaaaataactattttccccatggtgtgctgaatgcatgggttaaagcaggtagaccagctgtcctgggttttatccctatgtgttttttgctgattcacaaaggcatttaatttctctctaccacgctttctaggtctgcaaaatagaaaggggagttcatgaccatctatgcgttactgggggatttttctgtgcaagcgaaaattattgatgcaaccagaggacttgctgccagcgtcgaggggtgcattttactccctctgtaaagaggccagcagtaatgatagaaacacagtgcatttgactctgaccttatatttgacaactcttcctctacaatccttaaaaaacatgcctcaccatttaagagaccagcagcaggccttcagcaaagcccacggtctaggcagcctttgtaggcctctgggattgtggtgagaaaaccttatccctctcttatttcctgataactttacattttagaggtgtctggaaagaaaggtggcagaaaagcagcataacctgcttgacaagtcctgtacaaacagaagtccaatgaggctgctgctctggggttgccaagctcaaggaagccaattgtagtgtgcacaaaggtgcaagtcaccaaggcctcagagagctccaaggaagcctgtgcaaaggcaggatttagagttctaaggacgggttgtccagcgcagcccagcagagaacctaggtccataactgtggactctcctgtgagggagccatgttgcggggtggacatctgacagttgtccctgctctgtgaacctgcgacttcatcctacaggtgcagagaatggttttggcaactctctccaccgcagaatgtgggcggacttctgagctgggtttgattttcctcttttgctttggagtgtacaacaatcaaccctttagagcagaagtagaggaatggaagactttcccatggcccaagacccctcagtgggttgctgtttgctcttccctagaatattataatgttcaatttatgcctccaggagaccagagacacacgtttcccaaatgtgggtacaggtggctttaagctgtttctgtgagtagaggcccagtgacatgttccccagtgtaaccccctccttggtttcacatcccctctacccgattctaggccaagcccctccagtgtagttggtgacccagaacaggtgaaagtgaggctgccttttgtagcactgctctttgtgaatgggaagtgctgctggggagaaatgattttaagtgtgagctttgctgttaggggcagccctctttctccactgcaataagaagagtcatgactaagtctagaaaggcaggttttgatctttaggatactgtgatgtatgaaataaaggtatgtccttcttattcggtgttgcattgtcagcacctaacacagtgtttaattaaagcaaaaatttttgtattgaaaatataactaggtggaggagtaagtcagtgctacttaagtgtgagtatttgtcttccctgatcagatggttttctacgtactcaaaatttcatgtagtaagaatgcaggatgcttatggagaaaagtgagtgttgtttgtttctccttaatatttatatataaaagcaagagcttattaaacttttagacgtctttggaggtttgaaatttcccactgttattcttaagaagagaagagaaagaataattttttttcttctgtcttattggcctttaaggaaaagcgaatttcagaaaaacatgggacggaacaggaagtgtttacaggtttagtcatacttgttaggtatgaaaaagccccactgccttctcatattgtttcttttatgaacttaacacttcctactttgagaataccttcctccccaagggctcaaagcccttcatagtcattaatttgcatcttgctaattttcttaaaaaattaaaatgttaactaccatttagctggtattctaccagctaaaacttccagctaaatgcattttgtctgtctgtatgtattagctcagttgaaaatgtgatcctactgaaggcagtagggtaaccggcttgtcccagtttccctgggatttcagttttagtactgaaaaccccacatccccggaaccccttcagtcccagacaaaccagcatggttgggtcacccaagaaggcgaccagttcaggtagctctgcataaagagaagatgttccaccctgcagtccttaccttaaatctaggcagctaccttaagaattgacctagacagcagtgtgtgcatggctcagtgcaaatctttagcatcacctggtagaagacaacactgagcacacagtcgcagaactagtgcagttcgaggtacgtggaaatgtctctgcaaagtaatatttctggtttcttgtttttttgtctacccttttcccctttactgcactatatggtgaaaaacgaaaacaagaactgctaactacctgatttccgaaacaagaagtgtgatctcaaatatttctgttgatctcaggtttttcatctgaaaaatgaggatgctggtctcaatttctaaggccccttcctgcccaaacttaccaggaggaaagaagctggaagtagaaagcaggagaggttcaaaaagaaaatgggatgcatctcctttagtaagctctactctggagaaggacgttgtccttcaagtacaaaccttttcaccgacttggggagtttccccccattgtatcccaccccatctttttctgccatcgtgcactgtgtcgtttgaatgtgctgctttgtcagggctgggggcttccttggtgctccagcttggccacatccgacacacagaccaccccgtcctccttctgcctctagaggaccaagaacaacccttgttctgaaagcaccctgtccctgagcctgaacacatgaccctggatgtcagaagatgctcttctccatttcaattgcccaattccagctctgtaatcattatgttaaatgatacaagtttcaaaaaatatatatttctaatagactttctattatcttccttaaatccacagtgtcactttcattcttactcctcattttggggtgaaagtgtagaaagattgtggctttagaatctgacgtactttgcttcaaattctagcaccactgtgtgacattgggaagcccgttctttaaccccactcagactctgtttctccattgatgaaatagaaacatacagtatcttatgtgtctggcacatggaaggtactcagcatattaatattaaccactttgggctgggcgcagtggctcacgcctgtaattgcagcactttgggaggccaaagcaggcggatcatgaggtcaggagattgagactatcctggttaacacagtgaaaccctgtctctactaaaaatacaaaaatttagccaggcatggtggcaggtgcctgtagtcccagctgctcgggaggctgaggcaggagaatggcgtgaatccgggaggcagagcttgcagtgagccgagatcgcaccactgcagtgcagcctgggagacagagcgagactccatctcaaaaaaaaaaaaaaaaaaaaaaaaattaaccacttcattcttcttagcccttcaagcccccgcaccgtgttttctgacatatcatcttgttttcatcctttctcttcggtttaattccagagggtacagagaaggtgtaagttacaggtaaaggagagtaagtgcactgtgagtgggtgctgatgaaatatcacaacaggttctcattctgacaactcacactaggccatgcttccccggaatatttatggaactaagtggaaaaaaggatctttagcaaggatccagcaccctcaatgcagggaatgaaatgtgtttattattagagcaatccagtttccatacagctaccaatatacacacacccacataccctgttcagccatactgaagagtttacttgtaaatccaggcgaagctgatgctgagaggtggcccgctgtactgattttgtaaaaccagcaggaaaacctctgctcggccgaccacttgatgttttagttgcagccactaacatgttaatcaaaagaagcaaatacatgtttttcccttgagaaaacatggatagtggtgtaacggaaattaccttgaattattcctcctcaagtatctatccaatctagatagatggattatctgattgcaccaggagatgcagacctggcagtggctacttctattgcagcatctttaaaggaatcagatctttggatttccattttcccatttttattcttattttctccctgctaaaaaacagtttgcagaggcacttgaaagtgatataaactccatagtagataatagttgtacatgaacatcgtatcttttatcatatagtcccctatgtaattaggtgatagcttgagcctagcacaggtggcgctgctgagccatctcggaaatgaccacatctgaactgggcgcagtggttcatgcctgtaatccccacacttcgggaggccaagatgggtggattgcttgagctcaggagttcgagaccagcctgggcaacatgacgaaacctcgtctctacaaaaaatataaaaattagctgtgtgtggtggtgctcacctgtggtcccagctacctggggggctgagatgagcaaaaaaaaaaaagaaaaaaaaaaaaagaagaagaagaaattaccatatctgtatgtctatacataggtatgtggatttatcacagtgctggtacaagtacttttgtcattgatgtttattaagctttttatgctccaggcactatgcaaaattgtagggcattatctcctctaatcctcagaatcttatgcagtagggccggtgttgctattactccattttatagatgaggaaacttaggcttggggtgtttaagtaacttctatgaagtcacacagtaagtgctagagccaagaggcaaagtaagcctggatgcttccaagccgtagctcttaaccactatgctatactgctcaaaaatatttttagaactgaatgaagacatctaaggaaaaggaaaacgtggtccctaatggtcttttgtgataacaatatgaaacctttcgtctctaaagtgtcatggaagtgaaacttgaaaggctctgttcttcatcttctacttattaatgggcaaaatgtcttcgtaatttatggcatgtgtcccaaaggtgcaaaggtggcaaggtggccttttttttttttttttttttttttttactaatactaggtcctgcttccaagcctcctatttcttcacttccctgtgtaccagggtttacctgctgcttaacccacccaccccactatacgtgtctgtagtagacccaccaacattcacatggccacttctgctgaaagtacctcccaggatagaatagggtcacagacccccaattgtataagcctttggcttcttgatgtctctgcgagttacggttatgggagttggtctttggtgagattagtggtgagatcagtgggtggcacctagggtgatttattgaatagtatggggtgaggctgaagagcaaacatccacgtaagtgttgtctgttttggagtttgaaaagttgtcaccctaataaacaaactacttaattgaacagcccttgcttggcgtgatcaaagaaaagacctagactttgctatcagtaggctctgggttccaggcctggcttgtcacttacgatgatgatgatgatgatgattttttatttttttgagatggagtttcactcttgttgcccaggctggagtgcaatggcacaatctcggctcgccacaacctccgcctcccgggttcaagcgattctcgtctcagcctcttgagtagctgggattacaggcgcccgccagtacgcctggctaatttttggtatttttagtagaaacggggtttcaccatgttgcccagactggtctcgaactcctgacctcaggtgatccacccgccttggcctcccaaagtgcggggattacaggcgtgaaccatcgcgcccggccagctcgtcgcttattatgcaagttgtataacattgctgaatcccaagtttttagtctttaaaatgagaatttaaatgtcgcccttattttgattgctgggaagtttaaatgaaacagtgtatgtgcctgtcacatagtagttgacaataaatgatagtttcttttccttttcccttaagtaagttttttttccctctagcctataagctccttaaagaagatagagattttcttttctcactcatttccatattctcagcccttagcagtgccaggcacatatttgctgaatgaaagaaaaatcttttacaaaggtcttcagatcattcattcaccagacaattgttgagtatctacagtgtatcaggcactgttcttggagcagggcagtcttaaaaaacacacacaaacatagtctgtgtccccttttttagtctaactgggagagaaacattacatagataattagagcaatgaacaactttgatccttgagatgggatttaaattttaagagataggtgacatttggtgtcaagtctgtccaggtatacttgatattgtttttgatcaggtacaagaaacggcaatatactgttatctataactggttctgaaagatctgaaagaggtgtttctaaagtatttttgaggaatggtgctgcttttttggaataagtataaatacattgtaaagtatctatttcgagagggaacagacttgatgggatgggatcatagtaggtaaggtgttccaggaacttggaacatactggaataaggcttaaacacaagtcacagaactgggtgatagggcggtgagcgcatctactggagaggagatggggcagggctggcagcttgtagcaagatttttatgtagacagttagacttcaaacttcatcagtaagtcagtagatggccctaggtggaaacacaggacaaaagatgaatttgtgttggcactagaaatactttgagctcatctaatgaggctcattcattcatttggtaaatacttcacgagtgtccagtgcaagctctgttctagttgtaagggatatggcagtgaacaaggcagacaaggtccctgtgcctgcagagttttgatgataaccttcccccctgggtgtgtgggagggcctggggctcctgtgtggtttgggggtctgagaggtggatgaaggtacagtaggcccacagtcgtggaaatcaaagtccaagctccagtgaaccatcaattaagaaacaagggattgtgaagaacaagacctagatccagactgaagggaaggatttgctgaggagttcaggccagcatgggctggggtgacttggcctggaactctacaacagtcaggacagggagtcctgaataggggcacctgcagctgagtccatggatggggagggacctgtgtaaggcactgaatttagactctgcacgcagttctaagaggtgttctcaacacgtttatgcaactaaaaagtgtttattaacagtgttttgaaacaagtgggatttttgttgaggttgtaggataattcagggtcatatggagatttttattctatcagtatttgccctgtcatgtagatgagacacgttagaggcaagcctctgaaaattagattgatttatttttctagtctgaaccgaggaaaataactacttgtcttctatctcctggtgctctaatatatgtaaaatgttgtcttatggtgagacaatgcatattaattttttaggcacttgatggaagaagtggatgagggaagcagcatcggtctttgaacctaggtcagaaagaaatggaagccatggtgtgagaataatgcatcatggtttgtatggcctttttcatgtattttaactcaactgattttctcagggcctcatcagtcagtcaacgcagttttctccatctcatagccaaggagactgagactcagatctgcccctgcccactttttttgtagttttagggggaagcataaatgtggaggaagtaaatgagtgtgtttgttcaggcttagacttttgttattttttagccttgcagggaaggggaggaaagccaataacgatggctagaattggagatagaatgaatgcaagttgcattaaactgtaaggttagtctcggtaagaggttgtttatatggtggtgtcttgggtgtatcttaccatgtagcattcttcgttttaagaaggattccttccggtgcaacatcagtcacagcatagaaagcctatgctgctctgctagtttgcttgcttgcttgcttgcttgcttgctttctccttccttccttccttccttccctccctccctccttccctccttccctccttccttcctctctctttctctttctctctctctctgttttttgtttgtttttgctttttttttttttttttttttaaatttgagacagggtcttgctcagtcagccaggctggagtgcagtggcgcagtcatggctcaccagccttgcacttcttgggctcaagtgatcctcccacctcagcctcccaagtagctggaatgtaccaccatgcccgactaatttttaattttttttaatggagacggttttgccctgttgcccagactcatctcaaactcctgggctcaagtgatcctcctgcctctgcctcccaaagtgctgagattacaagtgtgacccactgcgcctctgccctgtgccacttttccacagctgctttacctacagcctgggagtcaggccagcaaatgacgacaccccaggcacagacatgctctctaggaacttcgagtcaggtatttcactttgtaaagaacttccattttaattctattttctcctagttagagactcatctttcttctgaggggtgcaaatgattctttggagaagtttaaacctgttttacggttcaaactcaagatggtagaaacaagtcatatccaaaagagtgccccgagctctaagagttgtggctgcgcaacgttttttaggtgtctccgaagtgttatggccaagttcaggattgacccagatgaggagaggttgcactgcatagtgatgatttgtgttggggaggagagctgaaactttgcaaagtggcgtcctgaaccaacttgtttttcagcttctagggaaatttgttaggtaatttttaaaaaaagagagagagagacagagaagacttaatttgatggagcctaaactccactgtcttctttctgctgagtgctaaggggctcatggtctctgaggacagagggcaggaaaacaccttcatgccctgtgtcctctgtaaggggcctctagtatgagggactctgatgactattgctgttggggaaaagaaggaaaaggaacaggggtcaacttctgtcatcatctctccagagtttatgatgtttctgaaaggatggggaatagtgcgtggcccccactcatccctgtgaggtgctgcccaggtatccaacctgcagtgcacatgctcgccactggcactggggatggtgagtgcagcagagagatgggattcttaatttattcaattttaattaaaaaacacagttcagttgttaaaaacctatttaagtgtgtttggaatagcttggatatgtgaatttaccttttcaactgtgaattttatgaactctaaatacagatcaagtatttccagcaaaaatttagtgtcggatttgaaatgtgctctaatggaaactagacaccagatttcgaagacttagtatgaaaaaaacataaaatacctcagtaattatctgtattgactatacattgaaagaatattttggccacattgagttaggtgtcctatgttatttagatgcattttacccatctcttgtttttcatgtagctaccagaaaatgttaaattacctatggggctccccttatatttctgtgggacagtgcgagtctagacagtgccttacgggatccatcagaagcattattggactttctagggaaagttgctggacttcaaaagttagagtcataatttttcccgttgtgttaacaagttgctttatgtggatgggtttatgacaattgagggttggaaaataggttttaataagagtaagttaattgagaggacagctttacctctgttaatcagaatgattttaaaatgcattttcacccactcagaaaccactgattctcatgggaacaaaaaactacattcgtgcgtagtacgaatttgtgcctgctgggtccttgtacctttacgccaggcagaaatctccgtaatcgtcagtgtagatttcatttccttgtggcaaggaatataaagtaatacaaccaaaggggaattccactgcatgaaaggaaatattagtgctcgtctagctcttgtttcaaccctataagctccaagtgattttcagagtccctccttcaacttttttgttaaactttccagattttcctatttatagatttcagttgttggcagctacatgttggaaccgttgttgaagcccctagtaagacttgatgctgtagcacgctttcacagcttggtttgcaagttgctttctaaagatgcaaagagaattactacccactctagtagtttgaacaacccagtgaatttcagatattaaagccatattcatgccactgttctcctaattctatcactgtttagaattgcattttgtctaaaggaaggatagatagaatactactaataatatcaagatgctcagaaactgttgagaattttttttacaggaagaacttaaatttccagaggcttttaaaaaaaaatttattaaggaaggagtaaataaatacgccgggttcttgagtaaactacttttacccttcagaaccactttgtacgtagactttatcatgatggccaagagtttttaaaatactataggcagagggtatactctagagaaagaagacaacattgggtttaggactgctagccccatccagagcagttatgtggttcattcagggatcttcttagcccttcaacctcaatttctacatctgtgaggtaggttttgtgctagttctagtgacatgactcgtgggtgtattaggaggatatagcagcatgtaattgaagggcttttatcttggaaaagccttagtaggctcaaggtttctagttgtttagggttctaagattttactaactagtcagctgcttggagttcaaggcatttcttcagattataatgagttgatagtgcagtgtgcaaaaataaagaccgaaccatggtaagtagcaaggttactgtaaggaaaaaaatgtgtcccactggcccctttaaaatggcacaggtgcatctctgtagcaaccttgacagccatcatgtgggatcattcccctcacccagggaacagtggttccccaatctccaatctctccattctccagcatgagaaagtggtctggagcttgatcacatgaagatggacagacacagccttttggatgcgagagagggaagggaatgcaggccaaaagtggggtgggttttcctttcctcttccttgttttttattaaccttgtcttgctcctgccacacacaagtgcagccagtgctcaggacactgctccgtgtggagctccggaaagtgaagctgagaagccttccttggggtggacatggggggagctgcagaggcaatagggagaaaataacaaccatggctcaggcactgcttggagcagttgttcatatgtaggtcaggtagtcatcattcaggaacttcctgtattacacaaataatctctattttatggttaaaggtaggacagtgataatttactcaggagggaaggacaattagcaaattgattaataaggtttctaaaacctattgtgaaagagaatcctttaacatatgtcttgatttattctgcttatttatgtcttgatttaagacagtgattcgcaactttagctctgcatattgcaatcacctgggagctttaacagcgttcatgcctggctcccatccctggagatttacttggctattgggattgtgttttaaagtttctccaggtgattctaatacacagataatagccagaatgcctgatttaaaatgtttcctgaattgttagctgatcttgagtgcatattttctatgtactgttgcacactaatagttttaatgaaggcacagaatcttatgtaaaataaactgttaattggtcttaactacagggctacaagagtttccttcttatttcaagctgcttaatattccgttaatcactgttgtcatgcacacacacttctgtattccattctcattcatttactttttagaatggtattaatgctggtggcatttgcagggtagtagtcaccttgtcagtagaacttgctttagtaattagttgtcagaaacaaaactccccagactttctacccatgaccacaatgaagggaatgatgccttttctgagtccctattcctaagaatcaggaaatttctatgatatttgacaagtataggtagaaattacttgccaaggtgattatgacttctggaaaaaatttttttaaaggaaacacaggtgtgtaacactcctaatcagtatataagattgtttgtatgttactttttcgagttataaaaggaagaggataaattctgcctccttccccagttactgtcaatcttcagtcttcttttgaattaagttagtttcccattttacaacataaagacaagtttaattcttaaggcttacataaaaaagtaatgtttaatttgggatttctcaaattcttcatcataataacaccttgcattagtagagaacctttgttgcaagaagatcaaaatattttataagcttcatctcatttttcttttctttctttcttttttttttttttttttggagacagcatcttgctctgtcgccctggctggagtgcagtagcacaatcacagctcactgtagcctcaacctcctgggctcaagtgatccttccacctcagcctcccaagtagctggaaccacaggcacatgccaccatgcctggctaatttttcatattttttgtagagacggggtttcgccatgttgcccaggctggtctcgaactactgagctcgagggatcctcttgccctggcctcccaaagtattgggattacaggtgtgagccactgcgccagacctcttttatctttgagataataccgtgtgacgacaaaggctgggtattgttatccgaatctctcacacagcaacactgaggagacattgactcatttcttttacgttgctttttaagtacagtattgtttggttttgttgaaaattattttggtagtaaacattttccagagatataaatcttttccagactcatttgcgcttgttactgtaggtagaattcatgaggcttttcctatttctgtttatttcggagcctgaagtgacccaggaattatgtgatatatgtagagcgagggaatttcttcagtttgactgtggtcctggttgtaacccagccttcttccttacagatgggggtgagggttggggtatcccttagagcctggtgtgtcttcatacaaacagctttgctggggctgcctagagcctgggccagcagtggggtagtatcaagtacagggcattattcagcggttctccacactctcctcatttgaatgagaatataaatcttctcccctggctctcatgtcacatctttaaaacctcaagtttcttattaggcatgtgtggtccatttaagctctagacatttcgaaaagataaatcacagggcaaaacatctttctagttttgaaggaggtctgagttgcagctcgctggggttgtgagtctgagccgtcgcttttctttctcttccttttacaagacttccaggatatagccgttaaagaaggacacaaaaaagagcaaagccctcagtgatgctgtggcacaaagaagaaagctacttgaggaggaggcgaagggtttacgaagaggcaaagaatgcaggtgaagggagggaggagttaatagttaaggctcaggttccaagccctttgggctgccagtgtctgcaggagccttgctttcatcctttccttctgcccaggttttaagtctcatgagttaaaacctggggaagctcccaccccaggtccactgtgagggaacgtacaagaacagtcacgtggcaatagtacatgcctggaaggtatctctcatttggggggagattgagaagcgctgtctaatggtgcccttgatacaactaaatagcaactgtctcagttcattacttgttagccccaggcagggacaacgcagattggctaattataatagccagaccattaaagggaatagcattaatggaggagaaagcagctaataaagagctgaacttggccactttgttgtgcccaggatacaagctgctgttaatttcagtacctgtttcttctgctgttagaactaggaagaaaggatttagtgaccctctttcaaaaggtggatcacaagcttagaggcattgctggataaattcaacagcaagactttatttcttccccagaggtgacgtctgatggttctgtataaataaagtcacaccacctttcttatgctgaattgatgctgctgacctgctgttagtaggacatgcacttttatggcgtttccaggagtggtgatgtgtgttgctgagctcatctaatctctgctttgagcaaaggcaatcctctatatcatggcagggattagaggtatagcctggggctgcagaatggtgtgatttaaattttcccatgcaggttcaaagcttgtaactttgcctgcgtgtacatccacactgggttccagccacatgaactgggccaccttcatagacctccctggtaaccacagcctgacgtgacaaggaatcacagttttactttccgcttactatccatgttagaaatatctaaggaaattcaggaaaaaaaaaaaagagagaatttcatggcatgtcaagaatggaaagtatcttaattaaaatgttttaaaatgggaacaataaagaagtcgatttaagttttttgctttggtgcttgtctttaaagaaattgctcctaattctagaaactagtgctttttctaattatattcagtagaaccctaggatcctgtgaggaggcataggggagtaattgataaagaaggggactgtggtgtccgtgttttatttggagctgttctacccacactgtaatttataagctctaacttaccaggggagataagattgtatagaaccagcatcttgcagttatacggaacctttaagttctcctactccagctccttcccagtgcaagcacgtgttttagagtaactgttcagcctcagcattaagtcagctttaggagaacagtaaatcgcccatttatctggagacttcagctgtttgaaaggccttccttctagtgcatcggtatctgttgctggctctgtcctctgctactacaagcaagccttgagtctctcttagacttgtccttcctatatttgaagacatctccgagaagattttaaatcttttttcccccacaggccacatatatccttaatgccttcatccattcccctcttgggaatgtgcatctttgggccattggagaggtcttgcttggactgcggccactgtgatttctgggggcagactcagctccttcttggtgtagagatctgcccactataggcaccaaatagatgttggcaggcttctttcctccttactgcttctatttatctcacctgtacttttagatttgctgctcttgggtaagcagataagaacaagggaaatgtcttccgttgttgttaaagacaatgttaggatagaaagtaatatgtttgtactcaaaaatgcccagtgagatttctagccacggccaagttatcatttgcataagcaacctggaaatgccctcttggtcctactgattgtgtcccatggttaatgtagatccctggataaattcgaatggctactcctgctcaggggtcatgccatgagaacttttctcatacatcagatagagtccccttccgtcagctgaatgcatttacccctcagtctgtgctacccataggataagcaacatgcataagaaggtaggtgccttggcttaggcagctctgttgagtcaccctcaagaatcctgctggaattctgtgaggagtgaggatgcagagcaacgaaatattcgaaggctgctatgatttttacaagcttgaacctgtctcttggaattccccattgtgaagtcattgttgactggttggcattataaagcagttcagagaagtaaagttagatcagtctgcacgcaaataccagccacaccatctcccaagctagtgactggaactgcggttttcaagtcagtttcctcattgcggaatggagataacgatgccttccttgcagggtcattgtgaggctgaaataaaataaaggcttcatgggaacacataccacatgctcacttaatgctagctctctttcctgattgtggcagtgactgtattttccagctacaattgtgacacgtgttctgagaggtgttaagtatttatatacaactacccatatgtatttatgggtaaaaggacacggaactttaaatattgagaccatcctggaaattctaggatgtatgattgcataatttgtaatgcctgctataggcctagcctcatagttgacccttgatggatgctgaaatatttcttaatcatagggagaaaaaaaactcaatgaccttttacagagatgtttgattgcagggcttattgctaatgctctctctctctctttttttttttttttttttttttaatctcactatgcaaagataatacaggtctgggtaagaggaagacttaagatgctttgacttaattgtatctgcttgacagaagcaatatactgccttctgattttaggatgtaaccatccagaaaggcagaagaaagggacaatttcagttctaaacaggaatccgaatatctcacgtcctgaaccatctacataaactagagaaagggcactccttaagactggtgaagcgggctccttggaagatccccacagcaacattgagtttggtttgtctggcgtaccctctccccaagggctgagtgggccatctgggtaacctagagaggagacttcagatgctaggagtatagttcctacccatcctcattttcacagggtacactcatttttttccccttggaagtactgatatgtattctgcaagatgaatgttgagacccaaacaccatttggcttgtaaaaattaatggcttagcatccagagggatgttgctttcagggcaggggggacactggacaccaagaagaaagccagcttgggcccctataccatcttggatgtctaaaccatcttctggtaactctctggatgaaaagaaatcatgaacttcacttctgtgatttggtggatgtggattttgctacatcaaaatttgcatttgagtctctgtggtgttctttctagccgagatgctagggtatgctctttctttctggggagattccaaaaatgttactctctgtggctgtgtgtacaatgtctatttagaaaagaagactggcatttgcatcttctctcaaattctttacgtttgtctcactgaattttggagtggacaaaatattcaatagcttttttcaagtgaaaaaaatgtcgactttcaagagtgtattactttaggttcttgtgtatatctgtgctttcctggtggcagaaacctagaaaactctagagctcaaatttcagcgtattcaattttttgttaatgtgtctatagcttgttaataaaagcttacttaatgaaagccaacatcaccaccacttgaaatttttgcagccagaagagtgtacttaaatacttgtgtattcagacttcactttaataaatttcaataaatagcttcccataggagaggtttcttctgttgaatctgtagaagttgacgacggtacaagcatcagctttctcaggcagcttttctaaacacctgcagggtggaaaagagatccttctctcaaaatactgaatattgctggcatgaccactcttgtcactggtgcctgctgttttccatcttatctgggttgcaggtttcttcacagtgatgggacaccgaagtgcaatgggatgaaagcatgcctgtggcatttttaccctagctgtggggaaatgaccactatcctgtgtccatgacactcttcctcctcaggactttcaaactaggcttcagaagccatcactgggggcagtcctggcatttataatggggatagggacaatttccaggaaaagtttctatatcaaggacatctcagttctgcagcagagaaatctttgaaattacctgcaaaccatctttttgcaagcacaaccaactttatttctgttttaattaattccaaaaatgctttatttccagaatgttaatatttagttagcagtaggctctaagtttcccaacccctcagccttttcagagggtataataataaatgtgtaaatgtgctaggggatccccgtgatttatggaagctttatattgaataattttgaagaggaaagaccttttggtaataatattcattttttgactcttctgtaatatgcaacctgagggtgggtgtgggggaacgtggagaaatgccattctcctactgagcacagactgtatacacctattttacagggaagtcacgggctcctaagcattcagtttaaaaatgagcagaattagatgggtacccttcattggcccttcatggctaggggagaaatgggagagggaacgcagctcattttggcttcagtccttacgctttcaagagacaaccctactccatacttcattattttttttaaagctttctataatggttggtgaaatttacatttcaactcttgcctacaacagttttctgccttattttctcttcccagcgctttgtgccgcctccttgacaacctgctcataggtattacaattggcctcagaaattgcagtgcttcccttttgttcagctggttggcttgataggttgtatctgcaaatttgagagcagcgtgttttattttttacagcatctaaacaataatgtaaccacatcacggcattctgagtcacatcattgacctccaccagcagtttatccccctacaacacttgaatacattaatatcactgtctgtagcattttaatttaattagagcagcggttataatcctcttgggaaaatcgttatcccccccatacacacacacacacacacacacacacacacacacacacacacacacacacacacacacacacccctactccccataatgttaaaagaaagaaagcagctctggttttcatctgtctgacaatttgctttagaggtgggactctcaccaccaccccctcctttgttggggtcgcaccagagaagcagttgtgagagtaaagaggttccctttatttgggaaattagacgttagtgtccttaaacttctctgtctagatgtctccatctgagatagtggtatttggttaatttttccaattgctgatagtctgctgatgtgccagggtagatgttaagtgcgaggttattgcaatagagtgaaaaatgagcactgtgagagtcaacctagagattcacaaaaagagagacaaaaggagtctctgtagtgtgggattcccaagagtgtgttttgttctccttggaacagagcccactcactgtacagcatccttttggggtccccaagtgctctgcagccaccaagcccagagttaccttaggtgtgccatggctactagaagagtgctcggggccctagaagcacattgtgcatttgtccgtcttggtcaaggtaacctctcttgttgctgacaagtctcttcattgagcctttgaaaaagagcttatggtgtggaaaactgtcctccagctgagtagaaaccatcatcaggaatgtgaggagatcagtgggccacagtctcttcatctctggccttccttttataagttttcatcatgaaatagcagttgtctccatctaaaattgtttggacggggtttgcgggggatggcgtcagatcccagagcaggtgcagaagtgtggtgtttcaccgtaaggtcagggaaccatgtagaagtgaaagcacaccaaggggttacttttaaagagagcacagttgaaaggaaggtccaaagcaatgataatttagtaaattacagtatatacactttcagggtaatagctagccagactcttttgtcagctggctggggatggagttcctaagaaatgaagtccagtcagcatggagggccgggtttctcccagcttgccttggtggagttggggcaggcggggatgaggcggcctcactctcatggactagccagagtgtcttgtgagtttctctttgcttcaagggaaagaagagtcattgaatttcgaaatgctgtcttgtttttttcttgcactcatgaagcaccatttgaagaccctttggctgcccgatgttttcttcaccaagtttcacttctgcaaaaaccctaacaaaacagaaagctatttccgagaataaagttaacggtagatatctagacatatagtgggatttggggggtgtcagacaagagttgaagagtatggagaatttgttaaattctaaaaacagactgtttgaaatgctcagaagcccacctcacctttaaaaacctctgaacagattttatgtttcctatatgtgtgggctttttttttttttttttttttttttgcttttttcatcccaaaccaaacaccaaaaagtataacccatccttcaagttaaagtttctcaaaatacatgtgatgcctgctaaagttcaagaaaagtgcagttgaaagttttgcctctgggtgactttttacaggacatcttaattgacccagaaatgaaacctgggatatatgtgcctgcccttcattaagaaattcaccaagaaacctcaggatgtatgtttaaacagaaatattccaactgccctacttgcttctggtgggtgccttagggaaggtatagcaattccattcggaaattataacaatatgtatatattcatttaaaatcaaaacttcctaccacaactgccagactttctaggctatgagcagaggagaagctttaatttggttataggccgaggactccgccgcttccctttgcacatttgatgagatgtaaaatgttaaagaactatctttccaaaacgtaaacactgccttccctttacttaaatgtacgattttcttttgctcttgagttttattttcatagtggcatcttactggtctttcctttccaccatatttttggatgttgtgtgttccattttacattgcccagttaaaccacagacactcctgaagtcatgtttacatgtggactgcaagtcaacctagttggcatgttgatctaagctacaaattgcactgctgttttgccgaacccaacagtcggtttcttgccattatttgcggtattttaacttaaaactcacggtaatccttctcaccccatctagtttgttttaattgatctaacaaacactgcttgtttgaattcaaatggaggatccatggaagctctcccaccccaccctttgatacttgataaggggtcaaacagtacttcttttaaattcagataattctttgaatgaactatgaaatacttcagagggaaaggaaatatcgattctgagatggagagtaaaagaacaaggagatattcattattgttgcagataattcctagcaatgaaggaaaaaattagacgttggatatttttggttgtggtggttgtatagtgagataggtggacaatagaaaaatcttccttgtggattgaagttctaaatctagaacttatctttgaagctgtcactttacttgatcagctcactatggaagtgaatctagaatcatactttgattagaagctggggatattgctacagaagagaaaacatggctttaatatagtgatggcattaattatgtgacttgggcaagtcattttttaaaaagttgtctttaagccattctcgcggacgtattttttttgttcccttttgtccctcctttttacttgtacaaaccacagggtgtacacctattgacatgagtccaaagtaaaggctgttttcaacgatggcagagttttgttatatagccccaaggctaggcatctgaaagacaactgtatacagtgtctctacggagagagtaagccggattgcttgggaagctggtactgcccatgccccgcctcccttttgctccccaccccgagatggtctcatacctccattccaagctttcattgtctctctccccctcccctcttcctgcccttatttttaacagcaggaacgaatttcatatacacctccagagagcccagtgccgagttacgcttcctcgacgccacttcatgttccagtgcctcgagcgctcaggatggaggaagactcgatccgcctgcctgcgcacctgcgtgagtgttcgtgacccgagagggacagaggattgatggcgtggggcgggggtggcaggcagtgggctccaggccagagaggggcaagctctgaggtggttttcacaggacttcgccacgctgctttggaatctttcacacccccctacccccagatacctttgaaaaatttgaggttcctgttccttgtttctcagtgtattcatttcttccctgactatgacatgttaaaaaaaaaagaaacctggaaacatgcagtatatggcagagccaactaaatctcctagtagacaagatgatttctgtgtgtgtgcaaagtttatctgtattctcaaattcacgcttactcaactttaatattttctttggtcctaaattttgctcagtttgtgagtcagactcacttctgctttgtttttaagctgtgcgctcgtcctttctttccagggccctccctcccctccctgtctgtgctggctacttttcttcccttcgttttctaggcctgcataggtcctctctcttgcctcctctttccttcacctccactctctcttgcttctcttgtgcttgctttgcctcagcagctgcagtctgtagtggttccacctttctctcccaaatcatctctaccccttggcctaccacttccccgtctcagtcctcagctgcaacttggcagaggtttggggcccacacacctgtgctgctgatactggcctccaaagccgttgacacctgctgtgtcctttttgtctgcctttctcatactgccacccagctcaggtgataaaacaggattggggcagctggagagactgaatcacctgattcccaccctcttcacagtgtccaagaaaatgccagcttctctgccttgaatgttatcctgagggcacaagactagcttatagaggacacttgaggtcaccttggcccttccagtgacttaaatggtggcacagtcttgctcaccatctctctccagcagggtgatgctctccagttcttctcctcctgttccaccctcctcagaaggttgctttctgaatgcagagaacaggagacagaggatgcaggttcttcctttctctctctggtaattcagggaatcagatgactgtgatatgggggctcctgggggaacactgccgccggcttatgccttctgccccagagggcagacggttgctgggatgtttgtgaggagttggaggcatgagaatcctttccctcctgcagcttgctgcgtccatcagtatttacgaagttgctgcctactatggtcaagacatttctgcttcatttgggcagggaagtaaaggacacagccctactctaccatcttttcctctacttttaaggaggttcgaactgtaaaggtgccagggtcatggctgggaacatcagtgttcttaggaaactggaatgttgtggcaccatgggagcagacacaactggaaaagaaacagcagccaagtgataggaaattttcctccagaagtcatcctgtgaccgatatattcacttcagaaatattcgcctcaggatggaacatactcatgccacacaggcagaacacttctgctacctaattcattcatttattcatctcacaaatagttattgattgcctctgctgtgcccggcactcttctgtgtcctgggggtgcagaaatgaacaaagcagaaaaaactcccctgctcttgtggaacttaaattctagcacagagaaaaaaaaagtatcaaacactcatcacaaacaggctgagatttctttcataacgttttattcctatagattgcaacatcccccaaggaggccctcgctcctggttcacttctggatgccttgacatatggaagctccttaactatcttccacgagatgttatcctgacaaaacaaataagaaagcaaacaaacacactgaactggaggtcaggagatcttaacttttagctagttctgctgttcgactgtgggtaatttaactcagttctcctagcatacaatactgtgtgttgacaagaaaatgtttaacagccttcctaactttaaagtactatgattctcatctgaggcatcattctccttgctttgaattgtttcttccatactaacacttgaattttttcttgagtagacagtttccttattgagccgtgtctgtgctgcttaccagcattttggtagtgccttctgtgtgcctagcacacaaccataatagctaatatttatcacgggattaccctgtagcaggcactgtgtgaagtcctttacaggaattcttttaattcattctcacaatacctgtcaggtaggtcttctttctatctccatgtcacacataagggcttagacaatttaagtaatttttcaaggtcgatcacagaaccagtaagagatagagtcaaggctcaaactcagttctggctgactccagagcctaggatcttatatccactataccaccaaaaagtgtgtgtttagtaaatatttattggatggatggatggatggatgaattcagggttgacacttagccagtgttcactggtgtggccgtagcattggtttatggctggaatctattctaattgctgttctgtctgttctatctgttgttgaatggcttgcatatcacccttcgaaggatggatgggtccccacgtagacagctataaaatatagaactgcagcacattcccggaaacctttccatttcatcagtagttagactatggattcagattatggtaatgattttgcctgaatgcctactctatggcagtctaactttatatacctctccttggtagtctgcatgagacctattgtgacaccattggttctgacatctgtattgaatcctctggaagtggaggttcccaggctcttgctgtttgccctcagctgggactttccaaatgaggctgagcttctgtcctcccgctcccgtttcagggttctgctgcttgtcatcctgtttgagaggagcatatagcccctacgatgactgaagctgtgccacacacttaaagatgcatcccagctgagtttccaaacctaaaagaaaataaatattctaaccagggaattgggttattgctgttttaatctgggattccagacaattcccagtggaatgctcatggaaagtacggggaagaatctcaaagccaagacaacagcgggacatttatggtattgctaagtccaaggcacttgtagctgcttattttaaagagatactcatcagattggtatgcctcaaagtgggttcttttcaccattttccattgattaccagataaatcctctcccttaattcttcctttctcttctttcattcttaaatcaacttatattcttgtggatgggggtaaagaggagcagagatcatattatttaaggttctcatacagagagtttctcaccattttattctgcaaacacagagctatacccaaactgaagacacagcatgacaaattagcaagttattgagaagtagagagtgatgccttttccttttatttgccagtgataaaagcaaagtgataaatggagtaaagtgttaagtgctgattagagaggacttgaaaaggactggcaaagaagcctgggcagagtgcaagaggagagcccagggaagaaaggccagaccgtgccatcctgctctgactcactgcccagattaccaggacagtgcccttcaacagtcctacagcagaacccctctgcttaccgggagagcaaacacaagtatgtttgttgagaggatagaaagggcatcattttttcttcttcttcctcttcttccataaagggtactgaattttttttgaagcttgagggtagaagagccgaagtacaattacagtagacaggtgggaaaaaaaaagttgcattctttaaaggaacataagcttttcattgtagcttgaaaacacttgaaagaccaaggacccccaagggtgcccaggcaaggtcactcttgactctacgcagagaagggctgttgctgggagcaaaggatacctttgcccagttctcaccaggggacttgtagtctcgcaagggagggatgttttctgatttgtctacccaaaggccgccctttttctaaactcatgggggagtggctgctgaagggggcagttacagcacctcacgaggtgctgccagcctgctcattggcagaggcttaccttatgaaacactgggcctcagacagtgatgctcaggccccgccttaggataacaatataagtatagttcagattgatggggcagaatttaaataattaaatgtcgttattttaaatttcttttaaacatgatcatttcacatttagttgacattgcgccatttgcccgcagactgtgcattttgcagtgtccatttggccttctaaaatccctgtgaattatatttaaaaatcggaacgtaggactcattcatcatatttaatagggttagggtttatgatgttgcaggttaataaatagccataatagccgctcggcgttttctggagtcagaacaccagaaatagtcccttggctctctttcctttccttgtgaatctttcaaaattcttacattactactcctgcttgtgtgtgtttaataatttaatttaatgccttcctttggaaacattacctcgctgctcacccactcggctgttttgccttctcagcagagtaactgagtttaagacagccacgtgacaggcacagctatattagaaccagcatagtgagaagggatgcagtgcctctcttttctaattgggtagagcaacaattttatatgctttcacattatgtttgttcccaaaaaaaaagaggcaaaattgggagctgaacgtgatcatcattattattttatatttttatacataacaagatgcgctcatacttattgtctcacttaattgtacagcagtccttgaagcaggtgctattgattctgtttgatgagctgaccgtgtctccgataggtcaactggattgtccaggttcacacagcatgtgaaaggccgaatgtgatttctacttcttgaaaccacctttcagcttttttaggagaaaacataatgacataaagagtttcatggacttgaaagtagaggcactgctgaccgctgaagtctgggcagccacaggtgcagggactgggaccggtgtggttctagtgatgccacctgatcatgaagttgtgctgaatcctcagcagactggcttctccctcgtagtaggatgagggagaggaatcaggataacagcctgtccctgtggatggtttattctggttttgttcaccagtcctgctgcctccccgtttgttctcttgcgagctcaggttagagttgaatttctccctacaaccagaatgccagggctggtcctgtaggccctgatgggccagctctgagagtgggctcaatccagtacccaattccccagcattttgctaggggtgcccttctaggagcagggtctcactgcttttggaagtctccaaataaaaaaccatggtaatagaaagggcttgggtctggatagacgtgaatggacttgaatttcagggttggctctattagagagatgatttaacctctctaagactcaagtttctaacgacacctactaatgagggcttcttagaagtatcagagctcatttatgtatagcacctggcatagtgcctggcctgcagtggccaggtagctcaccaaagctccatttctgtttccggttatggtgaatagcctgttgaggaggtggcttccccatgcaggagccaagggaagcagacatgtcgttgtctgtgtgtttcattaaagaaaggacctagggttctgtctgtgtattattgagactaatcttcctaagtcacaatggaaataagctttgctttcaaacgatcccctgtgatttccaggggctcagttttgctctagggcactccatcccaggaccttttcctacccacatgtctctccctcagtctggaactttcttcccgttctcgcctgaatctgtgaatctccttcagccttccccactcttctaatacctatcaagtcctcccctgtcctttgctatcacatcagtgttccaaaaatggcctctcctcacagctgcctgtgacgtgcagtgatatcaccagcagagttgagacaaggacaaggagaagagatttaattctctgtcagtgtcttacaaagcagtaatgacttctaacaaagccgaccagccactagcattttctactttgttcccccttaagccttcttttgggtgccttcactttttacatccaaatgcttgaagctttctactttccccgcggcacatgtggctgtacgagggccctggttagctgcttcaaacagcttgaagagcaaaaacagcccacagcagaacagccaggatgctttggaagggaaatttcctttttgggtttgctgtctgaaagaatttccgatgcaggcagacgttaattcctagctccatgcttcctgataaggaagcagcttcaataaatgcagctatttatagatgtctttttttttttaagaaaaaaaatatataaccagaggtttactgaccttttctttcacttcacatttcatgcagtgagctctgtgtacatttaaggcagttcctccagcgtcagctctgacaaagtggccctggtttcgctgtgggggatggggaggggaggatgaagatggcacggcccctcattagtgtcacgggctctccctttcctcagagttctgaagtagacatttggaaactgttgacaatgggttgtccctacctggtgctctgtgttatttatgtgagcccagaggtgcccagctttattctagactcaacactgaaaggttatagcagactaagagaaccctttaaaaaataaaagacgatgagaaccagtccattttatgaaacttgaacagcaacaggaaatcagaaactttatttccatttcttcttttcttctgtccgttgcttcctcttggattttcccaaccctcaatacgtctgtggtctttctctcgtcttgatgggtttccgcagattgaggagttcctgtccatgagctccacagtcacccttacatgtatctacctaatgctttctggcaggtgtgataaaggttcagtgtgttggcttgaatgtgcttctctaagttacttctcacctcctctgattatcagaaagcattggttgagctgagtatatacaaatacagcagtttccatgctcaaataactgatattttctcccattttgcttcatgtgtgagttacaccacattagtaattcaaacttttggggtttctggcaggatgaccttgacaacttcatcagaggtaaacgttagcagcgacgtttagatgttgctgcttttgctgttgccatgggtggattctgattctcagttgcctgtaccatgtgtgagtgttttgtggttcatttttctgatctcttctgaaggaggggtagagcaggacttgagagatttaaactggccctggctctggccacatgctgactgtaaattcccaagtataattagtcacactgccccaatatttactgcctccatcttgggtgtgtggacaaaaccccattctttcaacattggtctccatttctgcttccagcagatcatggataccagtagctctcaaatggggctgtaagattccagtaatagaaatgcagatgatgggtacggataatggataaagaactgtagatgtggggtggatgacgattggatacctagaagggaaagttgactgcacagggctacgcagtgaataccctattttaccaggtcagctgaggctaaattctctacttctggggtgggggtactaactgaaatggttcactgaggagggtgaaggtttgtaagggaagatgtaacaatacttttttaaaagcacctaggacaagttttagggtgttgaatagcaccatttaaaaattataggggtatccagcaatttatggagctctgattgagaagtatcattgttaggattttattacccatttgttttccagaagtagctcatctttgcaaatgagctttagttttttggtcattgtaccctacctgccagctcacaggagcctgtgtttctccttaggagccactctgaggtcaaccgtgtttaagatcataaagccactctagagaatctctgtggcattgttgtgtggaagaagaaataatgatcactactattattatatatatgtgtgtgtgtgtgtgtgtgtgtgtgtgtgtatataaaagtatatgtgtgtgtgtgtatatatgtatatatgtgtgtatatgtatatgcttcatatatattatcctgaataataacaaactctgcacagtagatattatacctgaggctcaggtaaaccacttgcccgaggtcacccagagaaagtggaggagccccaatttgaatccgtatctaattccaaaacccagacttttattttccacttcaccctattactctttaaaagtctgaggagcaaatgaaagttgtttcattctatctattggttagaaggagaatatccaagctaacaggctgatttttttttccaatttttaagcataatataaattactgacaagagggcccagatggataaaatcagagctataaaccaaattatcttttgaacttgaaggaagataaatttccatatccaatcctgtatgcacactgttatctgccagatagtctcaggtatgtgtgtaaattctggagtgttagaaacaaaactaaatgaagtaaaaagaggttccttgtctattattttccatcttttttaaagagatgatctacctcacagatggttattaaacagtaagaaagatgctgtgattgaatgaagattgtgttactgagtttacaccttaaaacactgaacttcctgataatttgtgttaagccaacacgcttcagaaaaattgcctgacgtttggtgccttagtttacccacatggcatgtgtgccagaacacgctacaacagggtaagagggcagagaacatgctcttgtaggggtcagttccttgagctctggttctacgtggctgattacttgggtcatcccagcagttcattccatctctcaggactgtggtttccacatctgcaaagtgaaatggcctgagtatatgattcctaagttctccccaactcaatcgtcgcattgttctcttattccagaagagaaacacaaggggtatcagcagtggaacattatctgtaaatgccagatttcatgatcattcacttgatttttaggactcaacatcaaattttagtgcagatggtggtactttcatgacacaggaaattgtccttcgttttacctgtgattgttttgggaggaagccctcctgcaaggaaatagggaaatccaacacccagctctgttgagcatttccctatggttcctgtgattgaaatcgggttaatgcttttgtgggatgagaactggtgccagctcctaggccttgcagggcttctaaagactgtccctgccactcttgccttatgctggttcccaggaccttacagccagatcacaggcctgctcccctgttctcatagccccctttctggcctgagaattgtctgtggcttggccctttgccccatgcaacatgcacaggtgtggcttctgctaactatctacttgaccccaactgtgtgattagcggcaatcccctctgcaactcaaggcgtgtttgcctttcctgtaacctgtaaaaaatttcagtctgcgtttttctccctctggagatggtatccactgggttttaggctttacagagccagctgatctgcgtggatgggccacactatcctcccttagccggctccgtagcacatgcacaattaatactgcattaattaattatgggagaaaaaaagcacagttggcaagggaatgaaggctttcagcttctaaagtgaaggctttgatgctgagcttgaaagtacatttccatccgcctcagccagcagagagaatctgtgacacttataccatcccctgggcatgaaaactcacacccaaggaaagtatttctaaatagaggccctcaactagttgctggaatcatctactcattgccatgggctgtgaaaagggggtgtaagattagggagaaaagactcgcccaaagcagcagtgattcgtgaccaaagctgatgaggggttttattttttctccttaagtagctcttaagtcaccaacatcaggaactctttgtagagaaacaaatatgagtaagtgatttggtgccagccctcttgaggacataaaatgactctttctccttcctcctcctcctcgcatgccttgcttcaggaaggaaccctaaggtggtgcaggttcccaaacctgttattcggatgggttggaaggttcatctctgttaggcatggtttcccactagatatgaacaaagtcggggagaaaatgctttcctttttcattctgattccttcacgccattgttcttgaactcctcagctcccacactgactcctttcacttctcctatgaggtggtagtgaagccacctcacaaagtcccctctctgaacagacgcagttctcgttcccctatttacaactctgtcaagcatttttcgtgggggctcttgctgaccttaaaatttggccgtgattcaaatattcatccaggtatctggggttttattaaaggtcttttaggaacacaaaagtaggaattccctgagagaggttttcttcacttgagactcatgggttataaatgaaactactggaatgccctgaccaagtgctgagaggagcttcagagacccacaaaaacctaaaaagatgtgaaatttgtctctgatcaaatagattttggaccttatgaaagaaaataagcttttcttttgattcttagagaaaaatttttgcttcagatgaatccaagtgtgtgtgcacgcacgtgctttcgttgggatcgtcttatagctgttattccagatacctgcttcacaaagcttctgtgattattcctactactgtgacgattcctgccaccccagtgatcggggaaaagaacttgaaatacaactgggtattgtagcattggcactgtgcagacgctgtgtagctctctcatgtctggtacttctttgtttgctaaaggagtattgagattcagaaagtggctgccttctaaacctttattgttcagatagcattactttggacccaggacagagggcttatagttgactgtgaacggggtgaatgttatacttaagcagggaatgtggtcacccagttgcaatgatttagagtgctttgaacataaatatctcccacgatgaatgaccagggtgcctgaaattccattgttgagacattccttttggatcaggcattatttccacatagctccacttttaaaagtaaatcattatggcaggagatagttatggagagagataattaatacctcaagtccctaatatcttaatgaaaattagcttatcagatctcctgaattttttgaagtggaaggaccgtggccagcacggagtgggtagagttggaaataagcactataatttgcttagggctggccttctctgtggataagacagatggaaaactagatggaaaatccaggcctcctgatttagacaaaacattgtgagcctggagctctgaggccaggatgagcagtctgctacttactgtgcgtggccattgctctcaagacattgccatcatcagtcttggccaaagaaggtcaggtctcctctagtacactggcgatttgagaatgtgcaagtcatctgcatttctttgacaggagtagtgaatttgggagtataaatctgaatccttaagcctttcaaccattctcactaaatgtctttacttcagggatgatcacgtttgatcgtaatgccaagatcttgcagatgtataaagggcatggtaatccaagtcttgagttgaagtaagtggtcaggaaaatcttgacccttggggaaggagctaccagagctgggtggcctatgtgtgtgtgacagggaggaggtgtgcagaatttgggggaaagatcctttgtagttctccatgtggaataataacttccatttattgagtgcttatggtaggcgcttttcacatgtattgtatcatttaaccctctaggcagtcctgtgaactgggttttattatcctcatcttactgatgaagagtcaaacttaaagaggaaaaggaacttgaccagagtcacagaggtggtaggtgggagacaggtccatccaatatacaccttgccttccaatagaagccaaagccctattgcctaatctcttcactttaagaacatgaagaatagtgttgagttcccctttgagatctgactgtggttaaagcttcacaaatttcagaaaaacagaataactcactaaaataaaaatttaaagctaccccacagaaaacatctaccacaacccaaaacttcagggtttatatatccagattttagtgaactatatgactctccctagtcccttgctctgtctcctggtaaatactgtccctttcagagccctggcacatacatagtgtaataagatcagaccccatccccctaccattccaatgcaatctaattgcaaagtgaaaatccagggccgtcttagatcctcatctgtctacgtctctcttggtccccactgcttgatacgcagtctcaggttcaataccattctctctttttgtgctttaggtctctgtattgtttccttttcaccacttttttttttttaatgaagtgattttaaatggaaaattaaaaacttaactgtgaatctggcagtttcctgctaatgcctctttgctaagaagcttcataaaatactgtatcttattcacttcagcacagctgctgtgggctctcaccacttaaccattcacaatatgtctgagagattaatttttgtaaggctgtggtttgagatatctcccccttccttgttttacttaaaatcctcagtgggaaagcgtgcatggggaaaaaaaaaaccaccaccaccctggataaaaggtactttggtaacatacgtgctttaggaactataatttgtcattttattttcttgtgccctcttcatttgaaatgctgcagcctttctgccagaagtctcaagtttgtgtatgagactgagggggaaacgagagtaggtaccttgtgctgagactgtcctgggacagtcccgtggtgggtgtgagcgtctgtgtgatgcaggtatgcttatttcttcatgaaagccgcaggtactggttgcctctcgcagggttaaaactcttggcggctcacaggaggtgatgaagagcaagggcacgggagaatgaagaagcaggaggaaggtgtgggccagggtcggtttcggtggggtccccacttgctgggtgaaagctgaactgtttatccacacatcccagcagcagcagaaagccaaggggtgttttcaggactcagctgccaaagtttcttgaagcagctctgctcaaaggcatatgctgggctcacttctgagggaaatttcctttttggggaagttgaagcaaaggaatttcctgtgtgggcagacagagcttcctgacttgaaggcttcttggaagggaaacagtttcataatgaaatgacaaattaaagacataccagccgggttcacttcaaaacagctattgagagtgcaggcaaagccctattatactccctcacagaacaaaaataaatcccatcctgacaggtttctgtatgccggattatatccgtccccccacacctttcttcacagccttcttcatgcttcccttcctcccacccccgccattagctgccaccagctccatcttgaacagctctcgagagcagccggcagccaggccgggagcctgtttcttgctcccttgctttgtggctttgcccatccctgacctgcgtggaggccttataggttatgtgacagccctatgctgccaagacacagaaatgacctctttccttccccttttgacataaagcaatgattgaagacgtcttcagcaatggggtgggggcgggcagtcaggggagaatgcagccatttcctcaggccggcctttaaaatcttgaaggcagtaaatgtaagtgctattccggtcttgggagctgggtctgaattctttgctttgttgaaggaaatagggctctgtgctgggtggacgatattcttgtacctgaacatgtcattttcttcagttccatcagcctgcatgtggtgctttgttttgtttctgaaattgacatgatgatgccttaggaactaaatttttttctttaatggaacaggctaggagaaagaaggatggcggtatcatttggggcgtgagaacagtcattattaattaggcttaagttaatgaaataaaaaaggcacaggctttgaaatcagttgtctaaatttaagggccagctctaacaatatacaaccagcaatgtaaccttgaacaagtcactgaacctcccagcctcagtttccttatctctaaaatgggtacagtcatacctttttcacattgttgtgaggaaattagattatgatttcagaggcactttgtgaattcctataagccttcatacttcttattaaaccactattgggatctctggagactgaaatatagtattaggctaagacagcagaattgtagaatttgtagatcaatttggcaaatatttagtagaagtcttctatgtgtgcagcatggctcgactctgtgggggaaaataaacaagtggaaagtttcaggtggccgcatggtatagcagaaagaatattggacttggggccaggaggccagggttcaatcctggctgtcactcagttgcctgtgacttggtatgaactgtttaaccttgatgagcctcagttgctcatctgtaaaactgggagaaatcaaactctatgaccttaataaactctgtccaactctaacattgtataatcagttttaagaggtttttgcctttagcagctgtttataggatttattctaaagagtagggaagaaatattcattgtataagagcttgtctgatgaagaagattgcatgaaaaagctacacttttttaataagtatatctgatgtaaacaggaaaaatgggtgcttgccagatatgtcatctatagcaacttgttttgagggggtctctgaatgctgacatgaaaatgactaggatcatgggttgaacgtgagtttgctcaagagaaggttctcttggggctttggtttacttcctcccagctgctccagggaacactcaggatatttccaaatggctgctcatttaagccattcccgttatggttctccttgtccaaattggcttccatggtacagtcccagtgttgactggttctgctaatttgattctttttttttttaatgtgctgatatgtagttttaggactgctgcattattgttcctctatctttccgtttgtattagtaaagaactattagcaattttgcctcagtcttctaagcacgctttttgattggagaaaaccaaggtaccagaaaacttagataccatgtggaaagtcacagtttactgggtgtgtactatgtgttactagtgctttaataaatttcctcattaattttattctcccagcaagcctggcaggtagctgatagtatctttgctttacacatacagaaactagggcttagagatggtaagtaattgggtcaaggccacagaactggctggtagcagagccagaatttgaactcatgtctgcctgctccaaagcctgtgttctttatcccctcagtgcacccctactgttttgactgctgttaaattgaccttatgcttagaaccgaagtcaaacccgtaccagggctgcaaaaagaaacaaaattaacctcatagtctgcatactctcgaaatggcaaaaaagcctgcaactttccgttgtggaaaataatatacctgggtgataaactgagcaaacatcacccttgcccttgcctctgaaagagagcctgttctagttcatcctggggccagcttggcctggaaccccactggccagctctgtccacaccttgcatattaggacagaaatctgcctaccacattccagctacataaagaaggtggccagcacctgactgcctctttctccttgtgaaattccttggaaataccatttgtgactgcttgggcttgttctgaagaaaattcaaatcttgttctgtttaacaaggattgattgaagaacccgtaggctcagtgctagtacaaagataagcaaggaaggaactcagaataagagagaaaaaacttggataataattatcaaaaccagtatttattgagcacctactgtgcccagtagagtagtaattacaggaggtaaatatctaaaacttacatagctcttcacagaacatacatctgttcttgcttctgtgtttgattttattagctttcctctgtacacataagcttttagtgtatgtcctattattgaagtccagagttttattatttttcacttatttgggcatagatagttccagaatttacttgtcttcctcattctcattgttaatctcatttttcttccctggagaatatggactttcaaaactatttttcaatcaaggccaaaatatttcttaaaattcacttctatttaaaacacagataacatccaggagaaaatctgagaagaaaaaaaaaaacgattttgatggtacctgattataaaagactcacagtactaagttattctttggcacgtgtagcaaaatactatgtaggtgtcatttcgagttcatagtaaggggagaaatggtgtcatttttcctgcagagaaatttaatctttcactttaatctttcattggcctatagcagccagtggggtcttttaaaaaattcttttccttcatattccccgtttgagcttaaggtacaaaaaaagaaaatactcttgaaatgctgtgaccagatctagactgtaacatgccccttcactcctctggtgaggaagtgcgggaaggtggaagacattgaggggttgattatttacttcgtttggaagtaagaagggaggtagctcttatttggaataagagctgtcttcagaacaggtgtgtgctctcctgaagcccagagctgtgactccctgggtgtgtctcttacctgtgcccttgggcaggtggcacgggagaagaatacgataagaggaggatggtacagacagaggagtcacaggctgaacaggctgtcaccggggcaagatgactgacaggtggatggaattcaccatcctttcctttcaatcaaaaaaaaggtagaaagttgctcataagtaagtttgagttatatcatcttcttcatagccgttgctcttcagacacaggtgctggtaatcaggaaaatgcaaggaaacagctctggggaaaaggaacaagcctcgttggccttgagagccccagtagaccatcaggccttgctttggatattgggaggtgacagtgccttctcacgtgcctgacagtttccctgcaccaccaagactctgtgtgactgaggccgtggcccgggtttcaggatgggcattcagaggaaggaagttccccctccttcacttacctcacgcttactagatgctgggttgcctatgcccatgttaaaggaagccagataactttctgtccccatgtgatccaggcccatcctgaagcctgggggttctgaacataagtatggcggttgcagccttccttctgtgacttctggaattcctgacagagagggtcatatctagccactgtcaaccggatgctagacttgttttgttaggcccttcctccttcccttcctctacttatcttccaataaccttaggatttggaggaaattaaaataaaccttcttctagaaaggtgtcagggacccatgcacaaatgtagcctttttgatgcttgagaaagaatgcctttttgacttccgtgaataaagaataagtcacggctaatgagtaagtaacagcacgtgcctgtggtcccagttattcaggagactgaggcaggaggattgcttgatcccatgagttcaaggctgcagtgagccatgattgtgccactgcactccagcctgaacaacagagcaagaccccatctcttaaaaaaaaaaaggaaaaatgcctatgcaatggctctgaggcaccctcatggttgatccaatggccttgcctagtgattttgacatgctttaacttgtgaccaacatctagtctatttgtctcccattagagactggttgtgacagcattgccattgacctgccatatataggaactccagtgtctgaaaacatagcaggactttgtaggtattaacattgagcagtgctttcacattttacagcttaccgtgatgagcaagatattgtgtcaaaaatagtgcattgcagatatcaataagaggtagggtaggcagtgatttcagtggtgtcccactccacactgtaattttgtttctttggtcaactaatgtaagaactgagtctgtaactctaacctagggagccattgctgtgtgtcaactttgttgctttaaaatcttgagacaccttttcagtatctcccactttgtctgagtagtcatacttttaatgatatttaaaagtcaaactctaaatactttggagctaaatctcagcagagataaacttcaaactggtgggagtgggggtagagaaacccttctgggagtcagaatgagatacttgtgtgtctggactggtggcaggtttgtatgttaccagagtgatctccatggtaacggatcaacatggcgccaatgacaactctacactaagagcttcaggttcccatgagaaagtggatcctcacagcaaataggaagaaatcaagaaatatggatccacactccccttccctgtagaattctggccgtgaagtttcagttcatataaccaacaccatgtcctatttaaccacttgggtccctctgagtaaaccaagactcttctgagaatgcagtgttctctcagatttcaactaaattcatacaaagtttaatcagacttgcatagcaaagaactatattgcagtggagcaagaatgtaacttggagtcaggaagcctggcctccagacccagctctgacactgtgatatgaggaaatcacctcgcaggttcttattttccagattctcaaattcccaccagtgctgatggtcaatcatccaattatattgaaagcccttagtatgatacatcagcagtaggaaaggtagatgactaaatataatacagtgtgccttttcctacaccatcaaaggtatgataatgttgtgatcatgtgtataaaaactttcagacacctaaaaagtagaaggtgtgattcatctctgttaaagcttaatctctgagcataacaaccaacatctggaagctaggcagccaacagaggggttaatttttctggaaccttggttgcaaaaggttattagtttgcagaaagactcagagatcactgtttatcttaaaccacaagagaatgtttttgaattcagaagaacagtgatatagttcggtaatttcatgaacctcttccctgggaaaccttatgactcaacagtcaaaggtgtccgaatagtaaagatggttttcagtgatcaggtctgtgcccatgcctggccttggatagactctgaaatgagattctttgtttgattgatggggtgatggtttctgttgtgtacatttgaaggaaaccagtttccccacccaaaatttctaaggagtttaatctttggggtataggggagttaaactacactgagtcaaggaagtaattgattgcatatttcctctaaaagtcagctatggacttgatattgactaaaacaaactagcagttctcttccaccaccaagtcagagcgtctgttcaccattctgcatgattaaaagaacaactaagaatggtaatgctccatttaaactttccttgtgattctctctggtctaccttcaatcaacaaaagcctaaaatttttattttagaatcatgatgttggaagatctttagattgctcataccataaagctgtttctaagattggtctcgggaaggtccaagatcaggattgaagtatgaaaaatcttggccaggtgcagtggctcatgcctgtaatcccagcactttgggaggccgaggcaggtgggtcacaaggtcaggagatccagaccatcctggctaacatggtgaaagcccgtctctactaaaaatacaaaaaattagctgggtgtggtggcggacacctgtagtcccagctactcgggaggctgaggcaggagaatggcgtgaacccgggaggcagagcttgccgtgagccgagattgcaccactacattccagcttagtgacagagtgagactccatctcaaaaaaaaaaaaaaaaaaaatgaaatcttgatcttattgccttgtcacctttttgtcttaagtttactttgttggtataaagaattttttttaattcagcaagagctcaaagagccatatatatatatataaatttttttttaattaaaaatctttctgctcaagtctcaactacagtgagactgaatggaaaatgcaaaagctcttgacatgatgtcggaatgaacaagatggagaggttgaatttgagaacatggtttccttattgtgaaattccagtttcagaacattggcactgtctggttcaaatataaatacacattattttattgtaatccgctagtttaaattgtttattctgcttataaggaagagatccatgatagctgtgaacccctttgaaggagactttatccatggctcagtccaaggtgtttgaagcacttttctcatggcctggctggaaagactttcagaaataagcagggttctggtaggaaaatgaaggcagttgaggaaaacagtgcacatatttgtaagaggactatacttggtatcttggaaaacataaacagaccctagactgtctaccccaagtctgggaaggcggtcctctgaagctgaggttctcctggaactcccttccacagggctgcgttgcaaatgccattgtggaggcatcacccgatgtggtggacctgaacattggggaaatgcagtgctgcctgctgctgcgctggctggcatctgccctcctccgtctcctgggtgctgccacagagaagagagagagagtgaagcgggcagagactggctgttgccatcacacaactgagggcggacctggagctcagccggctgagggtttgagagaccgttgggagcaagacccaaccacaaggcccatggaagaggaagttggcagatctcagaaaggggaggaaaaggagaggtgcttatttgttcatcttgtttttgcttttaaggaaaggaggagagttaaatgagaaaggagggcgagttgagaaggttctgagcagtttcaggtccacggttgagcaatgttcttcctggtcaacaaactgcctggatttcattttggcctgacaacagccccaccacctagggaactgcacagagatcctgtgtgttaaccacgcaagagagtctgcagttagaatactggggcttgtgcagagagaagaattcagaaagtcaaaggctggatgtaggtgaagagactatggactctgccttcatgtcatcagttaaagtgccctgcacacctgcctgtcctaggtcctgtagggatgtgatataacaagcatgagctataccttagtgtctgtgttccagaactttgttggctcccgaagcacctttccctcctcccaagaggaataaacaaatgtaaataaatggtgcccaggttttcatttggctcacaaaagattatataaaactcatagtctgtctgaagtatgttacctgtaaacctgtttcagctaaccaccttttctagcacaatcaagctggtaaaatacatgcctgcacgccagccacggtactgaggaccacatcaaaactgctccttgaaggaacttggagaaaatgaacaaccagcaacttgttagctggtctctgaatgacagagggtactgctttagatgtcccccaggaattctgagtttatgcagcagagggaccgtagccccggggtcaggcaggacaaggggatcagaccttcctcttgctatgtgtggatcattattcagctgaatgtctctaatcaggaactctgggcataaaaacacgatctctgcagacttgtgtgtggctagacgccctctgtgtgctgtatttgtaattctctgtctctgtatggtttcagccttggaagaagctttgaaccagtgatgagtttgctttccgcagtcaaaactgtggtttgagaatttcactgttaataattgggagtaaaggaaaaagctgggctattgaagggtaaagccgatgtccctaggactgtggcctcaggaagatgactggatggcggcagcagaactgatggcagaaaccagggaagctgatgttgtattgcagcctccctcacacagattctaatcctagaaagtggactgtggaaaaaaacttaactattcacaacaaacgtttaccagtcttatttagtggcaggccttgtgatgagtgctggggttaaaccataagtcaaatacagacactgctgtctttattattcattaaaatgtctttagggtaattttgtatttacatcttcagcaaatattaactgagcacctgtgatcaaccacatagctgctaggcactgtgaataccgtggtagacaagaacagacgcttttcttgttaatccgtggaatttacaatctagaggggagactccacctaccccaccagatgtgtgcagaaggcgccatcactgctttagtttcaggtctttgctcaggtcattgctcacactgagtccacatttataagttttcctgtcgggtgagctgccgaagggccagggaacgtgataaaccatacaagcagcgcatccaagaagtggtttctgagcagtcactgagacagcgagggttccctgcactgagcaccaagttattactattttccatacacgtcaatatgttattgattgcttcactgtgctgatctgtttttgtttcatgtggctctttgggtctgtctaacctggtattttcagtctcaccagcatttctaaagttctagagacccatttcatccaccttacaccatgtctaccacagtgccaggcatcaagcctgctaattgtgcttgatggtgattattaccagccccggatttgtaagagtcaccagcagtggcatttcaagatttagcctgggagctcacggttatgtggaaagaggggctcaagactaagcccagggaggttttggggtgatagaattgattctttacactgaacgtgaatcctcagtgatgttttgatgaggatgcgggacattgtgctatgctaaagcccgtcacagcagcattaaaaatgtcccagtatggagacctgacttacaccttggctcaatcattaaattaaataactcaccaaagaataaataccaacaaatactagaaatgttgatttttagaataataaaatatcagtttttgttttttgaactggcagggaatttttttttttttctttttgtagagacagtatcatgctatgtttcccaggctggtctccaagtcctggcctcaagctatcctcctgctgtggccgcccaaagtgctgggataaaaggcatgagccaccacacccagccagaattttttaaatgttaattttcaatacacatgtagctatgaggagatggacacattctttctatctgacacacctggtcactccaaacgttcagcacttcacatgggaggctacatatggaagtgaaatgaaaaatcaccagcagccgcagaacaaaaatataatccagtgagcataacttttatggaagcacttcagcaatatgggtaaaggacctgaaaacacttttgctctttggctcactaattccttttctaataacccatccctagggaacactctccgatgctgacaaaccttcttacacatggttctgcagagcagcagaggccaccaccagcaaggttcaataaattaaggcaggtcattatgtgggactattatgcactaattaaaaatcacattttttaggccgggcgcagtggctcacgcctgtaatcccagcactttgggaggccaaggcgggtggatcacaaggtcaggagactgcgaccatcctggctaacacagtgaaaccccgtctctgctaaaaatatttaaaaaattagccaggcgtggtggcaggtgcctgtagtcccagctactcgggaggctgaggcaggagaatggcgtgaacctgggaggcggagcttgcagtgagccgagatagcgccactgcactccagcctgggtgacagagtgagactccgtgtcaaaaaaaaaaaaaaaaaaaaaaatcacgttttttaaatgctcatataatataattgaaaaggcagggtacaaatctctctcttcagagtcatctcaattgtttttaatccataaaaataaaccaaaaggctatggaggaaaatagttattgtggttatctctaggtagaaggattgtgggtagaatttctttctctttactgtggagtttttttgttttttttttcttctggcattgcccaggattatttctgtccatcagggcgtagtgggtcacttctgtacccagcagcttgcacctagatttattgtgtcaaaatgcaaatctgggcgtgcattttccattgtcccctccccacctgcgcttaaaacccctccttgtcttcctgctgtaagtaggataaatgcaccagctgtactgggcctttcccatttcccatgctgatcacattctctcgcctctttcttctggctacaacacacttcttcattccaaacccttccccctgacccacctccaccccccaccctagcaagattaattccctgtaattctagttcatccttttggccccagtttaagccatttattcatgccaggctttacagaagactcaccagcacctccaatgggcttccaaggtgctctcaacttcccttaacacaggttcccagtttatcctcaccactgaagcccaagagctgggactgtgccagattgatcaccagtgcattcccccagcacacagcaggactcggctcaccctggatggttcttaagcatttatgaatgggtggatctcacctacgtgacctggaacttctctgttctcagagcaagccatgtcaaatagcagaaaatgcaccggctttggagcctactgcaggactagatgtctcagggtcgcagtttcctcatccctaaaaaggggaatcacgatgcttatctcatgcagttattgtgaggttacaagagttactgcttatgaagggccctgtccagcatctggcacgtggcaggtcctccgtgaatgacagcgccttcctgggcagcctggcgagcgcacacgcgtgtgcacacacacacactcctgtgtttaatatagccctgtctgttgtgagccacttgaggagaggtgtccctagaagaaacttttttcccagaaaatgaggcctggctggtgctcatcctgagttcctggaaggcagtgttttcttgtaaccatctgagattcctggggctgggtatagtgcctgatgctctcaatatatgcgtgttgaatcaaaccagaagaagcaggctgaggcactgagtgaaaacctatgtggatgtcctgctgccttttccttgtggagggtagatcattcccaactctgcctgaaactttgatgccttattggaggaagagaaaggtaactcccttgttgagccatagagctcttagtttttctttcttaaaaaaaaaatcactcttctttcaaacaccattaaattagtccagttatgtacactgggcttgtattgcatggtttatataaaagctaagttctttctttaagattggagccctccgtgtgagtgatttcaggataaaaggccttagaggattagacacattattcgtttgtaaaactgattgctcaagtgatacagccctagggctgcccccttattgtagcttcttgaacactgtcaaactgtcagacttgggttggtggttattttatctcgcaaacaaccaaaaccagatttacattgtaagtagatactagcgtggcttttgtccttcctatatctaggccctgaatacttcagagccagattaaatgctttgctctattttttcatagatttgggcttcgaccaaacatacaagttgagcctgttgacttctctctttgtggatgcacacgtgcgtctctgcgtatatttgtgcatgctttcccgaataagtcctcttttaaaactcagcctttcatcattttagaaatgatttgctcttttacagcttgtactttttatggttcttagaggatcactgcagcaaatatatttggcagaaattgagcacacaagcccttccccagaactcagtactgaatttgttcagttcccatcttaaaaacttgaaactcctttgacttttcctgtgatgtgcttatttctgatctgaaactgtagttcaaagctagacttggtaatcattcacgtcaagaaaggaatggattgctcaaaaaagaagtcagactctaaaaatagcctccataccgaggcccacttttctacctagggaatcaagacagaaatatttccaggattgaaatgacatagttcaagtgacgcaaccatttggctgcctgctatttttctcttttctgccagaaggaaaatatataatgtagaaaaattcccctagagttgttaaaataatcactgaaataacctttggtgcttagtatggtaccctggaaaacttggatctctagaatggttcatttcagagcttttccagatagccaagtttttattagaaaattggttggtatagacggtgctcactgtgactgttcagtgcatgatgagaatccttctttacagagataaaaagtgtgaagagaattgctgagaagtaaccattcattcccttctgcatttgcctagtgtgctgtgtaattaaatgagctgataaaatttacaagaaataaagctttatgcaattacaaatagatgacatgactttttaaaaggttttgcccatatttttcacacacgctctacctttagccttctctgctttcacacagatgctgaaaaacaaaagagttaattagaaaccattccttttctctctttctggtacagagaaggcttccactaagtatgtgctgaataaatgacccagtctgaaagttttaatttattacacagtatattcatagaactgtaactgttacaacctctagtttgatagatgtagctgtttttgtttttttaagttgagattatattaatatctgtcacttgggttgccagccttttagaagaaaatttggggtttatattagaataggttttaggttcagtagcctgtatccttttttactgccctgggacaacagcaaatattcacctaaattcattctgtggtgtaacactttagaagtataccagttcttccttgcaaataacaacaaaaagctctgaacaacttaatcacagagaaaaaaaaagcttttattggaggtatattgggcagctcattggctgataaggtagcagaagcaaaaggatacttggcagcccggagcttagctgagatggagccataaggacagttttattaggatgccaccacagctcggctgccagtggacacatgaattcgtgagactagcacctctgccataaataacatctcaccatccctggggaattggtcactcccttaagactcaaacactgtggcaagtgcatctaattggctgagtccaggttatgttccagggaacaggggagaaagctctgccaatcttgggattcccccacatgcggtatgtggatgctgagcagacaaaaatatagaagtctagtagatgattgtaagttactgtatagcagtgtgtttcatcttgttcttacgtcctgtggaagctttcttcatggcgaagttaagcagttccacatctgcattcccccagatcagcacaccaaaggtgaacagcttgggtttccccctactttcagttacaggtacaagatgttagcaaactatgcaaatctcaatgagttttgtttcctaattctgtttgcatgctaggaaacttgcctcatgatacaacagtaaacccctgctttaagaaaaacatgaggctggtttaatatgtacaatgtccaactcttaggaagtgtttatttttcaattgcctttaataatttctcataaagatcgatgagtctaagaattgtgaaggacctcagagatgatatatttcaacttgtcatccacgtcacgactgtctctttagcatcccagagatagcaggacagtcctcccctgcttgtgtgtattcagtgggaagtacttccctgcccccttttcgtcccgttcttggatggtgctagatgtgaaaaatagagttgaaactcacctcactgtcactttgctcttggttctagttttgccatgtgaaaccagatagggtgtattctttctacattaagtctagagacagaactttggaatcagatatggatttgatgctcagctttgccatttacccaaaatgaaacagttactttaacagtatttttcgtctaatatgtgcaaactaattgctgaatggataggcagttattttattaatgcaacaaaaggttatgttagcattttaatatttgtgttgtattcacattgatcgtttttacttggactatagccaaagtcagaactcttcttttgtggattttttaaacttaaaatatatgcctttacatttaaccctattacgttttatttaagttggctgaggtaatgcctatcatcccttctataaactcctctttcctactttatggcttctatattagatgagtactttctctgtacctttatgttaattatttggaagggaaaaagattgaatgggacgggacctgtgaaagatccctgtggcataccgctagagactgccttccaggtaggcatagttttaaaactataaagttaactttatagttaacaagtatattgtgattatgttttctggcaaataaatctctttgctgccatatgccataaatgacacattatcatttttgcaaatatgcacaatggtactacatatcaattgactgtcagcctaacccataagaaaaagtcaggatagactgtcaagttatttgctgaaatcagatgcactgcttggctctctgtaaaatctttaccaagtaccctctttcactttactcgtctactcatggcaaatctaaaaccttctacttcagcttaggcaagacatcttcttgggtcagtggtagatgtgaacaatcttcgtgggtcagtggtagtttaacagtttgttaaactgttgttaatcaatgtatctactctcggtgattttaagagagaaaagaagactttttgtttttgtctgagaggagtttttaacctggaaagacagctgaaacgttatctgaaatgtgaaatgttaaacattttattattaagagacagtgtgttttttattttactcacacagtatgtgtgcatttgtgttttctgcgactgcacatttgtaataataggctcatattttgtttttcattttaaaattggctttgtaggatgttcactaatgtggaaagacagagggattggggaatcactgggaaatgcttggagtcagtctgttatgtagatgtgcaaggtattgactacagagtgagacactcttgcttggttatgtcctatttctctctgaattttttaattctcaaaaagtaatttagaactataacaccttggtttgtatgagtgtaaaatgatttataagataacctcaggtgtgttgacagaagaaatgcaattaaattgtttccatgtttaagaaaaatatgggaggtatatgtattataagtatacatctattgactggctaaagaagaaaagatgactagggtatgccatgctaaggagtttagattttgtgctggaagtttaaataggggagagaagggatgtgtgttcagaaggcttttgtaggtagcagctgtagcaatgatctaggtgagaaaaaaataagtacaagccaaagcagtgtcagagagatggagtgaaagagaaacattcaagtgattaagcagattgattgggcaaggtgagtggcagatcagatgaggagcaagggatgggaagcagaaaagacaagtctccgtggagcccattatctagagtggcaagacgagaaggaagagcctataagagggctccccagagagacaggagggaaatcacagagatcaaggaaggagaatttcaggaaggaaagaatgatcctgcccaatcagatgctgcatagaattcaggtaagatgaggactgaaggtgtctttggcttttccaagtagggaagtcatcagtgacccagtaagcacaatttctgtggcggggagaggcaggtggaaacctgattgctgtgggttgaaatgtggaagaaagtgattatagatgactctcttactggattggaatcgagagaaaagataggatctggaaggcaacagcgggtgaagggaggtttttgcttttgttttgtttatttaatggacggtatttagccatgtagaattgttggtaagaatcagagagttgaaaataaaggagaaatatggggtgatttatggaacagagtccttgtagaagtgagaaaaaataagaggcaaagtaaaaatggaggtattatttcattttcaatggaaagatggacacttgttacactgaaatcagaggaaaggtgtgtgtgaacataagacagttgtttgtatgggggcaggcttcataacttgtggaaactcccacttcacagcctttttgtttgtggttggttgtttttttgtttgtttgtttgtttgttttgcctgagaagccaaagatacaggaggtggcagtgaaggaaatgggagagtgcctgattgagccaagctggggtccccccaccgcgtggcatcgcctcccagtgggaggcctggagtttgtattgatactaatttgtctgtctgtgtggtttccccctgtgctgctcaacaccgtagtgtaggaggggtgaaaggagatggtgagacccattctttcaggaaatattaactgagcacctgctatgtgccaagtgtgttctaaactatcaagatacaggccaggcacagtggctcatgcctgtaatcccagcactttgggaggccaaggtgggcggatcacttgagatcaggagttcgagaccagcctggccaacatgttgaaaccccgtcttcactaaaaatacaaaattagctgggcgtggtggcacccgcctgtaatccactactcaggaggctaaggcaggagaatcacttgaacctgggaggctgaggtgggaagattgcttgaaccctggaggcggaggttgcagtgagccgagatcacgccactgcactcgcgcctgggtgacacagcgagactccatctcaaaaaaaaaaaaaaaaagatacagaatttaacacaggaggagcaagccatgtgactatgtgagttcaaagtattccaagcacaaacaacaataaagaccttgaggagggaaagtgtttgatgtattaaaaggaacgcgaggaagcaaatgtgtctaaagtgattggcaagtgaggaagagcggagttcggaaacaggagtggggcaagaggacttgggaggaggctgtaggccactgtaaagatactgtgttttttgtcattttctgagacaggctcttgcctcggctggagtgcagtggtgtaatcatagctcactgcagccgcaaactcttgggctcatgatccttccgccgcagcctccagagtagctggaactacaagtgtgcaccccgtgccttgctaattttttttttttttttttttttttggtagaaatgaggtctcactatgttacccaggctggtctcaaactcccagcctcaagcaatcctcctaccgcagcctcccaaaatgctaggattacaggcatgaaccactgcgcctggccgggactttggcttgtattaataatttgccaatgagaattgtaagcaatggattgacatgctctttgaattttaaggaatcattctagctattgtgtagaggataggaagagggagagtgggagaaaggagggggaagtgtgaaagtagagaggcctgttagggatctcttaataagtctggcaagacatgatggcaggccgtaccaagcatgttcctacctcaggcctttgcacttgctgacctcgctcgctgggatgctcttctaccaaatatatacttgaaccactgcgtccctccttcagagatatctgctgaaatgtgaggtcttcatagtaaacctcaccccttcacttgtataccctttccatgacattttttcctctataacatttatcaccatttgacacagtgtatattttacttgtttatttacttagtgcctgatttcctgactaggatgtaagctcaagaacagggatttttctgtttcgttcattgctgtgtccctgatgcctagaacaatgcctgcagtgaggaggtactcaataagtatttgttgaatcaattagggaatgaagctcttccatctccattatcaccaataccacctctacagttataattagtgagaattatggcagtgctaatgttattttttcatttccatgtgtgcctttttggaaagacttgctgcaacaagcttcacatatcttcctctgcagagtagaagtatgtcactaagccatggagttgatttcttggctccttgtatagcaaatagccttgcatttggttcgtgtcagtctttgcatctttttttagtcacgttgcctacacccttcacaatcctctagcttaaactcttgagtaactctggacactggcgttagctggaaacttgagaaccagaggaatgatactgccaataacatgccttatgtgcttggcatctaattttggcacttgttttagcaggtttgattgcataatttagccattggctacaaaaaaaaatggccacatatcctgggaggaagggaagatttggaggtataagatggaatctgtcctagggatttgaggacgggctacggttcttgttttttttaaaatattccttcattttcaatactcttgggattattccaggccttatgcattgaccatcactcaatattacttcctttggggagtatggtatgacgccatcatttctggtcttttcatatgaagtctccatttttattatatttttcatgcctgaatctcaggttttgcaatattttctctaccacaaaatctgttatcaattaagtacaacttaatttgttttttttttcacttttccctaattaaagatatatatacgctaattcagaataagtatgaaatataataactggaaataggacatataattgacataatcccaaaataaaaacaaataatttgtagatttagtcctcatagtctcactggatcaatataggatttctgatcaaatatgatgcattttgagaaccctcagtttatgtctagaggagagtcttttatttttaatgtgcgggatttaagttgtaagtgaagaggactgcgtcaagaggcaggatagtagttctaccccaaaacagatgtgtgatgttgaacgagtcacttggagaaggatgccatggagagtattgggccaggtgatttctaaagactcttccagcattaaaatacattaattctttgcatacatccatgccttttgctgcttttgcagctttcagggttaatgagagctgtcaggagcagtatgaccttagagggaaatggctcatatcaagagagcagatgccaatcccttctagtactctccctgggcagatgacccactccctatttaaatccttggctttttttcttctctgataagtgcctgcataattgatactgttgccagtgatcaaacgctgaaatgactaaatgatagagctgaaaaagaccctaaggtgttatctagtccaattatgccccctaaaccccaaagagtctgaaagagtaatggggcccatgagccaagtttagtatttcaaatgtctcgtggtaattctatatttggagacaatattgtaaggttaagcaagctgtggaagcatgaggttgctctgcttatggctggagttataaatgtgaaaatggatcagttattcctagtaactgctcttgagtaagcagaatctttcaaaatgtcatagctttgttgtctaatacataatggccactcaccacatacggctttcaagcacttgaatgtgactgatccttactgagttacgctgtgagtgtaaaccacacatcagatttcaaaaacttagtataaaaaagtgaatatttcattaatttatattgattatctgtttaaatgatattttcaatacattgggttatataaaatattttattaaaagtgatgtcgattgtgtgtttttacttctctttactgtggggactaaaatattttaaattccattatatgggtaacatttctattgggagtactgctctagagtaagagatttctgggtgtgaaaaggctgagactcactccttgttttgcaggtgagtaaggtgggtcagagaggttaggccatttgttcaagatcacacagcaagtaggtagccaagttaggagtaggccagcatactttcctttaccaaaaatggccaaagggatcatagtgatttttttacatggagtctatgacattgctgctttgggtcaaagccaaaaatattgtgtagaatattagcagttttctaaagccctaagcccaagttgtatcacccagtatcaaatccaatcaaaaatatattaaaaagaatacaaggaagaaaaggaaagaggagaaacctccctatagaagacccagtaagcaatctgttttcattcttgaacagatttctttcacaccagtgccctggtattactggaaaaaagtacattaattacgggagtaaagcacaataagaaaacatttacaaggagtccagccctcatccatcatgcctttccctccaacaaagcaagaatctctttaacaaatacccattaaaagattaagcctaagaataaattgtttcttagtccccaggcagttcatttgacatcatttccataggattagggactccagcaatatgtgtttagcacagggctatagtcacactgcatagtattggtctaaaccattccaaaatatttttttagatctcgaactaataagacttttatgtggctggtaattatactaatatttcacccacaaattgggcctttttccccctccacagtgtgtaaccaaacgcagcaattctgcctttaaaaaaaacgaaccaccacctgttaaaaagtggtctaggaagtatagcaatgtcatggagctcttgaggatgtgtataattgaatagaaaggaaacctagcatctggcgcactcagttcttagtcccttttcctctgagccatcatttctcttctgataactgtatttggttcttataattactgatactatgatgtgtggagtttaaagtacccaacagttgtataaggcttgttacaaacaccttcaatgtccccactcccctcccttcactcttgatttctttttgatttcctgctcaccagggcaaccacattcaaatcttttaactgattcttttgtcattcacctcctccaattcttaaatcacgtgcttgtattggtttttttttttttttttcatttctaaatattatctagcattatttcactgtaggaaatgacagtttgtcctttcttccccctaccccaacccctcccatagatgcatcctcgtaatcataattttggacagaacaatttagtgtttacatattaagattatataagtgccatttgaagctgagtcacctactcttttatggttcttcttttccagtcacttttctttttccctggagttgataatgatgcttttatagtatatttattgtttttgttgttgttgttgctgttttgagacagaggctcacattgtcgcccggactggagtgcagttgtgtgatctctgctcactgcaacctctgcctctcaggttcaagcgattgtcctgcctcagcctcccgagtagctgggattacaggcgccagccaccatgcccagctaatttcttgtatttttagtagagacgggttttcaccatgttggccaggctagtctcaaactcctgacctcacgattcgcccgcctcagcctcccaaagtgctgggattacaggggtgagccacgatcgtatttcttgttttaatgtccttcttacttggttttttatctccttcactaattcatccgccctgcctcactctcctctcagtagttcagatgccataggtgtgatgagccttgaagcaagagcttctacctgcttcggtctgggcttcagcttggtgcccagctatgacctttgttcactttttctctccttcgggtgtgagtccctttcctgaattctggccttaatggaggacaatttccaatagcttcctgagaaagggtaggggggaggcaactttattgagaccttgcgtgtctgaagaatgtctttcttctttcctcatacttgatagattatttcctcatacttgatagattatttgtcttactgtatgattttagacatggggtaattttcccccagaattttgaaggtagcactccattgcattttttttcagtgccattgttgagaagaccatgccattccgatctttaatcttttgcataaacctttgtttgttgacttattgttccctggaagcatttttttattccccagattctgcagttttacagtaatgtgccttagtctgggtctgtgctaatcctgatgctctttcaatctggatattcatttcctttcattctgggaactgtcctcctgttttcttcattctttctccagaactcccattattaggatgtaggtccaataattatctttatttttcacctcttaatattttaagttcctcttggagagattcctcaaccttttttgtcagcacttcttttttttttgtttctgatatcatacttttaatattcaagtactttttttgttcgacttgttcttcattatagcatcttgtttttgtttcatagttgcaatatcttatttctctctggatgatatttttctttccctgagttgtctgttttccccacgttgcctttgtctggttttggtctttgttttgctgtctgccttctatactcaaacgtctggtgatccctgcatgtctgcccatttctgagagttgatggacccctcaagcactgaaggcaagttctccgtgcctgggtgaacgtgctctctagggtggcctgcccacacatttccttgggatgccattgggtaaatatctccaggtcttttgtctttggctgcttagattcccaagagatggttgactcttctagtagccatcctggagggtagattctagctgccaacctcctaggagcacagtgggagaagaaggggtagggggcacagtgagcacagtggtcaacatatgcatgttcttttaatctttcatataatttccgttaattccacctagtcattttggtaccagaggataaacttttttttttttttttttttgagacagagtatctgttgcccatgctggagggcagtaacataatcttggctcactgcaaccttcacctcctggattcaagcgattctcctgcctcagcctccctagtagctgggatcacaggcgcgcgccaccacacccggctaatttttgtatttttagtagagacgggctttcaccatgttggccagcatgtgggtctggaacccctgacctcaagtgatctgcccaccttggcctcccaaagtgctgggattgcagctgtgagccattgcgcccggccagagcttaagcttctaatctgccatggtaggggaggagccgtgactcgactgtccagattttcacatgtaactagtgacaccagtccccaatcctttcacggattctgccatgtgaatttggttatatcacatctttccttactatgagtttagaattccgctttcttgggtttgctaagtaaattaccaccggttcttctgctttcaagtttctggtttgtttttctttctttttctcccctccctccacccccttatctcttctggtgtctttgtccttgtagatttgtgccttcttaaaaatctcttcactgttactttagaggatttgggggaacgagaacagagctaaaattaacttcctcctctgatgaatgttgacagtcttcctgccatagggatgttgtccaaaatacgtgttcatgtgtatgtcaaactagagcttctcaggaggaaagctctttgtccattgaaattgttgtcactattgatagtctttttacccttagaccagtacaacttgagtcacacgtgtggcccataaagattcctgtaaggtcgtgcataagggacaagtagttgtagctttgtattcgtgtccagttgatgaaaacaaattgctatatctcctttgttacaagaaatctatggaagaatctggatagaacccagatagttatatttttgtttttacactgacccctttaattcaataaagacatcaatatgtgaatacataataactgacacatactactatataagtgttcattgatattgttatatgctgtttttttttaataatacttgtaaattttccaagagttttatctaatgtttctcaaacccagctgcacaacagattcacctggtggtcgtttaaaaaaaaagatttcatttcccaccttgggcctactaatcttcagggtgggtgcagtagcaaaacagagcttccattttctggagaagaagtgagacattttgagaaccccgttgggagggtcgtacacatcactgatggtcatttagaaagacagcaagatgaagcaaggagccagctctgagagctgcggctaaaagcaaagcctgtatccacagcaaatagataaatcaatatacacgtgtagtataaatgtatagaacacctggaaaccaaggcactatgctgggccctccttctgtacagaacacttaggcagtatgttgccccctttctttatgatgttttgcccctttgtttcagtcagattttacctggataggaggatgagcagaagaggctggtgtggatgtgcattttgttcctgctctcccagtgacagacattgaagtgttggccggagctagctaagaatttactttagacaaaatcctgaataggacccacacaactctgagacggattacatttaaaaattaatcctcggccaggcgaggtggctcacgcctgtaatctcagcactttgggaggccgaggtgggtggatcatgaggtcaggagttcgagaccagtctggccaacatggtgaaaccctgtctctactaaaaatacaaaaattagccaggcgtggtggcgcacgcctgtaatcccaggtactcgggaggctgaggtgggagaattgcttgaacccggaaggtggaggttgtagtgagctgagattgtgccactgcacttcagcctgggcaacagaacaagattccatctcaaaaaaaaaaaaaattaatcctctttcagtgtcaggtcccatttgctaatggggttcaattttcattcatctactgtaaaaccaaacaattcttatttgcagctgagctaaggggcagaaaaaggaggaaataaaaagcattaagttttatttccatgtatgcaacccagaaggttctaaatggttactttatttgagcaacttactttattaatagcaacttcttgtttaactagagcagtgttggaaaaataatttaacagaaattttagttagggggctacgggaggggtgggagatgaaaaactgaagaatgacgaaattcacatccactaatgtttacatttttaaagctttaatgtctgtttttaaggaatagttctttaatttaaaaaaaaaaaaaccttaacatattctctgtatactctagtgttggaacaatggtgactgatatcggagctttcagttggtacagtaataatagctaaagctcacccagcactaactgtggcagatattgtcctaagcactttacatctgctagctcattttatcctcccaagagccctttgagaagtttctgttattacctccaatttaagatgaggaaactgaggcaccaacggcaagcttgctcatgagtggtggagctcccctgttcatttaaccatgttgctgtattgcctggtgctgcttaccacaggtgcctggcccataggactttatgtcctggactgggcaaggttatagaagatgttttagttattagacaaagaaagccatgctgttccttccacacaccatctcattcaaaaccaatggtcactctgtttgggggccactaggagagatgaggttcagagaactccagtaaattaaggtcacaaggtcacacagatgaacagtggctaccactatcagctaggattcaacccaggtcggactctacagctggtgggatgcctcccttctcttagtatatgtgctctgttttgccgctcaggaggcaggaaagaaagatcaaggatgagtaggtgcctgtactcctagttaccttgcgtagcgctatgtgactcttacttgtatttcccaggcataaacctggctgcatggcaaagaaagccaggaaggcagcgttctccttttttgtgtagaagaaaatactcttgcctcagcagcagagaactgtgtccacctactgtttattttcctccccctttttctttttttcttcatcaaaaagatatgaatgctgagatcatcccagagaaatctagaataaataccatgagaaaatagtccctctggaaggcgtcttgtactcctgctgtttgtaaatgtgaaaagctcagcaaccgggcagctggatgggtataaatatagcccacagcactgacgcccgctgaatcctgctttcttagaggcacaatgggaacccacggaagtcagagaaggagcagtaaagcccagtcgatcaatcagcctctctctttctctctctccatcctggaccttagtgtgggcgtgaggatagaagcagctttaagagtgcacttaaaatagctcttggaactggacattggctaagctcaaagacaaggaagatgcttcctatgaaaccgacctctgcctgacccttacctggggctattttgaccattctggtccgtgatcttagggctgtgttctttctcagttcagctgcttgggcacaagcaggttttctagtgcacgctccaggcgtttggcgcctctctgctgcctccgtactcagagatcttattctaactagactcagctgtctgaagcctggtgattaaaaatagcctcctggtgctagctgtggaatcaagggagagatactcagtgagcagagaggtcagcttgacgcaagacacctgactgtcatacctgtgggtttccttgcacctgagttttttatctcttgaggtattttccttttatactctatcagtgcccattttttatggctatgcaagataaaccagtcatttcagatttgtggggattagtagaagtctgcattttggcaggagaaaaccattattttacttggtggttcccagaaataaagtctctagttatcattccatgcagacatcaatgagatttgccattgaggcatacatttatttgttttctctttctcatttggtggtaaatacttcaaagtaaagaaccatgtcctctacttccgttgtaactgcccacaaaacttaataattcatcttacatgtcttgttttgtgaccgttgaactgaccgtaacagcctttctctgatgtccatggcatgccattagtaagagtcacaaatactgtgatactcgcctaatccatttttaaagtctgttcagggatagtctaagagtacaaggcatatgtgcatatttgcttttagttgtttcattcaatgtaagctggatctgtgccttacttttaacttctaagattgcttccttcaaattggacctcagcatataatatttataaaaataaagcaggaactgttatttggttaaagcagaatatacttaaaatattaaacttgggataacttagagaaagccctgaagttgaagagcttggggctctgtcagtccgctggtggccggagtgccccagcaccgggccttcctcacaaaacattctgcctctgattccctatccttggaactggtgcccagttagcaaagagcaccagctgttctggccttggggacgatgcatggaggaggggcaccctccaaggaaaccaggccaatagagccaaagtgaacaatttcagtcatcattgggaaccatgatagattatgtagcactttaatgattgatttcctaaaaaccattcatgcagtctttggaagttcagcttgtcacttactggcgtgccctccagggcttctgtccacatcgatttcaccactacatctccacccatggaaggcatgggccaaacccattcatattccagagaacaaggtgcagtttccatggtatacagaaaggtaatattgtacagtgggcaataacattccagttccggctctgctacttcctacttctgagcaacttggaaggttgcctaacctctccaaagacctagataaaatggggttaagaatagtgtccacttcatagggtggttcgaagaaataagtgaaaatataaatgtaaaacacttagtacagtgtctgtcacacagcaaggactcagtaaatgttagccaagaggggaggaaggaggctgccacccttatctgttagctcagcttcaaaaagcctagcaaaataacatcatgaatttgatctgagtggtcacagcaaatccattccctcactgatgaagctcaaattaccttggccacattctttagatttttccctttgcctctgaatgaagcattcacttgacgtagataaaatacagacacctcagcctccagttcagccactgtccagtcaagcaggaaagtacattgtgagtgagtcttaagtgaaaaggactagttatgatgcatttgagacaagaaagtagatcgagctttaggcttttccttttcttgccggaaaggaaaaaaacaacattgcattaatcatcatctggtcctcggccaagattcgtatttacctgttatgtgccatattcatactcaccctgtaatgtggcagcctcgtgccatttatcattccaacagcccataacagatgaggagacacagatgacttgtccagggtcatcaagcttgtcaatggcagagtgaatgttggagctcagaccttctgactctcaacccaatgagatacaaataaaatagtggaaaccaccagccagccctcccaagtgtttaggggcattaaagacactggccatcctaaaggcgcctcttactcttatacatcatctaccactgaaaccagagcttccgctgtgcactgtccatgcgtggggccgatcaaggacaccaaggctgtgcaatgacaggtttcttctctataaactttccttgtctctttcttttaagacattgaatagcactaagggataatttcttccttttcttttttttttttttgtgtgtgtgtgtgttttgatttttgacacaggttctctctctgtcacccaggctggagtgcagtggcatgaacatggctcactgcagcctccacctcctgggctcaagcaatcctcctacctgagcttcccatgtatgtgggaccacaagcatgccgcaccatgctcagctaatttttaaaatttttgtagacacaaggtctcactatgagctaccatgcctggcctagggtaatttcttaaagtagagctttatctccttgtcgagaggcatttagatgtcctttcttcaatgaaagattctttttctcctctaaagaacccagaaataatttgttggtcctttactatgatgtccctaacagatctaatcatgcctctccattttgagaccattcattctttcaaacaccattatttttattcagacagtgtacctagcaatagtcccggcactgggaacacagaaatgaaaagttactctctttaagaaattcacagttccaaaacctcggctgtacccacagagtcagggtcatagggaagtttcagtaccagatagtgggaggagggccagggctgccagtcgttggtgaatgtggtaaggtggcaggctgttggcagttgagagctggcatccagcattaaccttagaaacaaagagctcaaggagcagaaatccagccacagagactgggattcggtcataggacttctgttattgagaaggactggaagacagagctgggtaggaaccaagataggcatcccattacagcaaaggcttgtttttaggtggcagacaagggcacagaaaagccagcaggagtgactcaatactggttccctgaaccactggtcccaagcttcctcttgataaagggtaggcctggtcccggagtctgggtggagctgaacttcaaagtaaaggagggttaagtaagcctaactggaaaggttctgggccgtaggggcagacagccaagcatctcactgcagctaaaacccaagtaaaataaataggacttatggtatgcacaaatctctcataccagagaaagtggacattccaagtttgtgtgatttgaaggaaaagattttagttccgtggttcttgtaggttgttactagattgctagaatgcttataatataagatagttttgtgtgatgggtttatttgggaatgtgatgatagaaacaaaaggaaattcctttgttttttattaccatacaaggataagattttgagattatctttccaaggaaaacttatcaactatctattatgtatcaggcacaatcctttgtactgggattccaaagacaaataagatagttcttgacctcaaggaacttgtaattcgttggggaagacagataagtaaccaacaaattagaacgtagggtgattggagtgtgtttcatgtcactgcgccacagaagagaagcagttgacttaggagaggagaaagtttaatttgggccatgaaggaaattaaaagtaaagacctccaaattggtgggcagccattgaaggattttaggaaagtgatgtgctgagggatggattataagatcgggggcagaaagaccagttacaagggaaaatcatgctggtcatgccccagtacttacatttttctcataccacctcttagagcccctgaaagtgtagactccactatggagaagcaacacaaatgtgaaatactagcttgcgagccacgtgggtagctctttcctcttcaggaaaggggaatgctagtgtctagaagtgggagagattgaaatgattctgtaatgaggaaataagttacgttagggcacatatataaagaaacagcagaaaaaatgtaaaatctcaatcactctgtagccatgacatttataaaaatgaaaattttacaagagtatttctaaatgctttgaagttggcccccaaaaagcctgcctaccttcactttgagttacaaataaaatccctagtgttgcatagctgtgtgagtggtatttacattctcacacatttcagatctcttgagtccattttgctagtatttgttttccttggagataggagttaattcagtcacactttcttcccctgacaataactgcatttttttctctaaggtagctttccctccaaccgttgcttgttgttcttacccaagacccagtatctgccaaaacaaatgtatgtgagtgataaacgctgagaggaatgtctgttggaccacaggaaatttcctgttcaggaagagatcttgggaacttcctgtggaggagtgcattgtgggacttttggctgcagtcccttgaccacagctgcaattaactaaaggcagagggggaggggagaggaagaagaggagacagctacccacagacattcttatccatgtagcccgaggagagaatgggctcatacaggttcacaactttgcaagtgaactagatgtctagtgcagaacaagatcactgtgcccaacctcctttactgccatccatctttcacagccttcccggtgctttcctagggctcctaaaaacagtcactgtcacattatccatgtgcattccccagtccctcataagcacacatgaagtgtccatgccctctgtagccccaccaactgtttggaatctcttgattagcttctagaatccaggcattggagttggtggtctttctccatcccaacttaagtatgaaagagaggagaggagaacccgtggctctttgacataccttcatgtgaccctaaaagcattagggaaacgttatggaactgttacgaaaaaagaggttaataaatccaattgataagcacaatcaaaaccaacaggagaaccatgcattcttgtgctgcaatgccattacgaaatgaagtcctcgttaatacctcatactccccttcttggtccccaaactgggcacgtctactttgcattcaagtgcctgatgtgtgtgcgtgtgtgtgttttattttttattttttatttttttgagacaacctattgcctaggttggagtacagtggcatgatcactgctcactgcagcctcgatggcctgggctcaagtgatcctcctgccttagcctctgggtccctgggacagacaggcataccaccatgccctgctaatttttaacaattacttgtagagacaaagtgttgctatgttgcccaggctcttgatgtttctttacagccttcactcagtgcttttatggagtccatctctgaagagcagggcttatatttgagtttcaaaaatctaaagtctcagctggtggcaatttacatctgataatatatatgaccttggaagtctctggcagacataggaaaggggagtggacatctaaggactgaaaaatatcccaggccattttctgggtcatggaaaagtaacctgaccttcttatcccacctcctattcatcatccatctcacctcccatccccatcacattttaaattttaattaatttttcattggcagataaaagtcatatgtttatggtatacatacataaaacatgatattttaatgtatgtatacatgtggactggctagatcaagctaattaacatagccattaactcacatacctgttttttgtggtgagaacatttaaaatctaccatcttcataattttcaaacatacacagtgttattaaccataatcaccgtgttatacaacagatctcctgagcttattcctcccatctaactgacgttttgtatcctttgaccaacacctccccacccgcatcccttcttttactctgcttgagttcaacttttagattccacatgtaagcgagatcgtgtaatatatatcttttcattactggcttatttcacttagcataatgtgcaccagattcacccatgttgctgcagatggacttcaaaatgtaaaatattcttcatgagaatgaagttacccccccagaaagggggaccagttactccccagaaagaattaaaaagtagccgggcatggtggcacacacctgtaatccagctaatagggaggcttagttggggggatcacttgagcccaggagtttgagaccagtctcacagtctcagcaacatagccagaccctgtctcatatttttaaaacaagaattaaaaagcaagaatagtttgcagcaaacattttctgagacttttctagataatactaggtttagtccgccctccaaagtagtataattacatcatggttttaaaattaaaagcaaaaatataggtgaagcaaaagtgagctttattcatcgaaaatttgtcctcactcatcccatgtgactttttaaagtgtaattctaaggagactcccagcatccggatggcaaatacgtgaacagagaaacataaattaactggaagggaacaaaatagacctctcagctgaccaattctttgtagctttgacattggcctttaaaagaacgaggcaaacttttttaaagaaagttatctaatttaatgcaagaggtaactctctggctatgacttagggtaattaggcctattttctacattttggacgtgtttcctatggctggaatgtaaaagcttatttaatattgatgtaaccccaaaatttaagtaattggaatgcactatttctatcacattctattgagctgaagtataggttgtgctctgttcaattcaggttgtcttgacaaagactgagaaatagaatggccctccaagggcatacctgactattctgcggataacacagtcacgcaggcatttgctatagtgaaaatactgttatggttaagctagtggtatcttgtatttcaatgataccttacggtttaccagttttcatgtaatatattaacctatctcatttaatcattacagtgttccttggtgtacagatgaggaatcaaactcagatatgacgaatcaaactcagataggctaagggtggaggtagaccaggagaacctgcacccgcatgcattcttctcactgcaagttcaggcaggccaggagatgaaagccagcatgagccagtgaataagcaattatctgacaaacccaaggccagcagaagtaagataacatctttgttcccctccatttcttcctatgccatccagccctcaacccctgctaccttcaagccctgttgatactcacgccctcctgcccacattccttcggtggggcactgaagttttggtggaggggagcagagcgaggaactctttgtttgtgcagtaaggacttccttacaggaaatttcctgtgatggaaactctggggaaacttcctgttggttaggccactgccgggggctgataacctgaaccacttaaaaccttcagggctctgctgctgagaggatgggatggcccttccctgcttctccaagtctgggagggcaagaaagtccaagcgtacagaagcctcaggaatctccctgggatggtattttccaggagctaaaagctatggctctcatcagctgatcttattctagaagaccagccctcatggttaaatggactgcttagatttataacgagaatggtacctgcagcgacatactagctggatgcattaatagggctttggaaaccatctcaaagttctgggtctggttcttcatacatcattttaaaacatattcctgttatattactctccagtgttaagggtttatgagcactgcaaacatttattttcagctctcacttatgaacttggaattctaattaatccttgtcattgtcagacatggttgacactgtatgctgtgtgggtcacttagcaccaagtgtaaatcatctggggtatgtcttgcaggacgaccaatcttaagccatagcacaaaattcttaaatagactttacaatcatttcacctagtttggacttctggtggattattttgttctttgtcagcactccagcaaagataattactcctaaatcatgccttggattgaactgagctttgaatgtctccaatgttgggaattccgtaggttcccatagcagctctcctggcccagctcttagtttgaaagtttggtctcctaattagcctgaattttctctagtgacctataagcccattattgtaagccctgtccttattgtgtcataaaaataattgactccttgtcttcaatctatttcatataggtagacagctgccacatcaagaacgtcttgtaagtgcttgatttaccaaagtccatttctccacaagtttcttcatagttgttttcctggattgggggttattttagccttactttctaaaatgactggatttaatggaggcctctgtcagtcccaactctccaaatttctgccccagcttggtgctctttgctttgtttatagtaaataatcatttcagcatcagaataaatcagtgaactggacatgtctttaggtggacttttgagattatattcctggtccacattgcaaattagggaagaatgaaagaaattataattaactaggaagaaatttgtccgctgagaagtctcccttgttagactcctagaaaatagagaccataatattttataattttttgtcacagtttccatacatatttgttgaatgaatcctaaaagtcaaaagggagctgcttattggatttgagttgcttctagaacatgttaaaaattatgtgaattttctcaatgtatttgtaagaataagctgtcctcgtgattgagtattgatcttcaaaatggagaattatcagtggtgagtgatgctgcatgtaatgtacttataaaggataggaaaaatattttgtaaaaatgccttgggataagctttaaatataaaaatccaaaatggtgatttagtttggggcactcagaggaagaataagaatagggcctgtttaaattttttgcaacatgattactcctggttttacatttgattttgtattatagaatgagattaactggaatatgttataaatacagaaagtctgtcattataaacactagtcagcaccttttgtcttcataagaataattgctattttcaatgcatacttgctctaaaatagaccatattgatgtcataatatgtagactgagcaaaaatattattagtatcatcatcatcatcatcatcttctgatcttcatcaaagttgtattaaaatattttggtattctaaatatcattatcttttttgaaagcctacttagggtaatagaaggatcaggaactttggactctttgacagatttctagttttttctatttttttgctattctgtaaattctttcaaaagatttttatcaggtgtttactgcatactctgaagtgctgggatatatcagtgaccaaaacagatatgacccctgccttcatgttgcttacagtttaataggggagataagtgtctaccaaggaattcacactagccagagagcacattgcccacacagcatccagagtaatctgttgtaagataaatcagactgttacttccctgtgccaaaacctccactggcttccagtttcatttggaaaccttctgagttctcagtatgaactgccaggccctgtgtgatctgaaatttgtaaatctcgtcaacctctccaccctcatcctccatcaccttgtgttctgctagttcctcttcagccaccctgatctttttgctattcttggaacacacaagtttatgttctacctcagggcatttgcacttgctgcccttctgcctatgaagctgtttctccagatactctcatgttagagtccctcaccttatccaggcctctgcttaaatatcacctccttagagaagcttccccaacagcattatccaaacgacaccttccttcactctccatcacctttatcctgcactatttttcttcttggcaattttcaccacctgacatgtaattttttaaaacactggatggtgacccttaggtatctattcaaaatggccattcttgtgcacagctggggtatgatgccagtgggtccacctgtagggtaattggatgggcctggctgtctcatgggagactccagagtcttttcttttgggaaggcaagtttgtccaaaaagaaatcctgtgggctcctccttagaaagagtcaatatatgatggcacttgagcttttaccatgaagatttccactgagttcccctatattccagagctgctcacccttgctccctcctgaacttggcgttctcagattcatcctgattccagcaagggaaatgtcctttcatctgcaaggaggtgcaggttgctgggctgggggagggtggaatacagccatgccacagatgctttattagtcttctctgttccctgcctgccttcagaggcacttggaacccccagtttctgaggttttatgaagttctggtaggaaaacgagtttgtttattggtatctccccctgcaggcagattgagttaagattttctgctcagctgagtcagataccaattgtccgtctgttccagcttccaaaattttgtgcacctccctcaactgccattgtttcctctcccattctgttgtcttgtgggtttgtaccttttttattcctctatctggtttagtgggacgtcagacaggagcagggatagacaagatatgtctcatcaatgtagttacatgtggaggtaaaagcattgatgtagcagtacaggatgctttgaaagcataaaatacagaaatctggtctggtgtgtcgcatacatttaagaggagacttgaaagctaagtaggagttaattgggcaaagaagaaggtaggattatttctggggaggggaacagagcctgtgaaggccctgagactggaagaggatttgttctacagggaatggaaagcccagcccaactggcattcattgaatttgctgtggaaaagcagagtgacacattgctttggtgaggattgcagatggtgaggtagaacaagacagtcacgttaaggattttgatctttatcctaagagcaacaagcatccgtgtctgtgttacctcagtaaccttggacctcgtaaactctgggttcttttataaaccaggcacagtaatatctacctcacagagctgtgtgcattgcatgacatcatatacacactatattgacttaagactgtcatatttgtttgctcaactcatggatatgaagggcagactgtataccttgtcaggtacttttttctttttattgtatcccatgggggaaatggatggtagattggtggaggtggctagaattgtaaagaaaaatatgaaattcacatgaaggctggagttactcatatgacaacaacagcttatggggcccaattctattgctcttgcgtctgtcacacagttgaggttttggaatgaactacgtatgccatccttgttggacagtgacaagtcactgtagccccctaggagaagaacagtataatcaagatgtcaggttgaggaataatctttgtgatcaactgagtgaaaggtacaaagtaagaaacaattgagaggcattgctctgggcccaaaagtctagtaacaggcaattagaggttaaaggataagcatttgatagtgttctagctatactgcaaaatgaatgctgcatgaaggctaactgagaagcttatcagttggtagttgggaactaaagaggaagcaggcaccaaggaaagatggaaagttctacacacctttgttagttacacatggaggtaaatgcattgatgatgaatctgccatttttaggttttcatgtttaaaaagtttcctgacaatgtgtctagcaatgtgctagacactgtagataatatacaataaaatattaaagaggcggctcgtcctcaaggaactttcaagcattcatacatttctgtttgattgtaacatatttattattttaaagaactggccagagagttgcatgttctgtgtagggataaatagcaagtttcaggcccctgcatttattggcacttacgtacatggtagtcctcacacctttgccggacagcaccaaaaatcctgcggagctcaactctgtgacctcaccctttgagcctggaaatcagcatgaactcatgatctgacaatcccgaacaagctaagcatttcttaaaagaaagcagtgacttttaataggtctcactgatggtgttccaccgattaaatcagtcaaacagaattgtcacattgaagattatcttgggtttctagaattcattctaggttttaaagatgcagacagattctgagggtcacaaacgtcagtttgccaagtatgtttaggctgtaaagttatccatgaaaagaccgtgtggtttgcatgagattgattgtgatcggatgtaactacattgctttttacagctcagtagaaaccactttcaattgcaaattgtagcagaagcaggcgtctacttaattttgatcttaaagaatttcaaagagaataaatgcacactaaatagtggtggattttggtagtatacgccaacatcactttttatttaacacatgcagaaatgtgtactggtagagaaaattggtagagtgaattaaagtacagacagatccacattgactttaaatgaatacatgcacggtcagaaaacggtaaccctgggcaggaatctttaagttttcagggctcattagacagtgagcaggtgaggctcaaggctgagtttgcaactgtgctgtgaaaactcaaaaatgaaagtttttttcatttctgagcctgttgaaaagtgggtaagaagggaaagggcagtctcataataaaataatatgtaaaggctaaccaaataacccactttagtctttacttactggcaggcagcaacatgtcctatttacagagggaggctttacctaagtggttatatgtaaatgaaccaccttttcaatgaaacaggatgcacctgtctagaggtgtctgttactagagcaatggatgtttgattggactgacaaattttatttcctttttggaaaaaagaatgtaggtggtatcaaatcaccctttctcctggtaacaataggaattacttcttgaacttgagaaaccagtagttgcttgacctatgttttttgcatttagcatagtcttctaaagtagtaggagcatacgtttttgtctttaattccctgcagaccccttccccaatgatcatcagcaatacatccacccataaatcaatgaaatcataaaaaagaaacataaaattcacttgaaaaagaatacctacaaggcattcctagaattctcaatgtaagtcattttttgccagcaaagctaattgttctcaaatatttgataacaaggatggcatacgtagttcattccaaaacctcaactgtgtgacagacgcaagggcagtagaattgagccccataagctgttgttgtcatgtgagtaactccagccttcatgtgaatttcatatttttctttacaattctagccacctccaccaatctaccatccatttcccccatgggatacaataaaaagaaaaaagtacctgacaaggtatacagtctgcccttcatatccgtgagttgcacatccgtgattccatccagccacagatagaaaatattcagaaaaacaaaaaacaaaaaaaaaaaacccacaaatgcaacaataaaaaaatacagactttcagaatagcatataacaactatttagatagcatttacattgtattcgttacaagtaatctagagatgatttaaaatatacaggaggatgcacataggttatatgcaaatatacaccattttatataagggatttgagcatccttggattttggtatctgggcggggggtcctggagccaatcccttgtgtatgcagaggaatgactgtactggaaagcaaagtaaagctacaccaaagagggtaatagcaggctataaagtactgagagaaactaagagaagaaagtgaggtacctctgacaaaggagtgcttggaagagaaaggatgaatagaaaaatgggatttcagggaattcattgatgacaggatgacctacttaaaaatgacaagggccatgtgtggtggctcacacctgtaatcccagcactttgggaggccaaggtgggcagatcacttgaggtcaggagttggagacgagcctggccaacacggcaaaaccctatctctacaaaaaaatacaaaaattagctgggtgtgatggcacgcgcctgtagtcccagcttcttgggaggcatgaggtgggagaatgacctgcgctcaggaggttaaggctgtggtgagccgtgatcgtgccactgcactccagcctgggtgacacagggagaccctgtgtcaaaaaaaaaaaagataggaagtgagcaaaagagaggtcatagataatggcatgatgaaacagaggaaaaaaaggataagaaggaggaagaaaaaatgtacaataaaacgagaaggaaggatgcaaaatgaatataggaaaaacaagagaactgaagacaagaggaaaaaaggagatggtagaagggaggaatgaaagtaagtaaaataggaatgaagttcaagatctatttagccatagctaaaggaacgtattatcagctattgatttcctcttctaataaagaggagaatgatatggatagtccagaataatggatcatttgcaaaacattaatgtgtcttgacttaaggtacatgtttataattacctcgaactgtatatttgtcttcttccatgtgtggttttaaattattttaccaaaatggggaagccaggagatacatacttgattcagtaaaaccagctttttattcgtagtttacttcctgctgcatccttttttcggctgagagggatcaatgtctgcaggtgtcccttaatccataattaaaccatatgcacatctaccctcccagtttccctgcccaccataaaaccttcatcttggctattgcttggaaaatggggagggaatagagcttctgcttttttttttttttttttttttttttggagagagtcttgctgtgtcacccaggctggagtgcagtggcgtgatctcagctcactgcaacttccgcctcccagattcaagcaattctcctgcctcagcctcctgagtagctgggactacaggcacgcaccacaacgcccagctaattttttgtatttttaggagagacagggtttcaccatgttagctaggatggtctcagtctcctgacctcgtgatccgcccacttcaacctcccaaagtgctgggattacaggcgtgagccaccgcacctggctggaatggagcattttacttgagacctctgtgagctggtcctgagtatgagtagtgaattccaacccacttttctcctaatccctgtcgtgtcctagagtgagaatatacagaggggttggaagtgggtttatgttcatgggctttctagatggactttcaagtccaagtagaagtccaacttgagagctcgtgtagaaagcccttgaatgtaaacccgtgaagaaaagcacttccttatttcagaaagagcacaaaagaccagcaatccaaaggcatttcgaagaccttgaaagagctgggagtggcttaggtatggagggtgcatgtgtgagtacaaatggcccctcagctcagaaccaagcatctgtgtgccatgatccatggttcctaaatatcatggagggcaaaaagtataaatgtgaattaatgcaagagaaaccacactgaaataaaaaatacctgtggtctcttgagattcaagttggcaaaatccaatctaaaagatgtctgactatcacaattagtgaagtccacaggtcagattttcctctctgttcctgattaggattaacctggaaaggtggattgggtccatctttaataataactacaccttctgaaagatttgaaactattattatctctttgtttgctgctgctttcatagatttatggtaggacttggggttagatggatgatccaggtcacctattccagcctcacactctgcctctattccaaatatgacatcactgagcgatggccacccaccttcccttggatacctctaacaatgggaatctcactgtttcacaggcagctcttttttttttaaacacctccaattccaatttttaaacacctccaatgtccagaaagttctttaaactcttaaatacatgacatttattaaaacaaagcctcaaaccactttcagagtggtggtacagcaaataattgattcttttcagggtttttcccccctgtgttttttgtcttctctaactcaaatcattgcccggatattgcttataacaggagctcagcctcaaccagtctttctgcttttaccacatgctctagtggaatctagattaccggactcatttcgaatctaactaaaaatgagaaatgctctgtttatataaagcttggcaatcaataggaaaaggaaaggctgtttagcaaaggccagtgataattccaagaagcagtgtcttttggaatatgctatggtgacctggccactgcagctatctgcttatctgtctggtttcagatttccagaaaggactcgctgccttcgaaacacttcccagcccttccttgggtgcctggatttctaccattagcagtttactccttgagcatggatttttgcagaaagacatgtagaccagggagatggctcattaagctcttggtggtcatttcaccagagcatttagcatttttaaatcccttcctggatgcttgttttagtgatgatggtggtggtgagatgaagcagggatgtgtagatcatgaagggatgggaaaggggatgatttggttggaacgaagcaaaataacatttctgagtgcctgctaaggtccagcacttttcacacgtaaaattttcacaacaatccctgtgagttgggatccagtttctacagatgaggaaatgaagacaggagactagatgacctgaccaggtcctaggccagtcaggaacagagctgggatttaaaccagagctgcctggtccaaaacctgtgctggtcctgctattttatgacacctagaagggaaaagggcagagaactggaaagctgagatggaatcacctacttaagaattttgcagaaggctaaccctgtctaaaagcatcgctttgcaatcagacacatgtggcagtaaaaatgtcccaatgctaactcattttaagccttggttttagtctacctaaaatttatagaacactgtaaaatatgctacatgtaataagatatttattaggagtcttcttgcacttgttcagaatgctttttattatgtttctgctcattattgtagatattctcccattttggagaaattgaccgcgtgcacactcttcactggagttttgcacaaatcttaccagaaaactggtgaagatcagtcctgaggccccttccgcctctaattccttgcagtattttggctgtactatgtgctgttacactagatcacaataagcagctgccagtttcctcacaggttcccttggggaaggatatgggaataattcttaggaaccccccacaaattatagcaaccaatgcagtaaaacccctttagctcactcctccccctgtgctcactcacatactcaaatatatttagtgctttccttcctctcactccgacacttttgggagagccctgggggtggttgagtaccttgtccttgggtggattttcttgttttctgagactggctgccatcagacttcgggagaggatcttaccagaggcgggtctcttcttcccccgccaccgccctcagtattctttcacagccaccacaaagccacgctttctctgctaagtacacattcctaggactgtaacaaaaggcttctgtgagtttgaaagctgcaggggaggctcctgcgtgaaggcctaagatttaaagggtttcatttctcctgtgctggggactgtattgagtgcagtttgaaatctgcttcaccaccacaaggggaaatagaaatcagccctaaagctgcatggagaccccggctggtctttatcctcatagcttagtgatttcctgccacccaagaggcagtgaggggctccctgacattccggaggccccaggaaccctggctgcggtgacccggtgctggggagggagtgcatggggtaggctcctggttgtgagccttcagttcgccgggatgtctatgctgtgctgtgtggctacttagccaaggctgtgcatgccagccggagccaacagcttcagcaaacctgccctccggggagagtggatttcattgttttcaaagagatacaggaaatcagaattttccatccttccatggagagacttggattggactgagaagagaaccagcattaaaaaggaagtctccttccctttcttccctgcccctcctcaccccagccccagcccacccgccaggggcacaccctccctctgccggcctttgggtggaaaccttcctgcctgcagcacaggcagtgtgaactgcggggctgtctgagcaacccagctcttgccttttcagtagcagaggtaatgtggccacgactcagaattatgggaccccagatgctgaggaagtaaactgacttcttttcagctcacagcagacgcatagacaacagagtagatttcatgttctaatgaaacagtgtagaaactctgtccttggtggctcagtactgtgtggtatgagcctctgcctccctccctccctccctctttccttctcttttcctcccccaccccttcacggcctgccctttcctgattcttcagaactgacaactataaatccagcccaaattcctttaaacaaagggtcaccaagagcacgaccttgaaaagacttcttgtgatatgcacttgcagagttgcatattgttccttggatttaggacaggccaaagaaatcttccactttatttaagaagagcctgtgtggttcgaggccagggccgtggacataggattaaccacaataataatacaatgaagtacacatgcaaaatgaaaacttaataatgaagaactactgattttttccagggagtatcaagcacttccttgtaaattcttacaaggcatgaattatttcctagaaatgatttaggctcttttggaaaagtgcattgattcttttaacatcataattccagttacggtaaaacctccattatctgattttctgtgaattgcaaagctattattaactggtacattttatattttaccagtacagtgacagctgatatttataatggtgaccccaaagttctgtaaaatgccgaattacccactcaggaatcaaagaaagattaaattgtgttaaatagagtttttcatgttaagtgtcttattttattcagatcttgttttagaaagtccaagtgtacatccaccataattttcgagggcagtaccaacttaaaatgttttatcttttcttggctttgtaaacaaaaccttgtaaaaaaaaattttttttttcaatactttgggttcaaactacagatcattcgatctcaaacctgacaggtaaacaaatttttttttcagagtaagtattgcagacatgaaagatcataaatgtgttcaccaaagtgagtgtgagacagatcaccccaaacactctccactatttctctatgatcttagcccagctgtgtgtgttgtgagtcatgcctgggtctgacaccagcattcagaggctggcatagcttagcatccacatcataaagggctcagatcgatggctctccttgtcaagctctgcagccctctctcaggctttgtgagatgtggtttgcatcattttcctttaaggaaatgttatgcagaaacataaatgcagtatacaacgaggaggctttcaccaagaaattaaaagggtacagatgtctaggaatgcaggggttaagacaaaaatgtactgcagggaaagaaatgtgagcagaatgcccctcttttcgcctgcttctgccttgcatccagcccttcccggggagtgtgatgtgaactgccatccaaggtggctgtggtacaggggcagggtctgggggctgcttctgcagcttcagcgcagaaaacccagagctcagtcccagcaaaagcctaaaggagaaggaaacagaggccctaacacaacagaaaatgatgcaccccactttcctgtggttcatcagttcacatacttcccaggagaagtcaaatcacgccccagaataggatacctacttaggacttagtgatgttttatagtcatgtcgaagaaccttcacatccatggcctcatttgatctcacagcaagatgggcatgattaaaaaaaagaagttactcccactttccagatgagaaaacaaattcaaagacagtgagtgccttagctgagtcctatccaagcaaggcagggggcaaagccaggactaaaacacaaggttctaattccttctccatgatttcctgatgcccatcataccctaatagaataggatcaccctgcaaggcaactggtccacatggagagtcctcttggaggacaccgacccgtggtgccacctctgatttgcaagttggtgcattagacaagccctggaatgacagccagaagatctctattctgatcctggccctccgtctacttgggccactttgatcaagccatttagccccgttcccttcaggtggctcagctggaagtaagaatgataatgcccatgcagctgactcacctggtgactgtgaaggccaaatgagatgatgtgtttgagagcactttgcaaactgtggagtattgccagccatttctcctaatttggctcagggcagaaagacatccaggtgaagagcttgatgtgtgtgatgacttaggcttggggatatttgtgaacaggacacaacaaataaattcgtttgacgggcagagggacagtatgctgggtatagtagaaactcttggaacctgcagttattgaagggtttaaaactcaaaaatgatacagaaggcagttctattacagtttctgcttttttgctgttcaacacctctgaagatggtgcgtttaatccttcctgggatggcaggttatagatgacttcatgctgaaagtgacccgtaaggaatatccgtatattttgaagtgtatgtggttcaccaggcagaaaacagtctgccaagtctctcatcccaggcagaaggggtggcacatgcgaaggccagagaatgcagtgcctctgagaactgtcagatgtcagtgtggctggagccaggtctgctagagggtgaggttggaagttaaccaggagtttaggaggccctgggaagcctctgaaaatatttaagcaaaaacagttagctttatgtttttgttgttgttgttgtttgagacggagtctcgctgtcacccaggctggagtgcaatggcgccgtctcggctcactgcaacctctgtctcccaggttcacaccattctcctccctcagcctcccaagtagctgggactacaggtgctcgccaccatgcctggctaaattttttgtatttttggtagagacgggggtttcaccatgttagccaggatggtctcgatctcctgacctcgtgatccacccgcctcggcctcccaaagtgctgggattacaggtgtgagccactgcgcccggccagctttatgtttttaaaagatcattgcctcgttcttggttctcagctctctgatccttttagtttttattggatagaggagagaccttaatgtatacagagactaaggaacttggaattggaaatctgcctggctccctttccctcaacgtgcctgcagtcagccatctttctccagctaagccaaaggatggtgggggcaccacacaacagagagctgagttagaaagggtgggagggaggtggctgaagggtccccactgcagttgacaatttgaaataaactcccactttccttcaatattttcctatagcaaatggaaactttgaccagataccagcttctttccatccttccattagactcacagcccagttaggatgttcacagtcccaagccagggatagcacatgccattaccatagtgggctggatagggggcaggaagcaatgctttccagcccttagaagcctctggtgatgtgctgtgaacatggtgagggaacccgaactttagagtcaaacaggctggtctgcaaaccccggttccagcactcactggactcaggatcttcccaagttagttaactcctctgaccatgtctgcattttctcatctggaaaatgggaacagtaatatccaccctccagagctgttatgaagatgaaattgaaagtgtctccaacgcaccaggtatatagtataatctcaatttatgcttttgcccttagatgccagaagttaatattctttcaatacttattctcgtagaagcaaaagagatcctgtttgtgtgatgttcctacagcctctgctgtactgtattatgaaagctcaagaaataggagttaatgatgaggcacagcaggaagaaaaatgtctctaagatgccaaacagggaaaatttaggaagaaataagaaccaaaaaataaatcagttgatcagggtaaaaaatgtcttatgctctgaacttataactctatggagtaatttccactaatgatctcagtgtctacttaactaatcatgtacttttctagccagaaagacagtacttgtagggtacgttccattttaatgcacaaatcattgttgcttttcaaaaagtcatctttttttccctggccacacacagcaccccgaggcctggccagcccccatgccagctcaagagcatgaactcttaccggaatgggttctgtggggagtacaaagtcaaacataagtaggcttgcattcagagctcactgcctagcgggaaaaaagacatatgcactcataactctaatttaacacggcgtcctagaaattccatatccatcttcaaagttctctggaagcaaaaagacaggaggaaagacatttttagaaggaggcttcctggaaggagtgacttcagtttcaggccttaaaggagatgtgagtttccacatgcaaggagggaggaaaagcatgttgcagacagacgaagcaagtgtgtgagcaaaggcctgcggggtgacagggaggggtgttgggaggtgtgtatctggatgaaggcaggtatggaaagtgctgggaaaaaaggtctgggaaagggccttgggggccaggtgataaggaagttgaatgcctctttgaagagtggggttttattttatgtgcctttggtggggagttgtgaaggtttttattcaaaagagcagtggggctgggcacagtgactcacacctgtaatcccagcactttgggaggccaaggtgagcagatcacgtgaggccaggagtttgagaccagcctggccaacatggcgaaaccccatctctactaaaaaatacataagtaacaaaaattagctgagcgtggtgatgcatgcgtgtaatcccagctatgcaggaagttgaggcacaacaatcgcttgaacctgggaggcggaggttgcaatggcctgggattgtgccactgcaccccagcctgggcgacagagcgagagagactctgtctcaaaaaaaaaaaaaaaaaagcaatgggaatggttcttaaggaagatttctctgggcacactgtatgttctcactgaatatttggtgtggtttgggttttataccagttacgatatggggcttggtatctctgagcctaaaatctgtgctttccaaggacagtagaaatgctagtgttcactttgctcagtactcttccctccacttggcactcatgctgcttctcaagccttggggtgtccctggttctggagtccctcctacccctgcagcccttttctaagctatagtctcacccctcctctgcaggctcccaggcagcctcacctcctcctgcagagggatcagctgtcaccctgctcctccctcctggccctcagcctaccctacccacatgcattcaccatcttaccagtggaacaggcgtccctctcctgtatacagaggtcccttcccctgagctcttctgcctcagcctccccagtgggcttctcccctccttcacagtcagcctctttctcatttgcacctagttccattccatcttcaaagaagcccacttggattgcacatctctcttcactaccacaaatctggttcctcacagccaagttctggaaagagttctccacatggtgtcctcctcctcacctcccattagcgcctcaaccctccgtgatctggtttctacgcctgctgcccctctgccctggctgcagtccccagatgccgaatccatctgccatctgctgcccgaaactctcctggcttgcaagataccactgtcctctgacttgtccccggtcttgtcccctgctgttccctcctttaagaatacaccttttctaaattgcctgctgcctaaatgttttcctctggaaaactcacctactccagcggcttcaacgatcatcagtgcgatggggacttccaaatattttttatctctagcctgggcctttctcttaaataacagatgcatgtgtacaactgcctactgggcctctttacctagatgttgtacagttacctcacattcaacaaagctgaatatatcccccgccaatccatcctctgtgggatgagatgggcgggcccctctattcatctagtttcaggaatcaggagcttggattttgtcattgactgcttcctccacattgaattaatctcttaagttccatcaattctaccccatggtatcttcagcccatcctttctccatcccttctgctttagttcaggctaacaatatctgtcatctccatttctgcaacagcctctgactggccgccttgtaccagtcttgccctgttctaattcattctctactctgcagctggagtgatcctttgaaaacaatatccgattatgttacgcccttgtttaaaattcttcagtgactccttgtagccttaggataaagcctgaactccttagtacagcagacaaggccttccaaggccttcctaataatagctaacacttatgaagttcgcaatccataccccacactgttctaaggtccttacacatatgtcaacatacttaatgctcataattcctgacgtaggtcctgttactatccgagttttacagtggaggaaatcgaggcacagaaaggtaaggcaccttgcacaaggtcacacagctaggaagtgggagaaccaagattcaaacccaggaaacctgactccaggcccacactccttagcaccatgctgcactgtctccatcatgtgccgtagcttctcatccattcagaaatattatattgagtactgaaaatgggctagaagctgcttgagacactggggatatagcaggaatccaaacaaaggtccgttcacatgctagtgaagaaaatgagtaagaaacagcatgattagtaaaattattaggtagattagggatgaatgctaagagaaaacaaaaataagcaagaaagaagaccgggggagtctgagaacagatatgcgatgttagaaggagtgtccagggaggacttgaaggaagtgaggatgtctaggagaagaatatcagctgaaggaacagcaagtccaaaggccctgaggtgggaatagttcctggtaggtctgaggaacagcagagaggtcagcgtggctggagcagaatgaaggagggaaaggatgatggcaggaaaggatggtgggagctgggtacagacaggtcaggtcatatagggcccagaagatcattgtaaagaccttggcatgaactgtgagtgagagataggaagccactgggggattctgggcagagtgacatgatgaaacttacaaacagaggagtgatgtgatttgaatcaatctctggcaggtctgttgaggatagatgcagggaaggaacagtggaagctggcagaccagtcagggaccagtaacaatgatccaggcaagagaggatggtggctgggactaatgtagtagcagcagaggtggcggaagtgggcagagctggatacatttggaaggcagagccaataacacttaccaatggaccagaagggggtgtaaaagaagaaacaaggggctgggcacggtggctcacgcctgtaatcccagcactttgggaggctgaggtgggcggatcacaaagtcaggagatccagaccatcctggctaacacggcaaaaccccatctctactaaaaatacaaaaaaaaaattagctgggtgtggtggtgggcacctgtagtcccagcttctcgggaggctgaggtgggaaaatggtgtgaacccgggaggtggagcttacagtgagccgagatggcgccactgcactccagcctgggcaacagagtgagactcagtctcaaaaaaataaagaaagaaagaagaaacaagggcgactggaaggtgtggggccttggccacagaaagaatggagtttgccttctctgtgatgggaaagattgggaacagcagatttagatgagtgacatctggaggttggttggcctcattaagcctaacgtgcctattaagcatcaaaatggagatgttgaccgggcacagtggctcatgcctgtaatcccagcactttgggagtctgaggcaggaggattgcttgaggctagagtttgagaccagcctgggcaacatagcaagaccccatctcttaaaaaaaaaatgtgttttagattagccgggtatggtggctcacttgtagtcctaaccacttggaaggctgaggcaaggggatcacttgaagccaggagttcgaggctgcagtgaaccatgatcccaccaccatacaacaactctgttgtctgggcaacagagggagattctgtctcttaaaaacaaacatggagatgcattgtcacctcccaccctcacccccatttgaacacacactcacatatatctcacgtcctaatcctactgaactactcaacatttccccaaaccggttgtgctcttttcatgtgtgcaggccttgcatccgctgttcctctgactggaaagctgttggcccatccagttgagaaagtcttccctggccgtgcacgaatgcactaacttgtaaatgtctctttacattcctttcttcccttccagaccgcaaaatccagtctcattcaccttgacatgccctgcgcctgatccgggacgcgaggcatagtgggcatctcctaggttagacggatgggtgagtgggtgagtgaacggagaggtggacaaaatgagtgctcagcagttagacccaactgtgttttgatggtagtgatgggaattcccctggcacatggccaggtgagatgatcattcagcctgaaatgaaagaaacagcagatgtcaggaagtttttgttaatcctgccttgtgcgttagaactctcccgcatacgtcccctttcccgcacactctctctacctttctcccccatttctagctcctggtcttattcatctgtagcatcagtaaacatataccctttactgttcacatccaggtctgtaggggaaattttggttataaaaccggaagagtgtttaacctaatgtcctgctgcgggcttgctttccacgggcctccgggtctgttaaaatgatcaggcctcattatttaggaagctgcctcagccaggcattactaatttgggcattactaattcagatgcctattcaggcaaatgagcaatgaatgtaaagtgcttttgtcagtgaattgcaagtgaagagaagagggagtgggggaagtaaagggaaagtgatagaatgtttgagctttgcttcatttccagaaaggacagccattgcttcctggaagctgggcttggcaacaggcatggaggaatgggaaagatttatttccctttgccaaagctcaataattcagcttgagtatttcaaatcaatacatttcttgcaaagtttccaagggctgcattaaaacagccatttttaaaaattatcagtacatgacagcatcctccgacgagactggcatgtcagggatgagtcgagtcttccaaatagacaagactccagtgagaaaggaggctgccacaagcaggaaaagcgaagttagagctgacagcaagaccaaccgcacctgtagggcctctggcgttcacacacctcattggttttgtgggggctctttctgagatgagcagctggatcgctcctcctaagggcttgcatgggggaatctgtgactataactccgtatttctttgaagatgcaattcatcactgaacttgggaaagactaacttggggaggtctccaccacgatctaggattgctaagatgtctgacaggctgagtcactcatacttttgtgaactattaaaaatttcatagttctgacatctggacatcttgactttcggtgataggagatatggaaagacagtaaaaggctgtgtctttactgttgttttaatccccactagagagtcctttttttctttttttttttttttgagttggagtctggcaccgtctcccaggctggagtgcggtggtacgatctctgctcactgcaacctctgcctcccaggtggaaatgattctcttgcctcagccttccaagtaactgggatgacaggctcccatcactaggccaggctaattttttgtattttcagtagagacggggtttcactatgttggccaggctggtctcagacccctgaccttgtgatccgcctgcctcggcctcccaaaatgcgggattacaggtgtgagccaccgcacccggccagtaattccttctatttcgatgtttcatcttcactagaatcgttccttagttctttcggtgggagaagccattcagccccccttgactgccagtgccctttgaggctctcagccatttgattcttcctgtgtatcccctgtggttgttgtctctgtttctagagtgcagtggttcctgcactttgggctgtaaccccctttggtggggccagagaccccttagattaattatcacatttctttcacttactgccacaaaacccagcagcgattcactaggagaacccgaagattggtgctcttctttatgagacaccaaaggggctctgtgtttcccagcatgaagtcttcagtgacagagtctgggaggacagcacaggcagcagcagtgtaactctcagaatccccacggaagagcagagcagctcaatagcaaaaccaaaacccagcgacgagacatccccaagtcccaccttaatgggacttttggtagcctttggaacagggaaaacccaaaaatagccaagaggtattcaccagaaagcctgaaagtgggagtggttttgctcgttcctatagtagtgagggcaagtggcgtcgaggaggtctgaaaggtgtagagttctctgggccctgtgaactctgccactaaccagccacgctgatggccagctttcaggatagctgtggagaagctgctgggagtagaggcacattgaaaaggttagggatggccaggcatggtggctcacgcctataatcccagtactttgggaggccgaggcaggtggatcacctgaggtcaggagttcgagaccagcctggccaacatggtgaaaccccgtctctactaaaaagacaaaaattagccgggcgtggtgatgcatgcctgtaatcccagctattcaggagactgaggcaggattgaaccctggaggcggaagttgctgtgagcctagatcgcgctaatgcactccagcctgagcgacagagcaagactccatctcaaaaagaaaaagaaaaagaaaaggatggggcagcagagacttagatgcaaggtctcccaaaggaaacagaaccaggagatttcagaaagccagctgccatttatttgaatgctacatgaaaacaatagaagagagggtttgctaaggctggaaccatgccatttcataaaaatttcggaacattgtcttcagatgaaaatgagcaacagaaaagtagtgaggtcaaatcccacacaaagtttttataagataaaggaacagaaggagcagaatagcatccctcaagaaagcgtgccaaaacaacatgcctttagaacaattcaaaaccctacttacctccaaatgagctaaaaggtaagaagaaaaagatacgaagcgtggggcaaacacaacatcaatcagaattagaaaaacttccaaatgaaatgacagactctggaaagaattaaaagtaaaagaaaaatcatttcagaaatgaagagttaactagtgagaatacaagatgaatctttacaaaaggtgattttttaaaagagaaacacaagggggaagcaggaaattttttaaagaagaaacaagaaaggttttaaaaacaactcaagaaaaagtgacaaatattgaagaacggcaaagaaatttcaccacgtggataataggagtctctggggaaaaaaccacaaagcaagctttcgcctgcatcgctcctgtctctgcccctgtcttcacatggccatctcctctcctctgcgtctctcctctgtttccatataaggacacctgtcattgaatttggggcccacctgcataatcttgagatccttaacttaatgacgtctgcaaagagccattctcaaattaggtcttattcacaggttctggggattaggacacggacatttctatttggcagccaacattcagccatctccagtcactgagctagtaagtgacaaaaacaggatttgaatttcgttgtttcattttattataacgtggttaagagagattttaaatatttccattaagttagcaattcttgccaacaacagtagaaagcatgcctttttttttttttttttttttaaagtcagagcctcattctgtcacccaggctggagtgcagtggtataatcatagctcactgcagccactcctaggctgaagcaattctcccacctcaaccttctgagtagctgggacttcaggcatgcactaccacacctggctaatttattttgtttttcaaggagatggggctcttgctatgttgcccaggctggtctcgaactcctggcctcaagcagtcctctcacattggcttcccaaagtgctgagattacaagtgtgagccacaggacctggccaacagcatgcttttacaaatagtagggtagcaggaggccagcctgcagaccgcccagagacctcaccccatcttacgctctgcccaacctcaggggagcatttttgcacttggtggattagcattacttgctccatccatgatgagccactcatgctcttcacagattttccagactcccatgtcaaagttaaaaaacagacatcggcctctttccagaactcagaatattcacatctatattgttaacactcataccttttccagcacagaatgaaaagcacctttgaagaatcgtaagccatgaatgatgacgggccgaagggagtgagggctcctacctcttgtcactcctaccatcctgcctccaggacccctgccacctacttgggagtctgcccttaaaactcaagggtcacctgactcattcctccccactcattcatctgactacccaccaaagctaagtgtgaacagcctgtattgatttatcattttccttttgcctgcttcctctggtacagagatcttcatgctttcatccaaacgaatgaataatgtaaaatcccaggtggggtgacagagccaaggagaaaagtgttctgcagcaagggagggcctcccagtatgagccttggagtctcagataagcccagggacaaagcatgagacatccagttacatatctgtggccctggaaggggagacggggttcgctttgtggtggtgtttagctttcctgactccaagtgaccatcttaagccaggggattagtaacctttacaactctaatactagggaatatattaataactggtgagaaaaaagattacagcttttttattgataggtctataaaagccatttccgtatgaatgtcctcagaaaggaggaataaggggatgagatagaatagaatagagagaagtctgtctcacacacacacacacacacacacacacacacacacacacacaaatgcaacacaattatctttaaatagaagttgcttctccaagtttgtttttttttgtttgtttgtttcatgaggcgtcagcaacgctgttaaaatgatttcatcctgcctgtgtgtcacagcagtctgccccgcgaaatgctgaatcagcagcagcccagacagcctttcggtggagggtagattcgacacccaaaggcaaccaaccgggcctttgaaagcacttggaagcactctccaaagagccagggaagaggacaaggaagaagggggtgcagtggaattctccttaaaaaacagcatgttctagaaaagccatgctttggaggtgctgtaggtcagatttgcctttgggtccctatgtgtattttctgaggtctgttcatgtaaaagttcaacacctctttcgcactcccttctcccagcccccgcgccctgcccccacacctcctgtccacctccacctcctcctcctggaattcagtgattatcaggactgtctccatcctgagaagaggctttttaaaatttcgcaggagaatagagacacccgagagggctgggaacaggcacagctgagccacacaaagccaagcctcctccatgcaagtgacggacagatcaggtcccagttcagaatgagaatgagttttactctggttacactttgcacaggaatgttctgcagactgtgccgggcaccagagatggtccgtgtgcggtttaaaagagcaggaggggaaagaattttcatccctctttattcaggcaccctcaggagagtatccatgttctgtgaatcatgcaaatcctgcaggatctttatgttctctgtaccccatccatttctgctgaggattacaaacattcttgcaccaactttcctccagcagtttcgatttctcaataaatctgtttgaggaacatttcaactcttaatatctattttcctactttttttttcttcttaaactcaggcttctttgtaagcatacatatcagtaagtttgataataaaaatgacctttctgccctgcagtataggaaatgctgccttaatgcctctttgctttagaaactcatccttgtatagtatctctccttgcatagccaagttgcctcattgtacgtaaattaaggttatttgcagtgattgaccctaactactatgaagaaaaactttcaatatgttagcaatgatgtctataataactgaagaagggacattccctatttaaggtcaggactgtgcgtttcaaataaagaaatgacagctcaaacatttcattgtacccccacttctaagtgagaagagggcacccttcgtgtctctcttttctgtttttctccctgaaatatcaggagagacatatatctctcttaaacctgatttggttttcgcattacctcacaggtacatattgtcagaactatttgcatacacgagactaaaaaaaatactaaacggattctccagggatccatggataaacttgaggtagtctataagctttgaaatcacaagcaaatatttgtgtccatgtgcctgtgcattttgaaggggggtttgtttatgaactctggctgaattctcaaagaatcctgtaccttcttcctaacgctgagaagtacttgctctaatctcttccccactccctttttgctgtcccctccccattatcttttttctttttgatatggactttaattaaaatgttgatgcttacgtcaccatacattttctgcattaattttgatttttaaaatattgcgttacatgacttaatcttgattactgaaactttttaaaggtaccccttaaattttgctcctggggcaaatgtcttacttgcctcagcctagcctggggcctgagcgggcacctccttcagccttctttcctccaacctctccctgatccaggctgttttccgcaaccccacctgagccattttcccagcctgcaagatgacaattcagtcccctcctcaaagcactgtactgggcctcatagctcctgccagagccgtcatgcaccttccaagaatgcttgctccagcttctgcagctccagggagctgctgaaagtattttggtcttctggagacacgggacaaagtacaactcatctactatccagtccttgtcctacccaaccccccaaaatgcattgagcacttgctctgtaccaggcactgtgcaacatctctatagggatcacctcatttcatgctcacatttgccctaagaggtaagtactattctggactccatcttaccgctggagaaacagattcagacgcgtaactaacccagcgctagtaagtggtgcagccggtgttttaacccaggacaatttgactgcgaaacccaaggtctgatctaaaatgctacatggctctcaccacattgggcttgctacccagaagcaaaaatgagaagaactcttctaagtcacgtttgtgaggctgagcggcaagctctgggtcagttttgctgtcaacaggttttctgctaaaaacccgtttgtagctaaaactagataaaagtcagaaaaatccacaaaatgaagtttataagaaaaaacatcattcgagggaattgactgtgactttggatctgaacatgaacatagagtgttcttgttcttggactttgggctgaaagacatgagtataaccttccgacctccacttggaaacttagtgctgagatacaggctaaccttgaggacagaaataggaaatgttttggaacttccaattccctagtgacaggatttgtttgcagaaagcagctttggtcagatagcacattcaagattacaggcagacccagaggagtgagatgtggagcttgtcagaatgcatccaaggctggcctgggggttttgagcagatttgcagagagcaggccggtggggaagggaaaggaggcagaaaagtctccggaaaagtgcctctgggaagcagcttgaagggctctgaggacacttggttttcttttgaagggcagagtacacagggaagaactctaagtaaaccctgccctcggcaagcagaggtcagaaggtgctctgtgggcaccgagcagtattcgggatctgcagctagaccaggcctgccatgagaagttgagtttatggtttattattcctcattcccttaacatttttacagtgcattttagagtgcaaggggcttttacatccattatttcctttaacccaggggaagttcactgggtaatacagaaagcctggagctggagttttggtcttaggttcattgtgaccttgggaaagtccctcgatttctgaacttcagtttcttctgaaaatacagttgtgccagctttagctccctcgcagaatagatgatggcatgacatggatgcggaagcatctggtaatgttttgaactgcacagagctgagtgtcctgaccatcaaagccagagctggagtaagtgatcagatgtgtcggggaggagaggggtgccaatcacagactgcagagctggctcagatgtggactgcctaggaatggaaatctttggctgtacagtctggcattaaacctggggactgttatgtgccaggcaccgtgtgcaaatcactgcaaaatccccttcagctacatgcatggacatgttaactcttaacacatgtacctaacaattcacaatttcatctcccagaaggtggaagatgcattgaggagcattgctaatttgcactcaaatctgacaaatgaggaattgtctggaaaagtagaaatgatagcagagggtgagaataaaaacatgattttaggattggggaagggaaatgagagacaagaacagatgtgttttcttgacttaagacaaatttttaaaatgtagggaaaagtatttatgatctcatgatctgaatgctgagacacaactcagagtcatttgggctgctcttgaaaatgaaatcctgacttatcaactgcatatgacccttattggaataagaaggaagggagacaactaaagaaactgatgaggcgatattggggatattctctgattagctcaatttttaaatagtttgtgtgtgtgtgtgtctgtgtctgtgtgtgtctgtgtgtgtgtttgtttgttttgaaatagagtctcactctgttgcccaggctggagtgcagtggtgcaatctcggctcactgcaaactccacctcttgggttcaagcaattctcttgcctcagcttcccaagtagctgggattacaggcgcctgccaccatgcccagctaatttttgtatttcagtagagacagtgtttcaccgtgttggccaggctggtctcaaactcctgacctcaagcaatccaccggccttggcctcccaaagtgctgggattacaggtgtgagccaccacacccagcccttaaatagttttttaaatataaaagtaaaacatgcttaatagagaatgagaaataagaaagaaaaaaggaaaaggagacagggaatatcacctacaattttactgagtgtcaattctttgaatatttttacgtttcattgtatttttctatgcattgagattattacatatgtacacatactatttttcaatatgaatacatactcttcatcatgttactggctgcattaattttctatcatagatattgtcagtaactattacttatttccttattgctgttcctagtttttcattattaaaaataacactgcaatagacatctttgtgcatgaaagattcttccacatactaagttatttctttaaggtagattctgagaagttaacatttacagggttcttaaaatatcactaagttgtttgccagagagatgatgccaatttatcttctcactgttttgtgagtaccagtctaatgagctccgatttttaaaaagatgtatataatggatgaaaaagcaacttaatgaaaagaaacatataaaggagagtttctgagctctagaattttaaaacgtaagtgagctgaaaaccatggaatacgcttaagaaaacaataaatgtgggcagcaggataagaataagcatgatgtcagcctgctgatggggttggatggggtaacatcagcaaatggcaaagaaaccaaaactgttcaacttctttctctctcccatgaaggagaatgattgtcagactgaaacaggtagtgcaaacattgacagaagggaattgaagcctgagatgggtgaattgattgtaaaagcaaactaagttctgaataaatgcaaggctcttggcccggacaaatgacatcccagggtcgagaactcagaggggtgaaagataagccactggcagtgatccttcagggttgtgggaaatggaagctgtactaaaagaataggaactgttggtaacctgattttaggaagagaagctggggaaaatgtgggtacgaaataaaacagctaacctgatggaacttccagataaaattcaggacagattttcaaacatacatgttacgagtggaagacattatcactttggagccagccatctgctcctcatcctctctcctcatcttctttaataaggttgctctaagtgttgtagttgctgtatttcaggatatcaggaaggcgtttcgttgaatttctgatgttgctttcatggatgagcttggaaaatgtccaaaaaccagagtatttagatggattgatcattgaacaactcttcccaaaaggagtcaataacttgatcagtatccgtccaaaaggaggtgactggtgtgtcaccagggtactcccatctcagccctatacgatctgcactttgtcagtaacctgtggaggtgacagatgcttagcaaagccacagatgacgtgaaattacagagtatagatgctagaaatcgatggaaatctggagaagactgcagcaggctgggatgatggttaaaaataataagataaaatgtaatatcaattaatatacattcttacagttgggttccaagtgctagctatatatgttcaggtagggtgagattataaaggtgattataacaataacagtacaaaagcaatagctaatgttttttaagtgattgctctatgccagatattggcctgtgtgtttcatatcatcatcatgtgtataattttactctacactagttttatgtcatctgaaaattgtataagtacattatctatgattcaatgatatttaattcacaggatgaaagttgtcctcatttttcagttgacaccagcaagacacagagaggttaagtaacttgtacaaggtcacacagctgggaaatagaggttccatgcttgtgctcagtgcctgcatgctgaactaccgtgaaactttttctttttaaaatttagtcataaatttaatttgatatcctgccaaaacaccaaataagcttagagagttaggtagtttttaacgtgggctcggagccaggtcacctggattcaaatgtcagctcttccatttcctggctgagtgactttgggcaagtcgtttaacttccctgtgttctagttttctcctccataaatggggatcattcctgtcttacaggattgctgcagggattaaatgagttacatatgcaaagcatttagaatgactcctggcacatagcaatcacttgcttacaagtaagtgcattgctgttattaggctacacaaaaagcactatggtggggtgttaagagttgacactgtagagctagaccacctggatctctgtcatggcaccaccacttccatctctgtgtgctacagttttctcatctgtaaaaaaagaataataatcattgcagtgataagattcagtgtaaatgttcagtaattgctagctgttactatcaatagaagtatattgtccagagaaagaaaaatgctagtcctgttcctactgctgcgtttaggaattgaagccacatagatctctggaggaggcaggcaggttggtaagggtctacaaactgcagtggaggagttatctttggaccaattaaggacgtttcatctggaggcaaaatgactaagcaaggacgtgataactgtcctcactgtgttgagggttacaaaattggtgtgggtcattgaatcaagttatgagacaacatgggatgttgggaaaagtcaggggatcaggggcaggttgatcctgagtcagtctcttaacttccaggcttcagcttccatctttcacattttatgattctgtctccagcacgtagaacctagagcaaattcctgtttatacagaaagtttggataaggagtggttttgctgaatggctactgtagcagaaaagcttgaactgagtgttgctcaaatcaataaaatcacctgatgactaagccctgttttctattaaactgaaaagagaatgcaacagacttcactgggcttttgtgagaattacatgaggtaatatgtatgaaagcaccttatcaactctgaagtactaccccgatgcaagcagttatgttgattattgccatagctagattataacttttccaagaattagaatataatgaaacacacttaagcattaatctgtcttctgtgattcagaagatccttcaggaagttacaaaatctcagggtcatggccatgggcatggagtaattctgtagaaaaagatcctggctgtaaggtattctttggttttttggattcaaattaaataggagcatattgactacatgaaaccctgaagggaatagagatcacatactctaagcccgtcattgtacagatgaagtcactgagccacagagaagctgagtggcctgcccagaatcaaatgttaattcatggcagatctgggaataaaatccaggctcctgtctcccaacatgtttgtcatcattagtttaagaacatctcagaaagtctgaaacagggtcaaaatgtactgatgaatgtggctgcccattaaagcatggaattgaagaaatattagaagtaagtttaagggcctgggtgtgtcactgaaggatatgacacaatatactggacctactcgggagaggggagaagtacagtagaatttttagtaactttcttaatcacagcagttcactttctctgtacaaaattcttttcaaatattctctgaaactaattggcattaaaaatgctgatcttagtaaatggccctcaagaggcacgctatgcgcacagggaatagtataatataggtgcagagtaatggtctctctccttctctcctttttttccttttcctaatgatcattaacatctatattctttgactttgttgaattaaagttgcaagagatggccgtaaataaagcaagttatgtatgtgcctccctcattctgcccatgcagcttctgttccatttgcagctgtgagccgtgtaagactctcaagaccaagcacccatgagtgcctgggagcaagtagcctgtgaagggaggactttattcctggatgcattaaaagcagagtcccacctacacctccctcctcttcccatttataaatctacttctccagggatctacagattttttggctatatttttagtctgttgataatttgagaaagtctccaaggatctaagtcttggatgggtaggagtcaattcactcagtcttttttgaatccctaatggatgttcaaaaccagtctcaattctggatctggatgggacatgcatgtcgaagtacagtgtgatggataagagcacagattctggaaccagattgcctgggttcagatctccgcttctgtcattactagggttatgtgaccttgggcaagtcccttaaatgcgttgggcctcagtttcctaatctgaatccctatcatagggttgtgtgagcatgcagttgaatgagctaatatctattcatataaagtgcttagagcagtactaggtgcatagtagtgcttagtaaatgactattaagtaaattaaatcagcctgattagaattgcctccaggtgcaaggctctatcccatttagacacgctaacacacaaggtcttaagggctttaggtttaaggaaaaggggctttttcccccctcaattctacaccacaacctttttattctattgaattacaaaggaaataacagtgggacttgactttgaacaccaaagtttatccagcctctttccagctcggtgaacgtgtccacctacttcactctttatgctaaaggaagagcagcgacgctgataaatgtattgagtggcctcgagcaggtggcttgctctgtcaagatcacttttgtatgactgctgggatcaccacagtctcccctgtaacttgctgggttcctcttgtacataagccgagggcatttgcatcggttcctggtgagggggtttccacacggtggccctggttgcttcaggggctgggctgtgggagacattaatgggaagtgaaaagagaaactgttgtgcttaaccggcagagctgtttggagtgtgactcttcttgtatttagggaaaagattactcatgagtattttcttccatagaatataaagaacctcaaattactacttgcatcccccacccccttctcacccacctccctccgttgcagcgtgtcctctgcagaaacttcagcattttactctcaattcccctcccaagcaggattcagttctgtatttgctttggggcccatgtttccaataagccaccctgtactttttcctgtttctgcctgagcatcttctgctcactggacctctcacctccaggcaccttcctaggcctgaggaaccagaccttcacatgtgtcccctaatgggaactccctgtgtgaaggagaggaaggtccataataacaaatcgcagcgccattcttgttcaaaggtgacaccattgacagtaaggagttaggtttaaggtttttaccagttcaaaaactgagattttgctgagtaaccctcactgccactcccacctccctgtgattctagatacgtgttttcaaggtcattggagagagctggtacttcccatatccatggactgtttttaataggcatcactttctggccagtcaggagtcaaaaacaaaaacttttagtggctgtattttattctaaagatcataaagcagtaatgcaccataaattattatttgaaattctaatttgtttccatgtgaaaaaaaaattatcctaaaaacaccaagaaaaaagctcttaaatgctcatctctaatgatttccagtgcccagtagttctttttttggtgcactacaaaaaaggaattttggttttgaggggacttccacaggtttagaggaagccaactaccattcctcaaaactacactttgcaaaggagccacttggaagacaatcatgcccagaggccctggacattttccagggcatttgagccgtttgttccccacttcagcaggtaggaagagcagccccatatagcaaaccagattgttctttggcatgcctggtttaggatgaaaggtaattttttccaggatcaaactgagggacacttttataacacacttgtgaagtcttcgtagcaagtttaagtaacttatagtgagagacggaagctcctcttagcaacactgatgccattgctctgtttgagctattgattcacaccatgtgattttagagaatgaagatccattgaacatccagcttcttctgacccagcagttcttaaatttggtctcatgtctccttttgattcttaaaaattaatggagaccccaaagagcttttgcttatatgggttatagttatctgtagttaccatattattacataaattaaacctgggtatttacaaaatatttatgaatttagcaagtaaaatagccaactctatattaatgcaaacatattttaaaatatattttcccaaaccaaaaataatttgtgagaagagtagcattgttacacatttttgaaagtctcttaaaatctggcttaatggaagatggctggacgctcatctctgtttctgcattcaatctgttgcaagatcacatcatatgccttctagaacattccacctaagaaagaatgagagcgaaaaaggcaaataattaatattgttatgacaagatgttttacttcataggcaccctacaaaggtctcgggaaccctgatgggtcccaagatcacattttgagaaccactgttctaacttatcaaagatttctcacaacagcaaaataaaataaaactatagacttacagtcaggctcccagagagccaacctgagccaacctctcagcccctgctctgtacccccctcctgcccacttggttcctactcagagttcaagtaccaccccaccaggaagctctaatgtcagtgagtagaataaaaaggcagaagaccttttatccttactttgccctcttattgccagaggccagcctgatggtttcccagaggctgagtgaattgctcttcctggaagaagtttcagggaacatttcattatttggcagctctggaaggtcaagctcagctctggaacattctttcttcagaaggacgctgggctgcaatcagatcagctctgaatctgaggaccctccaaccacactgacacgtgtcatagttctgagcccctgtgggtgctgtgggcaccctggaacagcccctggaactgggcaaggaagggcaggtctctaagacctaccatcccttaaacacataaaagatctttttctcattttgcctctaaataaaaagttaatctgacagcacaccccagagtagggtttggtgtacaaactgctccctggactcctcttggaggctgcttctgggcttcgagaagcccccagtggggcggctcaaacaagggctggagaggggactcagagttgaacataagggctcttgagatgtggagactcattttgttaactattcagagaccttctccctttattccagctgtctaactgacaagacctttctctctttctttctgcctcatgctctctccaacaggcttgcagccaatttactggagcagggatgacgtagcccagtggctcaagtgggctgaaaatgagttttctttaaggccaattgacagcaacacgtttgaaatgaatggcaaagctctcctgctgctgaccaaagaggactttcgctatcgatctcctcattcaggtgagagtctggactcttggcatatgcccaacttggaaagtctcttagttagtggttggtctttaacacccctcacccggcccaagaaatcccaacagtgagtcatcacaaggaagggatgacgatggaaggaagttgaaggaagattatgctagcatgagccagtttgagggaagaagaggaagtgtttacagaccaagggggagaattttaagtttaggagaggaacccagtttagtcctacgtacactggaacttaagggctctaactgtgccactaagaagaaaaagaaggctggccgtggtggctcactcctataatcccagcactttgggaggccaaggagggtgaattgcttgagcccaggagtttgagaccagcctgggcaatgtggcaaaacctcaactctacagaaattttaaaaattagctgagtgtggtggtgtacacctgtagtcccagctactcaagaggctgaggtgggaggattgcttgagccaaagaggtggaggctgcagtgagctgagattgcaccactgcactccagcccaggtgacagagcgagaacctgtctcagaaaaagaaaaaaatgccattttggccttttgactctctaaaagagatagctgagagtgaatgcaggctgtgaactgctcaaccgaaaacaaagagaggaaggagaaggacgtagaagggctagaaaagaaaatagaactgggggaactgcagataaagactgggaaatgggagatcctagtagccaaggccagtttagaaaggcttcaagtggtttcccttagaagtaggactcgtttgaggtaatgcatcttgtagcctgtagaaatcctaaaaaatacaagcagaggtctcctcgggctcatctgactcagaaagcttgtctaattaagggctcctgataatgcattagaagatttccattcagtaacaagcatctctacctgcagagtgtattgctcatgtggataaggcttcaaagatttgtctcagtttcatttcctaaaccctgtggatatttagaaggtacctgtctgggaactacatatgtcaaaggggaactgtggtctcaggtttatgcctcttgcgggattaattactgaagtactcaaggccctccttttactgaatcccactgcagacctcgactctgatgtaacttgacaaagggcgaggatcctgcagaaggtcttggcatagtccctaactacgttcaacctttatttactcctggagacctgccagaagttaataaactaaccgtcatgaggaaacgtccctcattacaggagatgagataaagccccagcacccgtatctccactgttcttcccagttgccacagaccgtttatatgaagaaatgctaaagaagttccccagaagtagagatgttattgaaacttgaaagtttatatcttcaaaattgagtaatttggaagggacacaaacatacctgaaacattttgtctcatatcatcaattctgtatgtaatctcacaataagaaaactataaaacaaccatgtaaataaatcagactatcctaaatagttcttttgaatttattacaaaatacttcccttttctattccagtggaaactcagagatattatactcaaagaggcaacgttatatatctggaggaaaaatccctacctctttgtgttccaatgaaaccattcatgtaaagcaagcaaaggaaaatacagtggtgggttttgacttgatttgacttggaccttgggcaagctttcctcccaagtctctataaatttccccttcatcctatctcaggtgcacttttttatagctggtttattttcctccacagtgacctcttagcattatttgtgaaactgggttctctctgctcagagctatgaacaaagatacgtgaaaatctgtccgcagttccttgccactttgtcgagtctttgtcaggtgggccatgtggaagatggtgctgctctcaaggaagttactgtccagttagaggcaggattgcgttgatctaaaaggccaaagaaggctggaggagggagagagcagagtagcactggtgtcgggagagaaggaatggagttggtttggaccatgaagaatgggtgggattgagtaggcagagggtaattggaacagcatcaccaagtatatttgggtgatggtgagaatgcccacctgatgagtagaagaggcagaaaaggcaggaagccctgataagcctgatgcactagaatggatgtgaggtgctatatagatcagttaggaggtggcaatagaaattcattccatgagtattcaccaagcaactctatgccagaggtacacaggtacaggctaagggagttcagagattagaggggccatttctagctggcttgtcgaacaaacctcatagacaaggtaatggagcctgactttgaaaactttgaaaggcaaacaagaaggagatgaggaagcatgttaagaaggagatgtaggccgggcgcggtggctcacgcctgtaatcccagcactttgggaggccgaggcgggcggatcacgaggtcaggagatcgagaccatcccggctaaaacggtgaaaccccgtctctcctaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaagaagaagaaggagatgtaggctggtgtacatggaagaggaattcagagacaagactgcacgtgctagacactccctttgaaacatggtcgaacatcactcaccatgcctctccggcttgtctgattgcctcctcacatttcaaactggtggactgtctcctggaaggcttctcttgactcccatccctacttccctaattccattccactttcctttctcccatcttgttctacctccatctaggctaggtgctgtttctcctttatcttagagcattctttccctctgtcatggcccttgacacagatacacacacacacacacacacacacacacacacagtgttatacattgtttgctgattgtttgctactccggatccctcccctagagtggaaagttcaatgtgggcagtgattgtgttctattaagtcgccaagtctccagtacctaacaccagggcatggcttccaggtggcactcaacaaatgtaggttgaatgatgacccggtttgagagtacccaggttaagaagtttgggttttattttacaggtaattggaaccactggaaagttttgatcagggaaatatgattggagctctctttttgcaacagacattttccaccagtgcgtagggtagattcattggcttacttaaagcaggaaagctagttagagtgtccttgctgtgatcctaatgggaggcagtgaagcccagactggatcagtgagatcaaaataatactcaggcacaaagtggctagctaagatggggagctgacttggaagtagtggttagagttcatttttaaagcaagcaatgccaggacattcaagaaaacttgtcctgatctgcagttggacatctaaaacaagaggcaggccagggctgggaataatagatgtgagcatcatacatcgtctccattatgtagaattttatgagctggggataaagataaatttatacggaaggtaatttaattaaggcacccactagaaagccatggacagaatttcaaggcgatgcctgccagcagggcctgtaggaaaacttaccacagaacacaggagtattgcgaatgggtttataagacaactaagttggagttgagaagacccatctgatgaaggggtcactcagcaagagggggaaggccacaggcatcctccttaggcaggggcaagatctagattgaaaatcctttttattttccagatgtaacatttgccactgtttcttctgacatgggctttctcctttagcagtttggtgtagtgaaagtcctcaggcctggcttctttctacacctggcccttcacaaatcacgtcacttcacttggccttattttcctcatccacaaaatgcagttctcaccacatggatcctaagctcccttccattcttaacagttcagcccaacttcaacactgaaacagtgttaagttgctagcaaacaatgtagctttctatgctctctatatatggaaacaacattctttaacacaactcctctccaatgtagagaggagagcactggactcaatgagttataattacctggaatacgattataccttaagtcaaatacagtagactccctgaatgccatattctttgaccagcttaacaaatttatcgcatctacttccaggacaagaatcctccattttcaacccctaggataaagcagggaacatttgcagtgtgctttaaataattatatggtctctaaccagaagatttcaaggttggagacaaatggaatattttctttggaatagtctcccagttggaggatataacagatgacaagtttataacatttgtaaagttaaagaataaatggaagggatcccaattttataaaacgtcacctggacagaataattttacaaagaccttgggctactagatagttatcacattaactggttctgaagtgatttaaattcagagaggtatttgagtacttgactactttgagactctgagaaaacacattgacaggagggaacagacaggttggcatttatattaacccttacttagggttatccattgcatgacattcaggtggaatggatttaggtacccattattttctccgaacaaggaaacccacaagttattatcaatttaattcatgttacactcacttgctatcaatgctaaaaaagggaaagaaacatatgttcagagttccttcaattcagcaaaactgtattggggatttgctaaatatattgaggattttagtagactaaaatctgcagtcttttcatatactagagtgtgattttgcaaattgtttcttccctttccaacccaccagaacctttgtctttggaaatatgctttgcttatatttttcaaatatagtaaaattttctttcaaagttaaactgaaaatactggtctttacatagtatttcttgaatcaaaattggcctattaatttctattaagcaatggtaggtttgccagattgaagggctgtgtcaactggctattttagaattaagtcagagcatccaaggatataggtcacagaagggaaattgtagccatgaaatgtgggagttgtagcaggcatgacccttgtctgaagacaccagagttggctctttctttactgtgtctttgagcaagccaaaaaaaaaaaaaaagtgtatcacacatcagagaaatgcttcgataggtcacttacgtgaaagtcattttatttcttttcttttttttttttagatggattctcgctctgtcgccaggctggagtgcagtgccgtgatctcggctcactgcaacctccgcctccagggttcaagcaattctcctgcctcagcctcctgagtagctgggactacaggcgtgcgccacaacacccagctaatttttgtattttagtagagatgaggtttcaccgtgttggccaggatgatctcaatctcttgacctcatgatctacccactttggcctcccaaagtgctaggattacaggcgtgagctactgcacccggccatcattttatttcttagctctttgcctgtcccatttgtgaaatggaggtgggcacccaccctgttgtcatatacttgaaaaatgcaagttttagcaatgttaaggttctactttaaacttactaaacttaagaagttaaaagttggagagacctaggtagccttgcagatgacgctaaacattggttatacaagttgatgtgatggtaacgtagggaaaaccaactgcacagtgcttcctttaaacacatacttatttcataaagttctgttttctcgagagcttattttgtttatctcaccttatagtccatatccagctgtaattgtcttactgtatctgttttctaacagatttattcttgtcttaaatatgatacttaaattttcccacaacctgttccttttttctcagggtctctgtgtataagacataaatattaaaccaaatttcaaatatttgttgctaagtaaaagactaatttatttttgtggtcacagaaggcactccagattaaattaaaaggttaattcaattggcctgcaaaaatgcactgaatggaatgcttagaaactaggaccaggctgggtgcagtggctcacacctgtaatcccagcacttaaggaggccaaggcgggcagatcacggggtcaggagatcaagaccatcctggctaatatggtgaaacctcatctctaccaaaaatgcaaaaaatcagccgggcgtggtggcacgcacctgtattcccagctactcaggaggctgaggcaggagaatcgcttgaacccaggaggcggaggttgcagtgagccgagatcacgccattgctctccagcctgggcaacagagtgagactccgtctcaaaaaaaaaaaaaagaaaaaagaaactaggaccaagcagagttagaaaaccaagcagtcccattacaggaatgggcatgttatgcactggtgttttcactgttgaatttattatgtaacttaagggaccgaagcttagggcttcatcctgaacccatcaaaggcagaaagggcccaacagagagaacattctgacatatctaaaaagtacctctcccacaccaggcatactcttactttaaaaaaaaaaaaatggccagagggaatctgaagcctctgaataaaaatcaaagagaagagagagctgtttgcaaattaaagaatgtgttacttagataatctacgtgtaaggatatgtacatagcaaatcatcacctgaaaaatgcagattttaacaatgttagggttctactttaaacctgctaaacttgagaagttaaaagttgcaaaaccccctgggagaggctctaggtagcattgcagatgatgcgaaacattgattccagccttctgagaacaagtagcgtataataagaacgtttaaactaatcatacactttcactgataattctattcctaagcaaatagccgaaggaaaccatccaagagtgggcaaaaaaaaaaagatgcccttaacaattctatttatagtagttaaaaactggaaattccccaaccacccccactgtgggactagctaaacaaacttggggagagtaaatatcatgggatacacggtagcctcacagccattcattcactcactcactgattattttttcagtagattttgcagggctctgcaggtcatgttcaggattttacatgtttgtttgaagacaagtagaagccatttgttttttgttgtttgtttgtttttgtttgttttgttttgttttgagatggagtctcgctctgtcgcccaggctggagtgcagtggcacgatcttggctcactgcaaggtccaccttccgggttcacgccattctcctgcctcagcctcccgagtagctgggactacaggcagaggatcggcatggcaaggtgcggcggtgaaaagtggaggcggggcatctgttgggctgcagtctacgagcaatagttgtgacattaactaaggtgaggcccactgagagacgaggtggttccagaaacagataaaaggcagagtctgcaggtcttggtgaccactttcatgtgagatgagaaggaagagaggccttaacgattactcccaggtttctggtctgatcatctgagcatttgctgacctaagaaacaccatctcatctgtagagatgtttgtgttaggcacatcaaatgtgtggtgcctatatgacctccaggaggaattacttaggagatcacggaatgtggttctggagttcagaagaagtgccaggctggagtagatttagcatagacgagccgattgaagccatgggagtagatgaggttgcccaagaagaagggcaggtgagagacctggggaaccttactactgaagggctggagaaggaggaagagcagagaagtaggcggaaaaccaggataagtggaaatctctgaagccatggagtattctaagagaagggaagtagagattgctggtgagaatgttgttgagaagtcaggcagttccctgagtaccaaccattgccctttggatttgacaacagggaggtgacctgagcaaaagcagattggagaagggtgggagtgggaaccagaatggaaggtgaggaagtggtgagaatggtgttggacagctcccctgggaagtttggctataaagggaggagagaaacaggagcagttcctaacagggaggatggggacaaggggcatgtacatgtggacaggaaaaaaacttgaaactgcttaaaagctaaagggaagaaacccaatagaagaagttggcaatacgactgcaaatggggacagtaagagctaactgtaaactggaaatgtctgtatgaaatgatgtcaactggggaaaaaaattccatccatatgaatgtgactttgtaaaacttacgcatgtgctttaaatacaaaagtactgaaacaaagaacattttttgccagattttgtgagacatgtctgttcacgcttatgacaattgcaagagacaccatccattgagcgtttatgatggcagacgtggggctggtgctctgcacgtatcatctcatttaatccttataacagccctgccaagtctgtggcatagttctcattttacacacaaaaatattgaactaagccctgaactatggctcggagaagaaaaatagcttccctaagggcatacagctgacaaagagaggaacaagattcaaacttgggactcccttgctccagagcccaaattctttcctctaaaattaagtaacttaaataaatttaacccccctcaacagcatcttgcatgttcttggtcctcagacattagtaagattgatcagccaagtcacagcagtattgttcactcgctctctcctgtccatttggaacacattacaatacaataatggaatttaggattctcaaagaacgtgcctggcttttcatgtaaagatcaccaatgcaaaactgtgttttgtttctgtgtgtgcgtgtgtgtgcgcacgcgcgtgtgcatgcacccaggagtatatctagattttatgggcctgaggcttacggtttgggcaatatgaatctttctagaactcttcccagggacctgcgcaagtgaagggccccgaagctcactagcttcatggtacatcagcctctgcacatgcgtgtgtttacatgaactgtgtatgtatgcgtgaagatagatggaggaaccaacgaaaaccatggttctttgaccagtagggctcagttccattgaatagtacaatagaaatactagttagtaccagtcactgtgtttcttttctgggaagagagagaagatttattaaaaatcaaatgggttaagaattttctgaaaaatgccctttgaatttcagccattagctaagttagatatacagtgctgtggcgcatgctctttattttcagtaggcaaataaatataacatttttaaatatattctttatcccagagactgttttggcgttgtttgtttgtttgtttgtttgaaacaaggtctcactctcatgcaggctggagtgcagtgatgtgatcacagctcactgcagcctcgacctcctgggctcaagcaatcctcccagctcagcctcccgagtagccgggacaatgggcacgcatcaccacgcccaactaatttttgttttttttgtagagatggggatctcactatattacccaggctggtctcaaactcctgggctcaagtgatcctcctgcctctgcctcccaaagtgctgggattataggtgtgacgcacagcacctagccagattcttttgttagtaacaccttttagatgtgatctcctccatatatgaaaattggaagaatacatcaagagagcaggctgggtgtcgaggaatgaagggacactggaaatgaaagaagatggagggctgtcttcatttacttagcaacctgctatagacaagacacatattctgtgttacttcacaagccaaaactaagaaccaaagtacagggattgcaggggaagccagattccacctcagcagagaaactttctatcaactagagctgtccaaaaatggtttgcttgcgccgtgactggctacccatcactggaagtacccagccaaagccacttctttctgggagaaggggaggtgggagactcttagtgagcaaagtttgagtcaatctaggaaacctctagaatcctgtctagatctaatattccaagttattactgggacacactatcgctgccaatcatatgctcacagtgcacgcacagcaagtggtccccgtccgcatggtggtgatgtgtttttgctgagccagccgcattccctgacggagcccctagttgctgaggaaacatgtctgtgcatggactgactcagctaaggccacactcctgggtcttagaactaagttttttcgtgacccagtacccaggacctcgggtccatgttcccacccgtagccgcctcatggatagcatttaagataactcccaataccttattagtctcctaataggcttctggtctaggtaggaaactggccgagtccacttgacccgcccctccccctgcttcctcctgcacactcgggaagaacccctctgaccctgctcccttggccagcgtcagtatgggaggctgaagcaagcccatgcagaagcctgggaggtgtgcggcagaccacgtgtcagacccccagaggcttagcccaccaggtcaggatgagacgtccagagaacccaagactaggagagtggcctcagttaaccttctttaccctttctggaaggggaacgtaaagctggccgtgacccagatattcctctattctccatgtgagacctccttagagatctacacacctgtcccaagccactataataatatcaggaatagtaatgatgggagtgtttgtggtggtggtggtagtggtggtggtagtaaaatcaatgactagtgtttactgagcttttcctgtttgcctcacgccatgatgagcttgttacatagaccatcttattgaatcgttacaacgatctcacaaggtagatgccatcaacactgccattttatagatgaggaaactgaggccaagtgacattaaagggcatgcccgaggaggcaccagtctgactccagagcatggcctcttcaccatgctgctgtctttcctcagtttctctctcatgaaaacacagaaggaaaagtcacctgcctgctctccagcccttgtttgagccaccccaccgggggcttctccaagcccagaagcagccaccaagaggggtccagggagcagtgtgtgcaccaaaccctactctgggtgcttcttgacctttccctcctttaaccctcatagcaaatgctggaggtcggtgttattatttgcattttacagagaagttcagggacttgttcaaggtcacctggtgcacaggagttgggactcccaccgaggcagccgtgcccacctctgcagtcagcacctcccaccaccacaccagcccgcctggttaagtgaaccaagctgaacaccctcacagacactaaatttatatttcctggcctccccttccaaaatggatacactaattactggacctttttttttttagtaatagtaatcatcaggaacacatttttcaatgttttcatttttctattccgcatactaccaaaaaaaccagataaaacccagcaagtgtgaggccctgtaaattagcaaaagttcaggaagtcattacacgaaaccaaaagaaacaaagtgttgattaggggcttatttttgtatgagattaaaatatgaatcattaaaataggactgtatttcaggcttcttatccccgcctcatcagagacatcaccatgactactaggtttggattcaatgaattccgaagccgttctcagctctcaaatgcagtcatgtgtgccatggttctgccttatacatagcagtttcaaaagtctggtccaggacacctctgcatcttcctgcccatctccttttaataaaatgcccaagtgacatggtgtctgcagctctttgaggtattttgctttatttagtcatgatactaagtagtggcagaaagttatactaacagcaaccaaatttcaaaggtagaggtaggaacaaagtcaaggcaaaaacacaaggttccctcaggaatcccttagaatagggtatccgtggagttttatttagtgtcagtgatagaggagcaggagtttgtagaaaaaaagaaattaatatggaacgtttctcaggtccatgctgagcttgaaagaaaaaataatacagcaatatcttcaatccaaaatatgccttgaatttaagttggtaattaaaatgtttgtttaaaaaaagtcgctaaaattagagacaaagacccattgtttgttattactgctgactgcatatctgtgtgtggagaagggtgtgaggagacagtcacaggcctgtgatattgtaaagatttatcacccacccccaaagggttttgaggcacccacctgcattttcagcttggatctaagtcaaggggtgggacaagaccatgacaggttttggggtttgtttattttttgctaattactcgtggacacttcaaataccaaatatatcagaacagaaaggcacctgctcaacccagcccctgccatcctctggcaatggcctgacatctctagatgattttctagagattgtggaaccttggagcaatgcctgtgtgcatttttaaaggagggaagcatcccagaacatgccagttccttatagagtatcttgaatagttaccacctctaaccggacttgtgaatttttttcatgtttattcttttcccgtctaggattgagattggttaaaaaggcatatttttctctgtagggaaaatttctgtgaagaatctatgagttgtcattggagcattacaaatgttcttaatgacttcataattcttcgagtaatctgaagtgcaagctaagatagatgtaaaaagaacatcctcacaaaaaataagagcaataaattgggatagtttaaattccctgccattgttcggcagctactgaagcagttcagtaatgtgggaaaatgttcaaaacctaatgtggagggaaaagaggatactcaactattaaaagcccgcttctaactatagaactatagatagtattaacagggcttctgtatcttagtgatgatgggattctaggtcatgttttgttttctttctgattttctgcctttttaaaacatttttggggccgtgcacggtagcttacacctgtaatcccagcactttgggaggcctaggcgagtggatcacttgagctcaggagtttgagaccaacctgaacagcatggtgaaaccctgtctctactgaaaatacaaaaatcagctgggtgtgttggttcgcacctgtagtcccagctacttggagggctgaggtgggaggatcacttgagcctgggaggtggaggttgtagtgagccgagatcgtgcctctgcacttcagcactggcaacggagcgcaaccctgtctcagaaaaaaagtatacgattttcataatcaaaaaagtttgatttacaacttcacatcgctctgaccttttgagtttcaagtgctgcattctgtgccccatgagcttggtgagggtaggaggtggcaggtgcgctccaattgtatctttggcaccgtgccaggcacttagctgctgctccgtagatcgttgttggaaaaacatctttccatttctcgatttccctttcctttttctttccaggtgatgtgctctatgaactccttcagcatattctgaagcagaggaaacctcggattcttttttcaccattcttccaccctggaaactctatacacacacagccggaggtcatactgcatcagaaccatgaagaaggtactggaagaggtttctcttttcttgcctgaggtttagacaaatccaggaagtttaattgttaacttgataagctggtcttcttcgtgtaagttcacttttcattcagtagacaattattgagtgcttactatgtacaaaatacactcttggttccctgaagctcacgatcaaagcgaagcagtgagatggatgtacacagaagcacagaagcgtaaccatatagtaggcaccgtaaaggtgtggtggaagggtccatgacagccaggtgcaggaagcagggtcttctcataaaggaagcaactctggagtatgccttagagcagtgctccccaccctttttggcaccagggaccagttttgtggaagacagtttttccaccaacagtggaggtgagggatggtttgggatgattcaagtgcattacatttattctgcacttcatttctattattacattatcatacataatgaaataattatacaatccaccataatgtcgaatcagtgggagccctgagcttgttttcctgcaactagacgttcccatctgggggtgatgggagacagtgacagatcatcagccattagattcccgtaaggagtgtgcaactagatcccgcgcatgcacagttcatgatagcgtttgtgcttctatgagaatctaatgccgctgctgatctgacaggacgtgggactcaggcggtaatacgagcagtggggagcagctctagatacagatgaagcttcactcacttgcccccaccgctcacctcctgctgtgcagcccagttcctaacaggccatggactggtaccagtcagtgacctggaggttggggaccccgccttagaaatccagcaggattctgataagcaaggatgaagtgaagaacattccaggcaaagaaaatgacgtaagggtggggtaaggctttgaaatagagagcaattagatgacttggattataaagcttatcttctcccactcttttattacagaaaatttcaaacatactccaaatagaataaaataaataaacccttctgagccatcacccttgccttcacaatgatcagcattttgtcattgcagagctagtccaaggagcttagcttggaaccagagtgtggagaactttgatttctggaatatggaggaaagaaatgggaagtcattggagagttttttagcaaggggtaataaaagttggaagaaggaaagaaaaaaaaacccaaatctatgaactcagtgttgggccagggctttctgcatagggcaccaaaggaggctggttagagttcactcagtggcggtgtttatttcaagtgtcccagttgttcctcttaatcattggtagaaagcaaaagaccagaatttaatttaggccctggacctagttccagaataggtgttggggcacagaaatagagtataaaaaccttacttgaggccaggcgcggtggctcacgcctgtaatcccagcactttgagaggccgaggcgggcggatcacgaggtcaggagatcaagaccgtcctggctaacatggtgaaaccccgtctctactaaaaatacaaaaaaaaaaaaaaaaattagccgggcatggtggcaggcgcctgtagtcccagctacttgggaggctgaggcaagataatggagtgaacccgggaggtggagattgcagtgagctgagattgcgccactgcactccagcctgggcgacagagcgagactctgtctcaaaaacaccaaaccaaagcgaaaggaaaccttacttgagcaccattgcattaaacagttgaacagcttgagcactcagtgatggatcgtgcctctgagggtcatgatcctcctgctcggattggtcagaccacagacgtccaaacgtgcatcagtttcttcatgtgtacttttccttaggtgcagattactagggacctcaaaccctggtcccttggggcatttccttaaaatgattgctcatccccaagagcagggctaacaattttgttttgttgttggcaaaccaaaaaatgagaagtttcttgtttttcctaattaacacttcacaaaagagagcctgactccaggcgatgacaccacctccttgtgccaagcatttcacagcagggcccctcgcttccgtgatggagaacgaacagcatttcgtgcacgctccctgccttcctctcatcctttcctcccctcactctacccttgctaaatttagcagctgccctcctcccccaattcagttattcattcttttgctcttcctgccatgtgcatttccggcttgcataatagccaccagccactccagagaagaggaggtgggtttactgaagcttgacattaaggcaaggaatatattacctagcctgcctttcagatacaaagggtatgtgatgggttttctttctgtctcttagtctttctctcattattttttttgttaatctcatttggaatttagccccattttattcctgagtgtgattggaggcttatggtctctcctcctcacagatccttcctcttttccctttggcctgatttgactcagcagtaggtgtgtttgttgttctcatttgcaggagctcagcaatagagaaagctggcttactctgagagctgctcgcaaaccaagtaaatacagatgtgccaccgcatacgctgtaatgagctttctctcaagtattatgatgttggtggttgtgagctcagtaggtaagaggatggagctaatgaggccgaggtcaagggtgtcattgccctgcagaccagttagctctgcttcagacccagctcttaaaagtagtgcattttcagagaccattccttaaagctcatggccaggaagcaaggtctgagagcatgtccgggcgcatgtgctccagtgaacaggtgcacacaacaaggagagaagtgtaggtctttatccggtggtatccagggagaagagctttccaaggcacagaagtgatatgaagaggtggccctctccctatcctcctgcctttcagctatatggtgcccttgatgacaaagagaacaagtagagaggtgcatggatcagtacaagtttcctgcctccagctacttcctctctctctcccttcttctccactgaaaagaaaaaaatccagctcaacataaattgtttccagaatcaatactgttccatttaattatgaaggataacagatgattgatgtgggcatatgttaacatacagaaagatctggttctgaaaaaaaaatctgtcaagtgaaattatacatatcaaatattacttccccagtgatttattttacataactgggaatacagttccatataaaagtatgttaacccaagatgacacatgttgctgccaacttggcataggtaagtaggtaggtgggtaggtaagtaggtggataggtggataggaatgacagaatggaaagagaacaaggcccaactcagctgttaagcagcctggcacaatgaagcatgcacggtcaagtgcaaacagaaggcatcattcaaccgccttgtgatttcacctcgtcgtggccacaaacttaaccagttcagacattcataatttcacaatgggcatttatatcacagtacaaatgtgtcttgctcaatctagcaccagttccccacatgtatcctctatgactttcttacattgaaacttacattgaaatcatgccttcgttagtagccacgtggcagtgctagaagctaggaagttggtgttagctcagaggttcacctccatgccctgacagtagacgaggatgatcatcatgctaattcaaactctctatatgtgaacatttgttacctctataatgtactccattctgaaatcacatcatggcttgagcaaagcagtcctcagattacacttacctctagaaaaaccagcattttcactctttttccttacttattagttatgggaagggagggtgattttatataattaggttaaccttataatttttcacccataccaacacacttatgacagtgacacagggctccagcaataagtaagccaggactacatatcaaatattcaggcaaaaccagaaccagaaccatcctcgacaaacaaactggggtgagtgtgtgtgagtatgtatgtatattttaaaggatgagatctggaaaccgggaaaccaggtcctaacccttcattctgccagaacagatcataagggctaagtttctcattcctctggctctgtctccccagttataagaagggggttaggctaaatggtttctgcagtctcttacagctctcaaatccccacattacgtccaaggaacctgagtcttcctgggtgatatgaagataagacatattcccttccctcagggtcttgagcatctaaaatctagaaaatcatagcagtgtcctgcctggtgttgctcagaagcgggagaaaatctcttctttcctcatttgtctcaccttattcagaacttcagataatgttgcccctctgagagtggcagcaagagtagcgtcattcacttatttcatcataaaaagctcagtttaaggacattctttttccttgactgttgtgactcattttatctttgtaatatgaattagaatgcaggtaggtagttatgtagaaaggaggtaaaataaacaatgatattacttccttcacaaaaaccaggaggcaaagcatctttagaaatatcaaagcagtaaatgactataaaataaatttattttgtcacgtgcagttgtgatgataacttcttttcacaccttaggttcttttattttgggttttatccccttaaatatatatatatatttttttttaattgtcatttgtcctctagtgttagaactactggaatattggccccccaaaaactcaacggaaacataaaataagcctcccttctgggctaaagtctctgaatgagaccagctccacagaatcaccccatgggactggatatgcagtctgtagggagaaggagcaagatccggatttctcaaacgttctcatcccatcacccccttggagcttgataatttcagctctttagttgcatcctgtcctctgccccatcaaagagattatggggcagtgattcttaatcactttaatttgcagatattcacacatgcagggctgagattgtttctgtagcactggatgcagttttaaggtggcagttctgctctgggacagctctttatcacaaggtaaacatggaaatcgcaagtgatgaggagaactttcaagcatcgaagtgcaattgatctcaatttttcttacaactagcacatgggaatggctcaataattgagagaagtcatttctttgtgaaagatggagagggtggcatgtgttctgcgatggcccacagaagttttatttatatgattgctttattgaggggaatcgtacccctcctgccccaccaccaaacccaagtgcccaaagactgctttggcagaaggaagttgtatacaattttaatgagataattaaagaagatgaggtatatgaatctggttttttttttttttttttttttttttttttttttttttttgagaaggagtcttgctctgtcgcccaggctggagtgcagtggtgcgatctcggttcactgcaagctccacctcctgggttcactccattctcctgcctcagcctcccaagtagcagggactacaggcatccgccaccatgcccggctaattttttgtatttttagtagagacagggtttcgccgtgttagccaggatggtctcgatctcctgacctcgtgatccgcccgcctcggcctcccaaagtgctgggattacaagcatgagccaccacacccggcctgaatctgcttcttaataacaaaataatagctaacatttattgggtccttgttgtgtgccggccctgttctaagctcttatatctttgaatcatttaatcctcaccacaaccctataaagaaggtgatattattacctccactttatagatgaagaaataaagattaagagcaataaagtaacatgccccaaaatcaagtagcaacgctgagatttaaacccaggtggggttgatgccagtgcctgcattcattccactgcgcagaatgaggagaccaaaatacattttcataaatatttgtagtgtaggcgccctgaaaatagagcacatgattgaaagacgagtagcagtagtggagatgagaacgccaaagcagttttcaggtcagctgactggggctacagtgtgtggcaggtcctgcttacattactgccaaatttgtactaaacaatgtcaaagatgacttctgggactccaaagtatgtctagttcataatattaaaaactcatgctgagttggaccgaattcacccttctagatcattaactcccttgggatgggccgtcttagcatcacgaaaatctcccagcctgtgagaactgtgggttctgagccaggcaccggcttctgagagcagacacactggctgtcacctaccccctgaggagccagcccctcagtgcaggtcacgccttgaaagctggcccctctctacagcggcttagtaggtaacaggtagacgcattctttagctgctcaagtcacatcctgtcactggttgtaaacccactcgattctctagtcttgctggaatcgtgttgatgactgcagggtcaaggaggctgtgggctggggtttgacatctttgttacacatattaaccacggaatacatgacagagccagagagcatgccggcacgtatatgcgtgcactctacatcccccgactacctgggttctaatcccagctccccagtttaccggctgtgtgacttcaggcaactgccttgggtctcaggtctctacctgtaaaagaaggaaaatgacaggacctatctcaaagggttgacataagaaagaaatgagtctccagcctgggcgacagagtgagactctgtctcaaaaaaaaaaacaaaacaaaagaagaaagaaatgagttaatacggaaaatgcccttagaatagccaagcattcggtaaatgttattcattatcatgattcaatatttctggctgttatttggttgtttccccccctctgtttgtgtaaatttttaattgggataaaatacacaacatttacaattttaaccatttttaggtgtacttcagtagtggtaagtctattcacaatgttgtgcagttggtttttccttccacttttcttaaccattctcaatatcgcaactacatccactttgtgcaaacatcaggtttgtgcaccttatacgtagggaagggccattgcctccctcactgttatccaagaacacctttgaggattcatctgcactatgatttctgtgggaaaatacatttaaagtgccagtcttcattactctcagaacacggcctgtttggaagtaagcactgcttgcattttatgtccccttgcagtatctggcgagcgctgggtcctccatgacccctttggaacctttgtattaatcttctggctgtctcctttaagaactacaagattaacctttttgcagccctttctgttctgggattcttgaatctggcagcaggtaacgacaggtcccatcagaaacaggtcaagatcttgacttcctgccctccctgggagcagggcccacgagcaccacttaacacctttttcccctgacccagcctcattccagccttctgcaagtcctgctttcctctccaggacctttgttcctgctttgcttcctatatttcagggcctagggcagcatgaccttttaccttctgacccttgcccctgctgcagcatgtgttttgtgacggagtgtagggactggattgtgcagagaccctctttgcatctgtctgggccctcggcctattacaggagggacccctcacccttcctgcctgcaccagggtcctccaactggaggctgcttttagccctagggctagcgtgctctcttaagccagaagttttaggggcaagagatccctaatatgcatgaatgactctcacaagacaggcaggaagtctccaagagacttcctttacccctagggaaatgccatctgatctttgagataaggggctgggagcagtttgatttcatctccagagaaggaagccctcagttaaggggtcatcttgctcttttccccactccagggcctctctgccttatctctgtgccacctgtgaccccaggccttatacatgattgagaggattacccaaacagacctaattgacttattggaaatccaatcctttgattttttaattcacttcttttgtgctgctttatggagacaaaggagactcccctatactgcctgtgaagagcaagacagtctgcagccccgactgtgaggactgtgaggcctcctgtgtcagcagatgtgcatgtactctctgtactgatcccctggaaaggtggcctgtttgaaagcagtcctgcccaggcctgcagtaatgaagattaagcctcagagtactacaggttacccattttgttttgtttagcccctttcatcaaatgcttataaaattctaggagcttacctagggtttattgttgataacctcaaacatatgtgaatcatccactccaaactagggcagttttcttctcaggccctccaagggagttcggtgacattggcacattgtggggatgaataggctgaaatgccaggtacacagttagtggaaagactccaaaccaagcaaaggttgaacgtcaggtaactggagtagggggtgtattagttagctagggccgctgtaacaaagtaccccaaacggggtggcttaaacaacagatatttattatctcacttttctgggggctagaagtccaaggtcaacgtgtgccagagttggttccttctgagagagctgtgaggtaggatctgttccatgactctcttctcgtttctggtggtttgctggcaagctttggcattccttgccttggaggtctctgccttcatcttcacctgcattcttcccctgtgtatgtctggaagtccagagtatactttttataaagacaccagtcatattggatgtttaaaatgacctcatcctaactaattacatctgcaaggaccgtctttccaaataagatcacatcctgagggtactaggggttaggacttcaacttatgaattttgggggagagatagtcaacccataatgggcataagagaccgggagtggtatatgaaatatagtttgaattccacctcaagaccttgagcttatgacttctgtctagctctgtgtatcattcatacttcccactaatttttaacaaaatgactgggagagggagaaagtgaaacccagtggactgaggcttgagtgagcattacctcctgggcctgttgatttgcgtctccctggtgaccttcttctctgaccagcatccgtgggcttagggaaagcacggtggtggaaatgtgatcctggtgtgtgagatgcaaacttgatcttagcctttgctctccctggaaacttatcggtcaaaactttcactaaaggcagttttttgtctgtttgtttaggtttactggttatttattatttatagcatggttaaattgggtcaaatttttatgaattgtaagtagagaaacttttctaataagaggaaaggataagaaatcagacctttttgtaaagaaaattaccccacttaaagtcctggtttattttaggccgtttggcagtgagaagaagggattatttgtgtctgacagaggtctacaaggaaaaaggtttgggatcagaaaacacttccaaccagaatgacggttccctgccagtccttggtctttcttcctcccttccttctgtgcccacatggactaattatgtctggctttccctccctcttccttgtatatttcccttccatatcaagaccttcagaatgagggcaatgtggataatttcccagttttccagctgggcagctcaccaagaacaaacccagacatcaaggccagaccaaaaaaatcttcttgttttagacagaagactcctacatctgggggatttaatgcacccactgtccgctcagtgcatttcctgtgtccggagcttctctgcctgccggctctggtctcgtaagtttccatgccctgctgccaacttataataacagaggcggcaggcagcaggctgagaatgtcatagcctactccatacatgggcactgctttgcagactgaaacaaagcttgcagggtctcattgcaggcctctcagccttgacagtggttgtgcccagaccaccaggagcctggaattaaataccctcggatccagttctctactgttaatgttatcagcttcatcaagtacttcctctttgagtgatatctgtggagaaataaataaatcaagctcctccaagtcctgttcctgcctggatcctgagtccaaagtaaaatctgagttggattatccaaagcactatcaccctcctgcattgttcccaaggtctgggcaggaacggagagtgaaatctctccaggacattacatcagttcctcctttacccttggcatgaaagttcttcctctcctggtcctcccagacttcctaaggcctgccctgagtgcacacccacacactaagccttgaagcccaggacatcaaagaaagcctgcaggtaaccagattactgaccaacgcctgtgaccgttttgaaatttataagatgggaaatggattcaggaaatgggatttttcaatacatggtcttcatcatccttaagtatttttaagccttaataagcttttaagtaaagagagacattctgtaaatggcatttagaagaaaatataggaaagttcaaactggaactgtcttcaatagttgtttacagtgatcatattctgtgacaaatgaaaagtggaccagggacaaaagataaatacatttctatgggcagcagaattgacatccatattatctataaaaggaaagtttgccttgtctacaaaagattacagatcattttagttggtgcccagtaagcatttctatgcatttgggttaaagtgaggaagttagtgcttgtctttccaacctatatccttgcaaggttaattaagcactttaaaaaaaaaaaagctttttataacaggaaatatcaaacctatacaaaagtaaagagaattgtgtaatgaatcaccatgtacccatcaccagttttgatgatcaactcaaggccaatcatgtcttcctctgtggtctacctcctctctccttcaccatcccagattattttacagcaaatctcagatatataatttcccttgtaaatagtatcaacaggctgggcgcggtggctcatgcctgtaatcccagcactttgggaggctgaggtgggcggatcatgaggtcaggagatcgagaccatcctggctaacatggtgaaaccctgtctttactaaaactacaaaaaattagccaggcatggtggcgggcacctgtagtcccagctactcaggaggctgaggcaggagaatggcgtgaacccgggaggtggagcttgcagtgagcagagatcacgccactgcactccagcctgggtgaaagagcgagactccgtctcaaaaaaaaaaaaaaaaaaatagtgtcaacataggtctcaaaaaaagactataaaatcataatagaaccatcatatcacttgaaaactagtagttcctcggtatcatcaaataatctgctagtgttcactttttgccaaccatctcataaatgttttttacagtttggatcagaatccaaacaacatctatacattgcagatggttaacgtatctcttaagtttttttcaacctataggttcccatctgcaaccttcttgtgtgtgtgtttgagcagtccctctcttcaggtttttttaaagaagtcagccataattagtatattcgtatatataatatattatatatattagcgtaggcttatatatactatgtaagtatatacttatatagtattagtatatactatatatcatatatactataatcatatatagtatatatggtgtgtgtgtatatatatactatatatcatactatgcatatatagtatattagtataatctccccctgtacatagtttctttttttcctctggttgctttcaagattttctctttatttttggttttcagcagtttgactatggtgtacctgggtgtggtttttattttacatatcttacttgagattcttggaccttcgaatttactgttgttgataatgttgttaccaaatttgaggacaatctagccattattttttaatttattctactctgtttttttctatattctccttcttggacaccaattacatgtgtgttagaccacgtgatattgttccacaggtcactgaggatttgttttgtttggatttcatttttactgatctgtcttcaaattttctaaccctttcttctctcatctccgttctgctattaagtccatctagtccggtctttcatttcagatattatacttttcagttatagaatctttattttgcctttttttttaattccatttcccttttggcagcctgtatgtgtcatcatttattacaaccatgattttcttttagggcttgaacttatttataatagctgctgtaaagtttttctgtttgtttgtgttaactccaacatctgcattatctcaggttctgtttcttttgatggcctttcctccttattatgagtcacatgtttgtatttcttctcatatctagaaaattgtgactggatgctgagcacattgagacactggattgtgttctattccactgaagagtattgacttttgttctaggaggcaatcaaattactggccagttactttgaatctgtagaggcatggtcttacgtttcattaggtccaatctgtttctattttgccttttgcccttagcagatccccttgtcctagggtttttactcctacattgtggccattctggggtaacaaacagcctgaagtgtttacagagcctttgaacttgatgagactcaaactctgaactctgtctccactgcagtagccagtagctgaggtttccgcttagatcttttgattatacaactgttgcttttcactgaactccaaagggtctccctggcacttgggctattcggtaatcagacaagaatttgaggaagcttttacatgccaatttaatcactctcccctctgtggctcccactgtatgggatttgtttcttcaattttctgccattctggcagctacctactctatctcaagcaactttctgtttatcttctaactgcccctgtgctgcacggactggggaggaacatgcagcatagggcagttaggagatcaacagaatcagggggaaagctgtttaaatatggacctcactctgtgcagttcccttctttcaagagtgaaatcctctccggtttttgtctgcccttgataccttcaaatagttttttcaatgtatttaatatggtttctttcatttctacccgtaagaaggttagtttggtacacgccactctgctattgttgaactgaaattgcccctttccttgtttagataagtggtggcagatcataaatacttcatcttgcttttcgtatctaaccatagattctgatgctagtccttagcaaaatatcaagatactcctcattcctttttacttttacgtagtactccattttttagagatatatactataatttattaaatcagtcttctattgatagctattccaatgatgaggcacttgaatttatggcagtgggttatacagtagtcacaaaataagccctttgccttcaaggagatgatcttttaatattgtgaacaatatttttgttcagtgatcatatgatagatgagatctagtagaactttcaaaaaagaaaaaagtccgcattttcttcttaaccctgtgtaaaacttaaaaccactatgtctgtctctgtttactgaccctatcaaattacggaattcactttatgtgttcttcatatatgtatattatcttaatggacaaaggtgatatgtttgacttgctttacttagaactgtggacaattctttgaccagaacaaggacagcaagcatgcacatccttttggtgagactgccctgggaacagatgtggccagagagagttcattgagttgggtgtggagccgtgtagaaatccccatttttatgggcagatttctgtccttctgcaccttagcagggacttctggagccaggtgtgtgccggtccattccccgacccagccctcagagctacttctcttgctgagctgtgtacacttctgatgttatcctcgctcacatgtcaccagcttgcaactttgagtgggatgagttagaggtgtccatccatcctgcttcttccttacttctgcctgtctctgagcactcaggagcaaagtgctcccaaaagttctttcaagttcagtaagattgtcattctgtaaattggggccactgtgcatgcttagagcaggttttggtgtgactttgtgtcatagtttctatattgcagtgacagatgttgtcatgagtacacaggttctagaatctgactggagtctggttctataatctcctaactggctgtgtgaccttgggtaagttatttaacttctttacgcctcagttttatcatctgtaaaataggggtactagtggtatctcttggttaggagtgtcatgagtgtcataaggttgggggtttttttcttttttcttctttttttttttttttttgagacaaagttttgctctgtcacccaggctggagtgcaatggtgtgatcttggctcgctgcaacctccacctcctgggttcaagcgattctcatgtctcagcctcccgagtaactgggattacaggcgggagccaccgcacccagccaggagtgctataagttttaaacagtgaaatccagcatctaagatatagttattactaataattattactaatattattaacattatcactaatactaataactcctagagttagagaatatgaaaattttagttgtgaaaatgtaagtcaatgaaagcatctagagagaaacctgtaagaacccttccacctctgaaagcgacgtagaagagttaaatgatggccaaaagatggggcatggaagtttggcttccttgtgcctacaggccacaggtaggtcattaacggaatgcttgtagacatccttaggttgtctggcaatagaaaaatagtttcaatatgcacaccttaaggccaggcgcggtggctcacgcctgtaatcccagcactttgggaggctgaggcaggcagagcacgaggtcaggagacccagaccatcctggctaacacggtgaaaccccatctctactaaaaataaaaaaaattagccgagcatggtggtgggcgcctgtagtcccagctactcgggaggctgaggccggagaatggcatgaacccgggaggcagagcttgcagtgagccgagatcgtgccactgcactccagcctgggcaacagagtgagactccatctcaaacagaaaaaaaaaaaaaatatgcacccttcaaattgttaagcagtgaaaaagacactgcattctggggagaaaggtcctttacacatacctacacgctcctccatttaccgcctgtagagccgcagggagtttcctgtcctgccaactcactggggtctgtgattgtctttccctctgctccacagataactgtgtccagaggacccccaggccatccgtggataatgtgcaccataaccctcccaccattgaactgttgcaccgctccaggtcacctatcacgacaaatcaccggccttctcctgaccccgagcagcggcccctccggtcccccctggacaacatgatccgccgcctctccccggctgagagagctcagggacccaggccgcaccaggagaacaaccaccaggagtcctaccctctgtcagtgtctcccatggagaataatcactgcccagcgtcctccgagtcccacccgaagccatccagcccccggcaggagagcacacgcgtgatccagctgatgcccagccccatcatgcaccctctgatcctgaacccccggcactccgtggatttcaaacagtccaggctctccgaggacgggctgcatagggaagggaagcccatcaacctctctcatcgggaagacctggcttacatgaaccacatcatggtctctgtctccccgcctgaagagcacgccatgcccattgggagaatagcaggtgagtgagttcccctctcgccgctccagcatcatggggacctgacaaagtcccactctcccctgtgatctttgcagccagcctcgcaccattcccaattaggcgccctccaaggctctctgagggcaattggaggcttctgcttggatgaggctaaatccctaatggcttggttaatgagccgctgggatggagtagttaatgagcctcagaaatgttaagaaacaaatgtcctacgtccagcttacaaggagagtcacatcagaatcaaggctaagcgaaaacatttaaaataaaaggtttatgagcatgctaatggccctgtcctgaagtttccagcagctaattaatgaccagacacagcataaagaagctttgtctcagattcaggcctgtaattccatcctgtgagcggtaacgccatgcagccttcaccttaggagcgggtaggagaggaaaacaggattatggtattggaggcaggtgttgctgggccatttggacagaggaaaccactcccagattctctttcatttattataagaagcccaaatttgcttacttaagggaagaaaccagtggaaaccagtgggaaaaatatctacacattgtctgtttcctaggatgctcataatttacatgaactcattcttcagaagcttaatcctctaaccatgtgacaaggttagctcttttcgtagagcatttctccattagatatttgttgagcacctgctgtgtacaaataaatgcattaggagtagggatacagagctagtttaacatgcaatatctttttccccaaggaatttagaatatagtgggagagacaaaggtgaaaaccactaagatataaggcagaatgaagtcagccccatttcccattcattttatgtaccagcattcattgagcacctactgtctgccagagtaataaagcgctgtagaagcaaagcagaaggaaggtgtgttttgactggagggaccaagcaaggctttgcaggggagagagcctgatactgaagtgactgtgctttcgatagtgggaaggaggcctggaggcaggagagaacggacctgttcagggaagggtgagaaatgccccctcctccctgagcccatgacccggtgagagctctagctgaccatcaaggtgctgccatgctgatggcagtggaagaacaggctcctacaagcctactttacttctgccttgaggtactgtcccttttttttttttttttttccacactctgttgcccaggctggagtgcagtgacggaatctcggctcactgcaagctccgcctcccgggttcacgtcattctcctgcctcagcctcctgagtagctgcgactacaggcgcccgccaccatgcccggctaatttttttcatatttttagtagagacggggtttcaccatgttagccaggatggtcttgatctcctgacctcgcgatccgcctgcgtcggcctcctaaagtgctaggattacaggcgtgagccaccgcgcctggccggtactgtcccttttttatttaaatcatgtatttctagatttttctctggccccaagtgcaccaccagtgttgtctcagtttcactgttataaatcatttacatcagggatgttgaatccagaaaataaaatggcaaacaaaaatgacttatatgttttaaaaactatgaaaaaggaaatgatatatgtttgggattccattcaaaacgatcctgcagagttagggggtgagatgtgggtggggcctacataaaacaaggctagccatcaccagctagtggctatatgtctgggtgatagatgcatgggggttaatattattgatctctctgcttttacctgtacattagattgttttaatcagaaaatgaaaaaataaaactggggaaaaaaagaatagtagataaagaagcaaagagcttgggcaaaacatgtgaatttccccaaataattggagaaggaggatgaggtcagtgtattgctgtgaattctataaatgacccatctcgtgctttccaggcaatacccttcttgtctgtataccctctcgtcttgtttcttgcatggtgtgtgcagcagtacttgacattttgcagataccttttgcttgtttataattctcaggaccgctctttaaggtagctcatgactgcagtattcatcttatgtggaagggtcatttgtacaggggaaaccacagaggaaactgagccccagagaggcaaaggcctttgccaaggtcagataggggccccatgaccgaggtgtgcaggacaacccttgctgcccgtggctgctgtccatagtgctgccctcgtgggcctggcttgcttcccaagatctctcctgtctacctcccaggtgacactgccttcaccacttcttgggaatctaccataagcccatgaatcaagaaagacacatggtttagacttgaggagttatttttcccttatttagtaggtttgtaaatttcaaaatattagtctcttaaaattatattactttttttttttttttttttttgagacagagtctctgtcacccaggctggagttcagtgatgcaatctcggctcattgcaacctctgcgtcctaggttcaagtgattctcgtgcctcagcctcctgagtagcagggattacaggcacacgccaccatgcctggcgaatttttttgtatttttagtaaagacggggtttcaccgtgttggccaggctggtcttgaactcctgacctcaagtgatctgcctgccttggcctcctaaattgctgggattacaggcatgaaccactgcacccagcctatactactatttttttcatctcattccccaatatcagtgtttgatgatggatgcggcctcatcggttaggaagcttggtggaatactgcacccaccaaatgatgagcctgggtgtctatgggtgcccgctctctcaagggcacacagaaataggcaatatgtgcttttcttgatggctctaggaagtcaagaatattcatgtaaaataaccctggggcctagatcttttgggggaatgcgttaactccttcagtataacacaatgtcctaaaactaattaccagtgctataatggcatattcaaaagtttttaaatctcccaatatatattttaactaatgcaaccaaatccaaatttaactcattccactgaaaggcattgtttttctccgaagaaggtaggactgaatcatccctaaagttccttccagctctgccagtctgtagtctgacagtcttgattctgtaaccctcccaagaaaacacaagagttttaagcacctttgtttctttgaggatacccctgtgtgtactccactcttctgatgtctttctggactcctcgatccttgtaaaattgattctgtttattggaggtgaaattcattgggtgattcctgtgtacaacgtaaaagttctgtcattaactgaatagccataaaaagcctttaaatctccgtaaagcagctgttagatgagaaaacttagttccttaaagcttttcaaatgagcacagcacaaaaagaaatgaaggtgctgctgaatgtcaaactgatgagtactatagctggagggtatagatggaaatagtactcatgaatgtggatcacaaaatgaagctaaattcttactattcagatatgatttgttcaggtgccctagaatttatgcatttggacaccttctgtgtataaggcactgttctgcattcttgatggggtggggacagcctcagagaggtataagacacagtctttatcatgaaagagctgagcacagttaactataaaagcgaagcacatgacatgtatcttagaagggctcctgttaagtaccacaggaggtcagagtagggatgtcagggcaagctacatggagggctggcttttagctgggcttggatgaatgcttagaatgtggacaagtggagattagagaaaaacaggtcattccagatggagaaaacttaccaggagcaaagcaagataaggctcggtgtattttttctatttcaggtagaaatgtaaatctacaagttgagatctattgaggtcatttaaaaatctatcatttttcaggctgggtactgtggctcacgcctgtaatcccagtactttggaaggccaaggctggcagatcacctgaggtcaggatttcgagaccagcctggccaacatggtgaaaccccatctctatcaaaaaatacaaaaattcgtcgggcatggtggtgcacacctgtagtcccagctaccgaggaggctgaggtgggagaatcgcttgaacctggaaggtggaggttgtaatgagccaagattatgccactgcactccagcctgggcaacagagtgatactctgtctcaaaaaaaaaaaaaatgtgtgtgtatatatatatgtgtgtatatatatacacacacatatatgtatatatatatgcgtatgtatatatacacacacacgtgtatgtgcgtgtgtacacacatatgtgtatgtgcgtgtgtacacacatatatgtgtatgtgcgtgtgtacacacatatatgtgtatgtgcgtgtgtacacatatatgtgtgtatacacatatatgtgtatgtgcgtgtgtacacacatatgtgtatgtgtgtgtgtatatacacatatgtgtgtatatgtatatatgtgtgtatatatgtatatgtgtgtatatatgtatatatgtatatgtgtatatatatgtgtatatatatatgaaatttttcataaattcttttcattatctattatcactgaaattccatcataccattaagatacatgcagaattgttctcactcataggtgggaattgaacaatgagaacacatggacacaggaaggggaacatcacacaccgggtcctgttatggggtcgggggaggggggagggatagcattaggagatatacctaatgtaaatgacgagttaatgggtgcagcacaccaacatggcacatgtatacatatgtaacaaacctgcacattgtgcacatgtaccctaaaacttaaagtataattaaaaaaaaaagatacatgcaaatttatgtctgttaggtatttaccatatggaaaaactaaaataatcaagaaaggaaattcagtaggtggttgacagtttaaatacaaatcacaaatgacatctttttaaatataacaagtagcttatttttaaaggtgtcacttactttgcaaaggataaggagaactgttattaagaatttaccaggttggaatggctagtgtttatgggagagagtttagcacaagacggagtgagacaagattgctggggtcttattttgaatccagcagccaacgctgtatggaatagtgaaaaagttgcctctttctgtgcttgttttctacttggtatctttaagaatgggctatttaggagcaaggagcctagcagaaagcatctgtcaatcttctaaaactttacctacaaaagttttactggcttgtgtcccaccagtgtgtttcaaagccagaaagtatattggccacaagcacctgtaggtggctgaggtgtgactgtagtcatccgtgagtcatgttttcagtatgtattgaaattccttatttggacttgatttcaaaggtagaagggccttttacaggtgaaggaactgagattgagacacatcaagagtctagcctcgagcttctgttcagtgtttttcccaaaattattgtttccttctggtctgggactctagagcaaagattgaaaactgtggcccaaagtgtgagccaaatccagccaccatgcgttttttttaaatcaagttttcctggaaaacagccaaacccatttatttggtattgcctatgtctgcttccatgctgcagtggcagagttgagtagttacaacagagattgcatggccagcaacacctaaaacatttattagttggccctttacagaaaacgtttgatgctctctgccttgcaacattgtgtacgtggtggtcagtgtgcttggaatcataggtgcaatgtaggatgcagacttagaaaacagtgcccttgctcccaaggaattatttgcactttagatgacaaggcatgtttgagacatgtgaaaggaacaataacaagttatgtaagagaggagacaggttctggactgcaggctatattttcagaccaaccagaatagttacgataatatcattaacataaataaaatactaagtatttagctacgtaaaagaaacgatttatttgcactttggattatacagttcttcattcattgattcaaaaattattgccagtctgctcatgtgccaggcattgttctagatgatagggcactgcatctctaaatgccaaatttcgtatccttgctggtggaaggcaatgtcctcttgctttatgccatgacacaaactaagctcctgctttaactatagacagctaaatcttaaacgaacacttttcagtcagtttagttttctcttaaagtactttaattccgttaaaacctgagccaccagatttcctgtctgcctgtctcttccttggccttaatccaaaactctgctgaggaagaagattcgttggtacactgacaattgttttataatccattcatttcataacccctcatttgctacccaaaagtggggacctaaatctgtacagatttacgtgttcaaaggccatggcctacccaaatagagaatatctcctttcttgtgtttctctcacaacttttgctgaagtctctccatctttgtgaacatgaacttctcgatttgtgaggctatcgctggtcagttgggtcattaatcctacagcaggcaagacacagaatttcctctcagctcaagatctcttcactcccaaccctcttagaacacacttcgcagcaatccttggaatctttaaaggtagccttttgtgactttaaaaaatacttttactatctctcaaggttacatccttaacagaaacaaaaagattctaatcagcgagacatcaagtctcttgcattgcttatttgtcacccaactaaaacaatgtactttcttgatttggttttattgactggatgaattatatatatacaaagattcaattagggaagcctctgaagtaagatgaagaaaaaagtatgaaactccagagaaagcagtttgaggcttatcctcaggggcttcaaggactgggagaagtcactgtattctggcatcttgcttctgtctccacttcctcccacagtgtttaatgctgctgtgaatttgtttcaaaggaagcctatagacttttttttttttttttaattttgtacatgagcctcaggagcagccttgacagctaaaagacctcgtaaaagagaagtgtgaagggattgcatgaaagtgctgggggcaagtctcagccctcggcctttgttggaaggtgtggggtgtgcagacacatgtgcaccttcgcacacatgcatctgtgcataaatatctgtgtttgcaggaaagaaaagatagggttgtgggatgtccccagaagccacagggattccagtgttttagtaccaggtgaaagagccgcttcctcccacactatctcagggagatgcccttctgtagacctctgtagcccagtaccctcaagagctcctggagacagatggccccgaacagtcctagggaagcagtgtgggcctgtggcaaaagcttggactgcgaagtcagcatgattggaatccggttcttgactcccaagcaggtgcataatgtccctgagcccttctttccttatctgtaatattgagaatagtaatacccatttctgggcccttttgactgttaatgagacaacatgtgaatgcatggcacaagaaagttaattgctacgtgtcactgtccccccctgcctcactgctgagctgccatcctgcccatctgagagggactgtgtgggagctgtgggtacagccagcacaactgcctgcagagccacgcagggcactgacagggaaggcctgtgtggggtgcccttcaaggccacctccgttttcttatttccttggagatttacttttgtgctcctgcttcccctccctgaagctttgcctgctgtccatatttggaggggatgaataagatgagcactggggaggggaggagccatcactccagcaggaatattcccagcggctgagtcactgcatttgattttcagtgtgaacaactgagaaatcaaagagccctaaaagaggaggaagtttcaggacaatgtttttaaaagataaaaaaacatcaacagcatggtgtctgagtggaaaataatagaaggggcttgaggagactggaaattccagtttgtgtaagggcgcacagtgctgtaatacagagtcctacctccctgcagtccctggatgtgaattcccaggctgcacccacacctgagcaaagcggaggctgggccttattaggttctgactgcgggctggatctcagctgcaggctgtgagtttcggataccggtgtttccaagccttctccacaccttatgtaatcacaggtgaaaaggtccagcctcatttgcagctgtggttcttctgccccaggaagccaggaagcgtagatttttgtattatttgcctccacttctccctcccccagcgtgccaccgtgcacatatgttttctgttttcctaagccacggcaaagcacaagcaattgcccattgtaaacacacctctgcgtatcaacacacacctggctgcactggattgaccaactttctgcttctaggtaatggctgatctagaatagaggaggaggaggggaaaaaaaaaaaaaacaagcagcagatggccccctgaatgttgtaaaccgtgtttctctaagcagggtttctcaacactctcgatatttgggccaaataataatttgtggggttgcttactatattgtaagagattcagcagcatccctggcctctacccactagatgctaggagcaccctgcaccccagtgtgacaaccagaaatgcctccagatattgccacatgcccccagttcagaaccatatttgtaaagcttagtagcaactttttttttcatatgctactttgcgtgttttgttgctgaactggaaataaacgttaatttttaggtaataaatttcaaaaaatgtaacagggacactcagcctctcttctggtaattatgcccatgacactgtcatttgcaggccttctttaaaattccacttgggcagttaaaagaacataaaatgactttcttagaagctttcctgaaatttaaattaaccacaatcattaaacattccctatgtcaataatttgactttcctactcaaagttttttaaggcatcagttttgtctagcgtggtttttttctttagaaaccatgttggttatgtgtgaattgcccatctttttacaatctctgctcaataagtttatacaatgagtctctggtaagagacagacgtgggagtgaaaatatttctccttaaccacaggaagggattttttacaatgcctttagctgcggataccgagggtacctcacccagcaggaaggagagggaactatacttgggctaaacactttcataaactacttctcatggaaaagaaaatccaaatagtggaaatttctttaaaatatccatgtgccttgagatagaagaaagccctttcgtttaagaaaaatgcacttaaaattaatgaataccttgtgatccaaaaacattttatacatatacgttcaggtgttttgaagtggagtgaacttctatttatagagtgtgttgcgctttattatatagtattatgcatttacattgatgatcaaagaacattgtatctgtgcaggcatgggttccgaaaaggctgaaaaattccaggtgagccgtggcaacaacctctaaaggatctaggaacctaaagaggatctgccttttatttaatagaaatcttagaaacaaaaataactgacatggcttgaatgtcaattgtttaaaaaaaaaaaaaaaaaaaggaaaaaaaatctattgtgtggtcaggcagttatttttatcatctaggcataatttttaccaaagaaacaaaacaatcaataatgttataaaagccacttatactctgagcttgaaacaactgctttatgccacaaaattcctattgctgtctccgttagtgactaattcaatatgtcctgaatgtcaacgtatttttattactcagctaaagttggctttgctggattaaatgtcatttaaaatgatcaattggcagcttgtttggggttgttttcacatttatgaaaggaaaagtttgccggatacaaatgttcttgaagctgatagggaaacggtgttctctggtaagccctgcccttccttttgccatctgataagtagataacattctaggtcctagtttgatgcctccgaaaaaccaacatggcagcccagtgcaggttaagcccttacattggagaaatggtctggttcacgtttcactgttttatgagaagtagaatgtaccattacagtaaaagagaagcaacagaaacatgcagtgaaaacgcccatgcttgtggttagagaactgtccgctttctttttgctctacagtaggcttctgagtggagtgccttccgcctagagtcaagagggctgccatgatgtcacccaccttcatatgggcaaaatgtctttatatgaaactgtaaaagacaaccaggtcgtttcttaattgctgaaatttattaaaatgaacacactagaaaatcacattcccaatccagaggaatccaatggcgtcgtcagcctatttgcaatggaaatgattgtaaacctatagggagacataggaggggctgcacacaaactactttcgttcgtcctgatttactggcttcttttccccctagagatacagtctcactctgtcactctatcgcccaggctgagtgcagtgggttgatcatggctcactgcagccccaaacccctgggctcaagcaattctcccacctcagcctcccaactagctgggattacaggcatgcaccaccacgcctggataatttttaaattttttgtagagatgaggtctcgttatgttgcctgggctggtcttgaactcccggactttcaagcaagtctactgcccctgcctcccaaaacaaacattgggattataattataagccaccacacccaaccctaatttacaggcactgtatgtgataatatgtgattttgtcagatgttttccagttggaagagattatggaaaattaaaatgtgtctgccatttgatagtaggacaaatactgaaatattaagccacagctgagttctggccttagtccttttggggctgctctgacaaactgccgtagactgggtagttggtacgcaatagatacggattgctccacagttctgggggctggggagatcaaggccctggcagatgaggcatctggtgagggcccactttctggttcatagacagcaccttcttgctgtgtcttcacttggtggaagggtgaggggtctctctcaggcctcttttaaaagggcactaatcccactcacaggggtggggcccccaagacctaatcacctcccaaaggtaccttggtagttagttaggatttcaacagatgaatttggggaggacatgaagattcagaccacagcagatctctattttccctttatagagaaagtaattcaagacaaggagatgcttacaagggaaaaagacactttgccactttttactgctttgcttagaaactagaatcatcctccttcaaatgcctgtaaaacgagctagattattctcagtctgcagtaggacactgatttctcaaggtacttaagatgcttgggttgctcatcttctccacacccccacctcagcccatcccctggcaatacagaatgcagccatggcaagacggggtgggcaatagaagtggctggacagcttctgttgttagaatggggttcaaagtccaggactatggtgttgttgttttaagaaggaggccacttgtccttttccaaaacacaatgagtgacacaccacattaatgtttaaacacagataatacagaagaaaggattccataagggatactaaagatttagggctgctgtacatttaatggtagttccttgaaagattaagcttctggaaaatgccacagttttctgccagtgtcttctgctattcaaagagaacgctggagttcagaaaagatacactgagcaggtgtactttgttctggaaagtcctaagattttataaacatacacccattaacgagtttctctgagactagaaattgcattgggaagtgtgtcatagcatgggttttggggtcatgcacagccaagaatcctgtgtgtcattcataagctgtgtcctcctgagtaaatcatcaaaccctctcagccccagcttcctgatctataaaataggaatagcaacagcacctgcctcataaggcggcgtaagggtcagatgtaaccaggcttgtcgaagccacagcacagtacctacaaatagcacccactaaataccgttgttatttttattactttctcttccctcccattatcactaatataataatcctgtaaagtaagtgctgttattcccacttcataagtgaggcaacagaacctcaggaagattaagaagcgtgtccagggtggcccaactgaattccccttgtaaatatacccccagagaagggtgtatgtttctctgcaatgcggatgtgttggctgtaatatattccaagtctcaactggacactcccctttcaaatgtgccaggcctaggccttgcccaaagtaaaaaagaaagaacattgtagtgcaggagtccagagtgcaaatccttgtgacctcaggcaagttatttcaacctctctgaggatcagaaataatacaggtaaagtgccgagttcatacttgtaattcagtagttgatcttccatcaccagccattctgacaagtgcctataaaaagtgggcatttccagaaccatgcagtgaacacctggaaattggtgctgctcctcatctggaggccagttaacctttaactcaacctagaaggcacacatctgtccccagctgcctctccaggttctgctggagggcaaccacacaccttcacagcacacatccagaaagtcatagaacaaggggaaggtgtacatcatgtcttcttctttttttttttttttttttttttttttttttttttgagactgagtctcactttgtcaccgaggctggagggcagtggtgcgatctcgacttactgcaacttccacctcctgggttcaggcgattctcctgcctcagtgtcctgagtagctgggattacaggcacacgccaccatgcctggctaagtttttgtatttttagtagagacggggtttcgccacgttggtcaggctggtctcaaactcctggcctcaagtgatccacctgcctcagcttcccaaagtgctgggattacaggcgtgagccaccacgcccggccatgtcttctcttttaatttactagcccacagccaaaaaccaaggcccaacaccatgcctagtccatattaaatcacctaacacttaataaaatatccattgcctgactaaatgttcaaacatcagttctgcaagtggagaaagtgacttttgcactgggttcctttctgccatgatccactatatcaaaacattttttaaagacctccaaaatgtgatagaatgagaatatctgtatctctttttgaaaccatgctagccacagttcccacagtcagagtcaccaagccacatagtttttcttttcccaccatttttcactcctcactcctttttgctgtgttttagcctaccccagccttctcatctttatccatccatctcccaccaacaccaggataaccttttcactccactattttttaccacacagctctctctgtaaccatcaggaccctctttccacccttttttccttccagcctgcatttaacacacattcagagcccattgattcagttagaacttgcctcccgtctttcacatgggttctgcccaggtttaagtttgggtcacgaccgtggacttctgggtcactgtatcatcatctgtggagggaggctgtcgcctggatcatctctgaggcctccggtgggtcaaaggtcacacaacaggacctccctccatctttctgggcctccgtttcttcccggtaaaacaaggaagttagttagacaatcagtcaacccaagctaggcagaagcagttgctggattcttttttgattcttctggttagtgcctcaacaagaaacattttcaacagtgttttcttgcccttttcctctgtagactgtagactgctttgggattacgtctatcagttgctttctgacagccggtacgaaaacttcatccgatgggaggacaaagaatccaaaatattccggatagtggatcccaacggactggctcgactgtggggaaaccataaggtaaaagggcagcagatatctgctccataaactagtgccaaaatgaagtccttatccctggattggaggataatcgtctgtcttctgctttttacgtctgcccatacttatttagtttattccttgctgggcaagcaattaggcagttgcaaagggaaggaaataattaaagatgcatcttgccatttgttcctgagaccaggtgcccattaactcacatatcctggtttgctgggctgcatcatgagtgactcttgtttccactccccttgacctgatcccgccacctccactgttgttaggaactgggtaaaagggaagtacagcaagactctctgactcacaggggacctttgggaagtgccactacttttctgctcagttagaaactcccatgttccccaaagcccatttctttatagaaaatacttagattctgactgtaaaacatcccctttataagcaagcgatgcaagaagtttgccccacaatttcccaaactgggaggagggaatggaattgaataaagtcttttgcagtaaggaagactgctcaagtgcgcagttgtaaaaagcgggtaaccgtgatccaggccagtcgataggtggacctgaagcaaagcctgatgttggcatggtggcacaaccccaatccgctgagtgagtgaaaaggcagggaggcccagccaggtgtgcccagacctgcagccttctaagaaggcagtgggtaatgcagaccatgaccaaatatggcaaggccccactgacagacacttccatgtgtgagtcactgagaaaaatccctctgctactcccactgtaccattgcctcgggcccagaaccactgtattcttgcttccacaacaggaatttaaacaaaagaattgtcttccttaaaatgacagaccagaaacacaagtttgagaaaaggtcattgcaacaaaaaaaaagaaatgctgtgtgggtcagaaggtgaagggtgacccagagatagggggaacctgcaggaaattcctcaggcggagcagagagcggtcttgggaaaaggaaataagcgaggctgctatgggatctgctttattagctagggctccaggacttcggacaaagggtgattcaccttaggagtaaaccttggtgacagtgaatataaaaagctaaagggtggggacagatgtgcctggaaggcagccgattagcaggtagcttcccaaactggcagggccacaggcagcagctgaagagcttttattttaatagctcccgcagtgccttttctgaggttcatttcattgtgtctttgtgctttttttctcccttcctcctttgaacaaacagaacagaacaaacatgacctatgagaaaatgtccagagccctgcgccactactacaaactaaacattatcaggaaggagccaggacaaaggcttttgttcaggtagcacttcctttttctcctttccttcttttgggaggatgctgttttctttaaataacggggagtggggggagactgttaagatctctacctgcctatcggatacccaaagccaatcattgctacaaactggataccaggtactggtttgttaggatttaaggaaaatatttttttaacttatgtctgtcctgtaataaagccaaaactaaatgaacagaatctgactcacctttaaaataacgcagtgaccaaataatattatgtggcattaaagtccggtgtagttaaaagcacaaagtcaatggcaaaacaaggaattaaacctagacttccaggttaccatcgctgtaaggcaactttctgaaccagtatttgtcaaaatgcaggtaatgacccacagtgagtcatgaaatagattgaatgggtccatcagagctttttttttttaatgaaataaggataggataggatagagttgaaaatgccagactgcatgacatgtagcaagaatgacagttgattcatgaaaatgttgttccaggtgtgtatgtacgtgatgagtcatgatgtaaaatgtatttcttataatgcatcgtagtcagaataagtctacaagctgctgcactagaatttttctttccagaattcctcatagataatgagttccaaccaagttagcctgccaccacatagattgtaattccaagtactatgcaagagaggagaaagaactggaagaagaaggagggatctgaaggaccaatcaggagatgtagaagtagacctctggtgctggtggtagtcattagcggggccaactgcaggttggtagaagtgagatcaacaaacacaaccttgggtgatgagttttggcaggtgggccagaagagagtggcagatggggctagagatgtagattgtgaattatctatatacaggtaggaagtgataccatgtatgaacagatgagctcactgatatgattaatttattggaaagagcagagaatctggtctttagcattgggaaggaatggtaacttaggaatagtaaaagcaattaagatcttcaaaagaaacgggaaaggctcttcaggaaagggaaacagaatagaaggaataaaaaaagaaccctccattctctggctctaccgtatggcttttcttcatccttcaacctaaacgcagtccttggctccctttcttcccactctatacctttttcgtggatgaactgatcccgacacacaacttcatttatcacctcagtggttaggctcttaaatctctatatccagctctaaaatctccctgaaattccaaatttgaatgtccaagagtttcctgtaggctgtgtccccttaaatatcacatttaagtatttcagacatgacatcttcaaaacagacacttgtctcggattagaaattccacccagaggccgggcatgatggctcacacctgtaatcccagcactttgggaggctgaggtgggcagatcacgaggtcaagagatcgagaccatcctggccaacatggtgaaaccccatctctactaaaagtacaaaaattagctgagcgtagtggcatgcacctgtagtcccagctactcgggaggctgaggcaggagaatcacttgaacccgggaggcagaggttgcagtgagctgagatcgcgccactgcactccagcctggtgacagagcgagactccatctcaagaaaaaaaaaaaaaaaagaaaagaaattccacccagaattattgaattctttactcatcaggggcatcactgctgtttgaagcagccaactttgaaactacagttccctttgactcctcctgtatcccagtcattgtgctagatggaccattggctcttcagcaccattcccactctattctgtgttgcaggggctagaagcctgggaactacatttcccagaagggactgttgccagaagttcccaggttggagtctttcagtgacaagcagtttcatgagatctgggagactagaaaaaagtaaaggcttccctggcagtggaagctgatgtctggacttcatgattcacatcgggattcactcaacaacgtctttctgtctctagtccactctgctgcctcctgaaaccataatacaaactgccagctgccctacaacactaatacagttccctatgccagaaatgtatatgactaacttttgcctttttaatacctacaccctcaaggctcaacctcaagtctgttgccctgaatgaggccttcttcagctgctccaacacacatagctgtcgtcttccatcatcacctgggtttcctggagcccttaactacactacaatttgctttttcttttcttttcttttcttttttttttttttttagacagagccttgttctgtcacccaggctacagtgcagtggcacaatctcgactcactggaacctccacctcctgaatttaagcaattctcataattatcatgccgtagctaatagtagctggaattacaggtgcctgccaccacacctgactaatttttgtatttttagtggagacagggtttcgccatgttggccactcttgtctcaaactcctggcttcaagtgatctgcccaccttggcctcccaaagtgcttgaattacagatgtgagccactgtgcctggccaacttgtttgtttttctagagacagggtctcactctgttgcccaggctagagtgcagtggtgtggtcatagctcactgaagcctcaaactctgggctcaagccatcctcctgcctcagcctccggagtagctagagcgactacaggatttatattttgaatacaggttgagtatccctcatctggaatgcttgggaccagaagtgtttccagtgtttggattagggatgctcagcctgtagttttatgtgtcaagtccttctccccgacaactagattataagctcctagaaggtagaggattctattttttatcattctatattaaacctttcagttaatgcttattgacagcctggtgtggaatatcagaagcttaatatgggaaagtcgtcaaaagaagaaaggggtggtttggggggccaagcataggacatctgtggagttggcttagaggggctctttattgacttcggatgtggagggagaaattttagttaggggataaaagaggagaaaaactgcagatgctacagatcatactgctggagaagtttgccagtaatgagcaggaaaagcagtagtagccagaagattgataggcttccaataaaagattttcagtaagagaaaggaatagtgctattagtgagggagagattagtccattttgaggaaatgaatgttagaagccagacttgccacaaaatgaaggtttcttggtataagacctagtatgtaatcaagtgaggtgttgaattgtagatactctttacaagatgtttgagtgttgaagaagatggaggtttaagtgttgaaatcatggactagtgccattaagcagctctttgatgaggagacagaacacaaagaatgagtaggactcaactcgtgagaagagtcaggagggctccagataagggaaaagctaaagatacatgggagagcatgcgccatgatttatacaagagccaagaccgctagactgcattgggttcatactgatgaacagtggaaaataagagcttcctaggtaaagatggcagaaagacccgatgagcagagcaaaggatgcacctttgacttgatgagtggtcattttaggcttttgcatgtggaggaatgagagaaaatgtaagctctaagatagtggcgcagggcagagtatatggggagagaaaggtgtgcaggcacagaaggggactggaacgggtgctcctacagtgtaggtggaacatctgcaaccaggctgccttcctgagccatgtaaattatggtcaaaacatgtcactgatgtcacttccagtttaacccattgaacaggaagatgaggcttgctgtacaccccagttgcaaaggtagacagactaaagagggttcattgctggcattttgggtgaatcagtgataacattgtaaaagatttttttttttttttttttgcccttccaattttccagaagctccactaagttgtcctattgtcagcatttttcacttaacatttaactatatcctttgaaatttaagtaagttttgaataccatttcctgggctcacagtctggaatggaagtggatatacagctctcatgagtctgtaaaatctaattctgtaaaagaaagaacatatatacatggtctggaccaaggctttctcgtgtggtcatgcattaatgcaccacgtgatcccaaagggtgctcactacgtcacagacagcctagacttttttttttttttccaataattaggatttcactttgtcacccaagttagagtgcagtagcatgatcatagctgactgcagccttaacctcctgagcttaagggattctcccacctcagcctcccaagtagctaggactacaggtgcacaccaccgtacccagatttttttttttttggtagaggtggggtctcgctatgttgcccaagctggtctcaaactcctaggttcaagttatcttcccaacttggcctcccaaagcactaggattatatgcatgagctaccatgcctggccctagtctttttaaataagcattttaccactttttagacagtcagagaaaggagtaccttttcctaatttgcactaagttaacattaatctcggggttcagtagctctccagctgtataagatgatggagtctttctttatatacaggctagagttcagagtgaagacagctttaggaaaatggaatctcttacctcctccacttcttcttccaaaggtttatgaaaaccccagatgaaatcatgagtggccgaacagaccgtctggagcacctagagtcccaggagctggatgaacaaatataccaagaagatgaatgctgaaggaaccaacagtccacctcagcgggccagcagcccagggaacccctgcccaccaggattgctggaagtgtgacggagcaggcgggctgaggagagtggaaaaggaagcgacccagaaatggcagggacacttctcttgcagaccaagagggaccctggagcaccttagacaaactacccagcacaggcggggctggaattctggcggagggcatgagcctgggactccatgtcacgtttccttctgatttggaatctctccatctgtaattcctcaccctcacccttccaccgttgttagtatcatggtgtttttgtttttgtttttgttttaagaacctgcagtttgactcttcatcgttcatctaggggaagacatctgatgttgttttcctatggaaatatatatctattatatatatattttttgcaaatctcacaaagtgcggcaagcccagctggtcaggaaagagaatacttgcagaggggttcaggttcctctttttcctgccacgtggatcaggtctgttcctgttactgttgggtcttggctgaaaaaaaaaaatgcttttaaaaaagataaaatgaaaaggagagctctctttttctctctcttgctctgttcttcccttggtcccctctgtcctcccgccctgcctgcagttgagattcagatgccttctgacagagttcagcctcttggagagtcttggggattgttggcacctaaacagaatcagtgacccgggtgctttgtggccagcagcacagaatcaaacccgcatcccagcattgggccacccatctgagggaggccaaaatcatcacagatgctgctgtgctgcagacagatacatgctagtccagagagccgcccctgagatggctgtgagaaccatgtgtctaaggcgtaagataaggatggaaggctgtccaagttatttggaaggcctcggcagcttgggattagcttgggagcgcagcgctgcaaagtggaaaatatgaaaagaccacacaggcccagcagtccagaaactgggcaaaaatattctgcagtggggatttatttttccaaagcaggtaacagaggctagtgagaaagaaaagctcctctctgctccattccaaaggccatcttgtggtcagtttcatgccctcacctgatttttttttttttttttttttttcaattcctaaccttttttaaagtttcctggtctccactggacacagagctttggagacggaggatcccagagggcagtctcagttgcaatcagtgtgtgcccagcctgggcagacaggaaattcctcggatacattattttttctttctttcatagctgtgtctcagaaaggacccatttgtggctctttttcacctcaaaataagatcgatggtatcttgtaaaatgagggtagtgccacttcttagtatttttgaaagctgttttagattttttttttttttccttttctagccatctaaattgactcttccaatataggtctcagaaatccaatatttggagtacaatttcttttaatccagattacacctgccttacaaagcaccccctccttgttcccctctgtttcctctactcagttgggggagaaactcacagctcctccgggatacatatgtgccctcagcagcagctcccaggtgaagttaccagacccctgggcttctccccagctttttctgagttgagtcagacatgtagagtttgggtcacacaggcaagaggaattttccctcggccttactgacaaggacaccaacctagggtgcaaacagatggactatggttcaaggacactggaattgaggagctgatcaaggctctcttcagccttgctctgtccctgcctcttatcagagcacaggtagacacacgggcatagccagcccactcctactgtcacaggcgccccaccattcaaccttccgggaggtcagggaccttctatatgaggcgagtgggtctcagtctgcttgaatggtgatgagattctgctggatctcagcacgctgcaggtgtcttttgagagcattcagtaggacatggtgatccctatttcagcctctaagatgactggtattctatctgaaatgcagagattaagccaaatacctgatgtattgtgaaagccactgattttaagaatggagagaaagggattttttactgcatccctctgtatgaatatgaaatcagagaccagggcatgatgttgctaggattagagcctctcagtctggcctcttcacccaagtgcaagaactcagtctcttactgttcaaagaatcttaacagttgaattatggagggaaattcccttttgccccaagcatttctatatttaaagcaatatcccaggagaatatgttagacttaggatgataccttcagccacttgaagaagaaatagaaggcgctcattccaatatagtctttatttcccattcagatacaggttgagcatccctaatctgaacagttaaaacccccaaatgccccaaaatccaaaccttcctgaacgctatgacaccatgagtggaaaattccacacctaacaaacacatttgctttcttatggttcaatgtacacaaactgttttatatagaaaatgatttcaaatatcataaaattaccttcaggctatgtgtataaagtatatatgagccataaatgaattttgtgtttagactttgtgtccatccccaagatctctcattttatatatatatatatatatatatatatatatatatatatatatatatacacacacacacacatacacaaatattccaggatacaaaaaaaaacatttaaaaatccgagacccagaacacttctggtcccaagcatttcagataagggatatcaatctgtactaccaataaggatttcgtaattcccctaactgcaaatgtcctcttcatttgttctttatgagaaaacccgggtagtgccagcacctggatacagtatttacaccctgcagaccctaaagatttcagattcagttagcaaaccttgatgaagcacctgctggacactgagggacccaaagctcaatcagccataatccctgctttcagagtttatattgtacctgcctaatccacccggcgtgactcatttcaacactaagtactaggggtgttgtcaggagacaaatctgaagtcaggagaggaaaatgcaaaggagccctgccgtgtgatggatgtgcattctcacttgggtcttgaagttctcattcctacatctcaagctagccaggcagtctcctctctatcagaagaaagcactggtaattggctagactggctatgttgaaggtaacatgaactctaagatcttgacccagggcgacttggttttgcttaaggtggcatcaccaatgttccaaatcctttagggagatgagggtatccccacagaaaaagaggaataatagaccaatggattttctcctttcaccagtatgtttggaaccctctgatccaatgtcttttgatactgatctcttgtccaaatgagaatgtcgctttagctgaaattcaaatggctgtgacaatttaccgaaatgatgaagtaaccaccattcccacctttcactgcctaggctccaagtctgaatacatttttgaaataggaactcccttttgcaaaaaagaaacctgggtgtcagggaggtgaagtgacttgccctaggagcagacagcatgccaagaatggaattaggctcaggatccagcctgggctcaccctgtgtggctcattcccacccaggaaactgaagataaaagatttgggaaaacacaccaagaaaaaggggcagttttctttgcccaagcatttggtgctagttagaggctgttcactctctcctgctcctcttcggagtagaaataaaggctgtgacacaaggaagccagtggggtgggagggaggcaccataatccctccctaaaacccacagaagactaacctgatactcttttgacccaactgcatcaacactaaacagctgcagaccccctgaatctttcacacatgccaagtgaacattcttgatgatttctctttgtgaccgcaaccacctgcaaaccagaacgactctagaatttccttccccgcccccctttttgtttagtttctaatctcttgtttatgaggtgtggggtttataagggactgaatcaaatgaatgtaacaaaaaagaaaaaaaaaacaaaaaaaaatgccttttctcagggccagtgagttgcaaataatttttaaagaaaagcctataattacatcatctcaataaattttttataaaaaaaaaaaaaccatgaagtccagagtctctgtttttaataatatgaaatggagtcagacaaggtgctccgatgaggtaaatcctgtctccactcaattatggtataaagggcaatcatggtttttctctggcagcaagtctccgctgcagggcagtctgcaggcgatctttagacaagtggtaccggaaaggtcagagtgaaccattccaagctgagcagctgccacaggtggaagaattaccaagaggaaccgtgatcagagatgcttgggtcccatgctgtggtgaaggtttattagctcactgagaacttagcaatgccaggtcctcacacaatagaattgccccttaaatctgctgagatcagaggtctaagcctaccaggtgatgaaggcgtaagggctgggatagatcctatgactaaatacaggactgtaatgacctagaaggtcatcacacagctcagagccagcccacatgctcagaatgtcccagccaacctgaccaacagagccacccaccaaccagtgggcacttgggagttcaagatcaaacattctgcacttgaccagaactatctgccatcagaagtgggtggaaacaaggggaagaatggaagaggaagcaaatgcattgctgttgagcaaattgggcggaggttcaaaatgtctaagaaatcagcagtctcagaaaatgttcttagtttacttttgtctttaggttaacccagttactctgtatcccctgagaatgattgctgaaatttggccctatattctgtatgatcagagcacagtatcaaataagggtctagatattttttttgtggtgctaaaaatgcattcgaagctactatttctataatgcagcattagagaacttgctagaaatgcaaattatcagttcccaccccataaactgaatcagaaactttggagctgggacccagcagtatgttttaacaagcactctgggtgattctgatgcacacaaaagtctgagagtcactgctaccaatttcttcatcttagtatgaaagagagcttgtagcaatttaaacaataaactcaaaataattgatgacaactaatttgcatcaatagtactcacacacaataacgctgcattttcctaatggtagatatactgtggaatgaggctaagtggacacagaatcacataccaaagtcatcgtcttgttttctccaaaccttttaagcaatcagtttgctgtaaagatgagctgttttaaagggtaactcttaacagctgacctgcccttgcaaattagagcacagcaatttatccacttatgcccacttatctgcctaaccagcctgatctaaaaagaaaaataaaaggattattctcatctgctaactgaccttggctgtctgtccccggaattattaaacagagcctggatgagcatttagccagggcatttgcagaggactctagaaccactggactagaccagtgcttctcaaacctgaaagtgcttatgaatcatcagatctcagggaaaaaagcagattttgcttcagtagtatcttgggaagtctggacagaagatctgttcttctaccctactctctgggtggggcttgaggtgctgcactttttttttttttttttttttttttttttttttgagacagagtctcactctatcgcgcaggctggagtgcagtggcacgatctcggctcactgcaagctccgcctcccgggttcaagcaattctctgcctcagcctcccaagaagctgggattacagatgcctgccactacgcctggctaattttttctatttttagtagagacggggtttcaccgtattagccaggatggtctcgatctcctggcctcgtgatctgcccgcctcagcctcccaaagtgttgagattacaggcgtgagccaccgcacctggctgaggttctgcacgtctaaaaagctccaggtagtgctgatggtgctggtccagggaccacactgagtagtgagaagacagtctcccttcagaccctgaaatgctaactgtgatgcaaaactgaccgaacccctccctttgttgttttcctctgctaattcctccctagaatggtccctgggcccagtcctgctctgtgagaagtttgcttgttccctttcagggcagcatcaagagtaaacaacatgatcaaaagcctcttcaccaagtgaaggaacagctattcatgtactggaccttcatacagacattcataaccagatgcctcatggtcatcattcttatgggaagcaatgagaattccaagcatcactgcctctcagcctctagaaagaccagtcttggtcactgaaagcagacagaacactaacaatgccattcttgatgttctaaatggcatagataggatggatgagcagatcttccatgcaaacagtccaagatgctgacattaaaatcagataatcctgtttgttagtacttaacagattcactgttttcttattttttttaattaaggccttcagtctctgccagattaagatgatagatttctgttagtaaaaaccactgaggaacgtctgcttaatctcttctgagacaatagaagactatttcctctctccaaaccctctcagcagtggccttctggagtcctctgagatgttcatgccttttccctcaaccagaattttggtcatgagatcccatatcagaccatccacctgagttgacctttgcttcctccagtgcctctgggagagctaagtgctatctcggtgccccagctgcaagcacttctataaaagcaactaaatgcctccatgcagtgaattgctcatgtgcctctgtcccctactaaagctctctaaaggtagagtattttatgcacatttttactaccagccccttgcatggggctggcacaaggtatatgttaataagtgttttaaatgggagtgaagtcagagaaactctttgtgaccttaatttaggcaaagatttcttgaatatgacaccaaaaaatccataaaagaaaaaaatggataaattggacttcatcaaaattaaaacttgctcctcaaaacacaccatattcagaaaatgaaaagataagttacagactgggagaaaatatttgcaagtcatttgataaagaacttgtatccaggataaacttccacaactcaataagatgaataacccgattttaaaatggtcaaaagatttaaacagacatttcaccaaagaatttatagaaatggttgttaagcacacaaaaagatgctcaacattattagtcactaaggaaaggtaaattaaaaccacagtgagataacaactcatccacaaaaggctataataaagactgtcaataccaagtgttggctaggaggtggaaaaactggaaccctcatacattgctggtggggatgtaaaatggcacagccactttggacaacagtttggcagcttcttaaaaagttaagcataaatttgtcatatccaaaaaatttcactctgaagtatcttctcaaagaaatgaaaacacgtccacacaaagacgtatacacaaatatttagagcagcattattttactttattttgagatggggtctcactctgttgcccaggctggaatgcactgatgcaatcacacctcactgcagcctgaaacttctgggctcaagtgatcctcccatctcagccccctgagtagctgggactacaggtgtgtgccatgcgctggccaacttttttttattttttgtagaaacagggtctcgctatgttgcctaggctggtcttgaactcctgggctcaagcgatccacctgcctcagcttcccaaagtgctgggattacaggtatgcgccactgcacccggcccagcagcattattcataatagatcgcttctgtaatcctatcacttcgagaggctgaggtgggatgatcatttaagcttaggagttcagtgtgggcaaaatggtgaaaccccatctctacaaaaaaatttaaaaattagcagggtgtgttggcaaacacctgtggtcccagctacttgggaagctgaggtgggaggatctcttgagcccaggagattgaggctccagtgagaagtggtcacaccactacactccagcccgggtgacagaggaagaccctgtctcaggaaaaaaaaaaaaaaaaaggctgggcgcagtggctcacacctgtaatcccagcaactcgggaggctgaggcaggagaatcgcttgaacagggaaatggaagttgcagtgagccgagatcacgccactgcactccagcctgggccacagagcaagactctgtctcaaaaaaaaaaaagacaaaaaccagaaacaatccacacatccattgactggtgaatagataaataaaatgtagtagatccaggcaatggaatactatttagcaacaaaaaggaaacaaaccattgatacatgcaataacatgaatgaaactcaaaaacatattcagttatataaaatttccagtaaaggcaaatctataaagacaggaggagatgagtgtttacctggggatggaggtgggagtggggattgaatggaaacaagcaagagggaacttttggagataatggaaatgttctaaaattggatagtcatgatggttgcataaatctatacatttactagaacttattgaactgtacccttataaagaatgtgttttaaggtacataattttacttcaaaaaagctgttaatacaaaaaaaaaggaaaagaaaacaatctacataaatcaattcacgctggttgtatggtaagtgggactgtcttcaggagctgcacataggactcaaataaaggaattatagaaaaatatactaataatgtaatatactaataaaaatgaaacattaagagaaattatgacagcaagaaatcaattacattctgttcatcaaccaacctccccagggctaggcctctcaacagtccaggaagtctgagtaaaccacggctctctcagaaatactttaaactatggacaccccagaaggaaccccagaaacacacagcccttgatggccaccccctgccagcatcaggtggctccaggcagttgtatagacagcggccctaatttgaactggtagcctaggatattggaagaccatttgatgctgagactccaagtcatagattcttaaagctacacagcaacataaaggccatctgaatcagtaggtgtttgtttgtgttatgtgtggccccagggcttcccaaaggggataaggagcaatgggggagaaatgcctcaggaatgaatctgggagcctgagaaggacccaactgaaatcagacgatgggaacaccaagcagggagatggtttaacacacctgtgggctattattcttcaactatgaaattaacatctatttagttggggtgaagagcaaattattttttactcacaaaaatgatgagacttttagccaggtgtggtggctcatgcctgtaatcccagcccattggaaggccaaggcaggtggatcacaagttaggagtttgagaccagcctggccaacatggagaaaccccatctgtcctaaaaatacaaaaattagctggacatggtggtgcgtgcctgtagtcccagctatttgggaggctgaggcacgagaatggcttgaacctgggaggcggaggttgcagtgagccgagattgcatcactgcacttcagcctgggtgacagagcaagaccttgtctcaaccacaacaacaaaaaatgatgagacttttatgtacaaaataagaaatgcattatatgcactgaaaatatcattacatttttactttatctaaaactatctcaaaagatagtatctttccattcataacagtcatgtataaaagatggagatatattccatgtctactataatgcaaaacatcttcaaaatgtgttttaaaatgatttcctctgtctgtcatgttggtaaaacgtttttcactgttctgtagttcatattccctcttctctttccttttatgaatatctgaactaggcagcctcttgggaagtgtatgaaagacttctaaaattagataataaaataaatcactcattcctgataaatagcattacacagtcaatcattttgtctcagaactttagcctattgctactgtagggaaaactttttgaggccatggtctcaggaccaggggaacagcctgcaatctcagcacgtgctttgctatgtggggagcaaagctgtcatcagagatagggcagtactagaaaggatgttggttttgtccacccgagaattctgtctgatggacaatgtctgaacgtcaatgtccaaatttcattttgccagtcacatcaggaattctagacagagactagaagttcattggtaccaagtttctgctttatgcccttctgatttagtgtgcctgacataggctggtgcccaacacagctggctggctggcctgagagcaacagcacaggacacttacacaggtgcagtctgcagtcagagtgcccggatccaagtcccacacctgctgtcactagctatgtgacctcaggccatgaacttaaccacgctgtgcctcagtttcctcaaatgcaaaatcgggatgatgataatgatagtgcccacctcagaaggaaggttgtggggattaaaggaggtattacagagaaagtgcttaggaaagtgcacagcacattccatattaactgctatgacttctataattaagtctggatctactgagccaccaaccactgcttcactcagagcagctctgcttttatcatttctacacattgggattccaccaaaagacaccttctcataaaaaagtttccatggtttttgttttgttttgtttcagtttgaacatcatggaaggattacaaccccctcactttacaaatgaagggtcagaggcccagcgggatgaggggctaccccgagtcctcccacaccctggggttgtctgagcctgggcccccgcctggcattctcacttcacctcccttcatggggccacattctcagtctcgaagagcacctgagtgcccagtgatatttatttgtgccaatggactcaacccaagggaaatattggcttgactcaggtttacggagaatattttgatctggttttgttccagttcaatagctttaggaaatgtgtaggtttcgttctatttaaaatcagtacgccaaactctttgattttgttttctctttctttttaagaaagtcctgactcagctaccctatgcacaaaactatattatttgggttcagttttggggctaggaaatttgaacaccacttcaaaaaggagccctgaatgtggagaagccacatcactaggccctagaagtcttgccgtttgaggaaccaggggatcaagctgtgagaatctcccaaccatcttgctccctgctggactcttgctttttttttttttttttgagacggagtttcactcttgttgcccaggctggagtgcaatggcacagtcttggctcactgcaacctccgcctcccagtttcaagcgattctcctgcctcagccgcccaagtagctgggattacaggcacccgccaccacgtccggctaatttttatatttttagtacagacggggtttcatcatgttaacctggctggtctcaaactcctgaactcaggagatcagcccacctcagcctcccaaagttctagaattacagatatgagccactgcgcccagccttttgctagaaaaggaaaaggtgcacatgaccaggttgagaatatcctcttttgcaacaggaagaacagcagccacactgtgtcccatctaaccactatctcaggcaaatcacctaaggttggagcctcggtttcttgtagaattattttcctcaaagcaccatggaaataattcaatgatgaaaatgggtaacaatcctaacccatacatgatagttcccttccctctttcctgcctgctaaatcctccctgcaacacacatccatactgcccttccagcactaattttctgtcttctaattctgtaaaattatgaatgggaaaatcacccaatgacaattgccgaggtatcttagaccttttgtttctaatcaactgaattgccacttcacctcttcaagcgatgtatagcccttagtcaagaccttggccaaaataaggtaattaccttttgacacaacctgggaagtcagagcatccttcctccgccagtctccgcaaagaggagcctcccccaagactagaaatccacacgctcttttcccactccacctcttcctcctagtaaaagtctgtgtgtgccgtttgcatcggcttgtagctggttagtcaaatcaggagatgaacgcaaattctccaagaaatttgaaatctgctttgagcaattcagtttggatctctttcgtttcctttccttaacagcccccaatacttgttccctacctgaggaaaacctaggagggcatggagatggctgtattcccagaccaaagattttccatttaaaggaaatgtggggtctggtttggtctgtttcagtgtcatcagggttttaaacaatcaaataaatctcccttgctagtagatacttcattctctgcccctgctcccaggattcatcaccatagttatcttcaaacatcacctcggtgccgatgacgacatggcacctggccaggtgtgaaggaaagtcaccttaaggaccttccctgtgaagggtataaacttggactcaaatacaacatgagtaggggaagaggtggccacttagggacttctgggccaggccacctggctgagaaatttgccatgaggaatacctagttcacctctacacgtagctataagggcttcttccacttcagacatgtgatgtggcttacgcaacagtcaagcaggaattatgccaatataaaataatcatgcagtgtcatgatgtagctgctcctttagtctcccccactttataattttcggtgccaaccattggatgagctcaagcttgccaaggcacattccctttccctctgtgtgccccacagaggacccagttactgggagaccactcagccctcattgcagttctaacaggtctagcccaaaggccttcaggctagtcaacttcagattactttggaacatgcttgctctttgttttttgagcacattttgaaggagatccagatgcccggggtggagtgaggctcctaaggtacatcattaagctttctcagggaagtaagatcagggtggtatgggaaaaagagcaccagctttggaatcagacaaagctgagtttggaacctggctctaccacctacagcaatgccatcttggaaaaagtgcccatgattcttgagtagccatttccttctctaggatttggaagggtttctttgaaaagcagagacactgtatgtaagttgcctggcacacaatacacattcaataaacaggactcattatattcatctgggtgggttctttctccggaaagtggatggatagccggataggggaacttgtatccaaaaatcttatttcccactcatcaaatcttaccagttactctcttcacattttcttctctttccccttcatcattcaaggaaaaaaaattggcggggcacagtggctcacacctgtaatcccagcactttgggagaccaaagcaagagggttgcttgatcctaggagtctgaggccagccggggcaatatagtgaaaccctgtatctacaaaaataaaaaataaaatagctggatgtgatggcccatgcctgtggtccctgctactcaggaggctgaggcaggaggattgcttgagcccaggaggtggaggctgcagtgagctatgatcacaccactgcactccagcctgggcgacagagtgagaccctgtctcctaaaaaaaaaaaaaaaaaaaaaaaaaaaaccagaaaaaaaagtttaaaaagaagcaactttagcacagtgatcattctagatgtctctttttccaaatgaactggcctcaaaatcctttatccttgcacagtacttacaaagagtgcttgcttacactgtatctataacctcataacaaccccattaaaaatgttttctctctcattttaagaaaaaagaaactgatactcaggacagggtaaattacttggtcaaattcacatagatagaaagcaggaaagcttggtttcaaatcaagatcctctgattcctttttacatgttctgttatattattcaggaaaggaaactctttgaaccattgtcagcctttgatacagatgtttcttgaattggttagcagagaacagagctcttaaagagtgttcataggacaagtaagtctgattggaggaaagagtcagacatggcagtgatctggaatttggagtcctgagaagtaggtaggggtgccagtggtgtttcctaagaagggaagaggtagtatgagagcactcatgtcatgaaatgtggtgtaccaaagaaaggaaacatatctgaaagagatatggaagagtatggaaaatacactttcccaaagttataatttcaccttaggccagtcccatctctctactatattgacttcttaaacctttccaaccttttcatgtccttttctcaggaatcctgtcacccacaagaatgtagcccactttgttcatagactggaaatggctggggacacagcagaatggaagcccatggttccaggtgaggccgtctggaaagagagagtctggtgaagggattaaggaggaaaaaaactctctggtgaccgagtaggcacaggttagcacaatgctaggggaggagcagagggctaccaggtagctgaagtgggtacagcccccagatttcaagaacataaaccctgagggtatttgaagaggaaggagtgtgcagctaaatacagggtgagaatcgaaagattaacagaaacagcatttaagagtgaggacaatcaaaatcagaagtgtcagaggataacaagagaggaggaggctgtttgtgtatacttgtgtacgtgtacttgtgtgtgtgaacagatgacaatattaccacagcagcttcaaccccacttcctgttgaagagtgtttgtatgtcactaaaggtaccattcaagtgatgggaacatagaatgttagaactagaaggaaccttagataatttcacataaattagaactctcaggaattgagtgactggcctaaagtcacacagctactcagtggcattgctagcatgcctctgtacagttcatcgtctttggcacacagagtcagaaaaatacttcagcaaggaatcagaggaaaagaattaaaaacactcttcaaaagccaccaaccaacagcacaaacaagaagacagaaagaagagaggaaaatgttccagaacgcacaagttcagttacgaaaagtaccacacaaaaagacaatttagtcttaggaaaaacagacactcaaagcagaaaaggcataaaatactgtctcagaaagaaatgcaaaaaacaaaaaagattaattttatggacagcttgatgccagagtgtgataataaagtgcatgccataaatatttgattttgtgtgaagaaatacagggaactggtttgtgtgagaggaaggaggtttgggtggtcactgaaatttaaatcaaaaaagaagatgaataagcctagtttgttaggtgaaagcctgcagttgggtgctccaaaaaagaagctttcagtaggtttctcagtgatttataaatacacgtggacagtttcagaaacaaagtatctactagagctataaactagtccttggttttcactcttgccccagaaatggttagaaatgaaatacgtgtttaacaagtatttattaagttctcatcatgtgctaatacctaaaattgcaaaactttaaacaaaatgagattaaagcaaaagttgtaacgttgtaatacacagagatgtaatgcacatgacaactaactaatttgacatctatatcaaatagatataaatgacagaggggtaggtgataaactgaactgtaagactatcaggttcctacattttacatgaagtgataaaatattaactctatgactctaaaaagttaggaatatatattataatgtctaagcaatcacttaaaatgcaaaaagactaacagataaattttttaaaatattaaattaacccaaaaagagccaggaaagcagtacagagaacaataacagatgagacaaatagaaaacaaagaaaaaatatagacctaaatgcaatcaaatcaataattacattaaatgtaaaaggactaaacattccaaataaaagacagagattgtcagaatgggtaaagaagtaagacccaagtatatgctgcctataaaagacacagttttaatatagggacacagataggttaaaaataggaatagaaaaaaaatataccatacaaacagtaagcataagaagactgaagtggctatattaatgttggataaagtagacttcagggcaaaaaaaaaagtattagtggagataaacaaaatgggagcctctggaattaagcattagttttctaactacagaacctaaataatcaaagaaagccaaagtgcggctggggggaaatgtagtacgtacagcaattttcccaaattccctgtagtttattttgaaaataatttaagacaacttggttcaatcatacttaacttcctgagttctcactaggaaagataaaaggaaaatttttgaagaataggctcttcaacaagaagggaaacctggaaacactgagctgtgtggactctccagctttatgtataattgacatgaacggggatgaccaactatttgtttaacaattatttattaagttctcatcatgtgctaggcactgggttaagcatttggtgaacaattcacacctagccccttccctcatattgataaaacaaaaaagccaacaagtcactataccagctataaacagtgataattactttttcttaaaattttgttttcctttgattctaagggtacatgtgcaggtttgctacatgggtgtattccatactagtgggaactgggctcctagggtacctgttacctaaatagtgaacactgtacctgatgggtaattttttaaccctcaaccccctcccaacctcccctcttttggagtcctcagtgtctattatttccatctttatgtacacgtgtacccactgtttagctcccatttagaagtgagaacatgcagtatttgcttttctgtttctgagttaattcacttagcataatgaccttcagctccatccatgatgctgcaaagggcatgatttccttcttttttacagctgcaaatggtgataaatattatcaagaaaatactcatgatgctgagatagagaataccaaatgaaaaaggaaacctgcctaggatagcatgatcagagaaggggatcagaggaggtaacatttaggaagaggctgcaaacagagacaggggtgaggtcaggggaacagtgtgtacaaaggcattcagggaggaaagagctaaggagtttctaaggaactgacatatggccagaatagctggagctcagagtaaggcaaacaaggaccaaatcttgtgggtgagctctaccaaacctccaagggacataaaatccaaccttatataaaattgtccaggggaggagacaagatggctgaatagaaatagctccggtctacagttcccagcatgagcaatgcagaagacgggtgatttctgcatttccaactgaagtaccaggttcatctcactggggagtgccagacagtaggtgcaggacagtgggtgcagcacaccatgtgcgagccgaagcagggcgaggcatcgcctcacctgggaagcgaaaggggtcagggaattccctttcctagtcaaagaaagctgacagatggcacctggaaaatcaggtcactcccaccctaatactgcacttttccaacaggcttaaaaaatagaacacaccaggagattatatcccgcacatggctcggagggtcctacgcccacggagtctccctcattgctagcacagcagtccaagatcaaacttcaatgtggcagcgaggctcagggaggggtgcccgtcatttccgagttagttgtttgattaggtaaacaaagcggccgggaagctcaaactgggtggagcccaccacagctcaaggaggcctgcctgcctctgtaggctccacctctgggggcagggcatggacaaacaaaaagacagcagtaacctctgcagacttaaatgtccatctctgacagctttgaagagagtagtggttctcccagcacgcagcttgagatctgagaacgggcagactgcctcctcaagtgggtccctgtctcccgagtagcctaactgggaggcacccccgagtaggggcggactgacacctcacacagccaggtactcctctgagacaaaactttcagaggaacgatcaggcagcagcatctgcagttcaccaatatccgctgctctgcatacacaggcaaacacaggctgatacacaggcaaacagggtctggagtggacctctagcaaactccaacagacctgcagctgaggctcctgtctgttagaaggaaaactaacaaacagaaaggacatccacaccaaaaacctatctgtatgtcaccagcatcaaagaccaaaggtagataaaaccacaaagatgggaaaaaaacagagcagaaaaactggaaactcttaaaatcagagcacctctcctcctccaaaggaacgcagctcctcaccagcaacggaacaaagctggacggagaatgactttgacgagttgagagaagaaggcttcagacgatcaaactactccgagctacaggaggaaattcgaaccaatggaaaagaagttaaaagctttgaaaaaaaaattagacgaatggataactagaatgatcaatgcagagaagtccttaaaggacctgatggagctgaaaaccaaggcacgagagctacgtgacgactgcagaagcctcagtagccaatgcaatcaactggaagaaagggtatcagtgatggaagatgaaatgaatgaaatgaagagagaaaagaagtttagagaaaaaaagaataaaaagaaatgaacaaagcctccaagaaatatgggactatgtgaaaagaccaaatctacatctgattggtgtacctgaaagtgacggggagaatggaaccaagttggaagggacagtctgcaggattttatccaggagaacttccccaatatagcaaggcaggccaacattcatattcaggaaatacagagaacgccacaaagatactcctcgagaagagcaactccaagacacataattgtcagattcaccaaagttgaaatgaaggaaaaaatgttaagggcagccagagagaaaggtcgggttacccacaaagggaagccgatcagactaacagctgatctctcggcagaaactctacaagccagaagagagtggggaccaatattcaacatccttaaagaaaagaattttcaacccagaatctcatatccagccaaactaagcttcataagtgaaggagaaataaaatcctttacagacaagcaaatgctgagagattttgtcacaccaggcctgccctaaaagagctcctgaaggaagcactaaacatggaaaggaacaaccagtaccagccactgcaaaaacatgccaaattgtaaagaccgtcaaggctaagaagaaactgcatcaactaacgagcaaaataaccagctaacatcataatgacaggatcaaattcacacataacaatattaactttaaatgtaaatgggctaaatgctccaattaaaagatacagactggcgaattggataaagagtcaagacccatcagtgtgctgtattcaggaaacccatctcacatgcagagacacacataggctcaaaataaagggatggaggaagatctaccaagcaaatggaaaacaaaaaaaggcagggtttgcaatcctagtctctgataaaacagactttaaaccaacaaagatcaaaagagacaaagaaggccattacataatggtaaagggatcaattcaacaagaagagctaactatcctaaatatatatgcacccaatacaggagcacccagattcataaagaaagtccttagtgacctacaaagagacttagactcccacacaataataatgggagactttaacaccccactgtcaacattagacagatcaacgagacacaaagttaaaaaggatacccaggaattgaactcagctctgcaccaagtggacctaacagacatctacagaactctccaccccaaatcaacagaatatacattgctttcagcaccacaccacacctactccaaaactgaccacacagttggaagtaaagcactcctcagcaaatgtaaaagaatagaaattataacaaactatctctcagaccacagtgcaatcaaactagaactcaggattaagaaactcactcaaaaccactcaactacatggaaactgaacaacctgctcctaaatgactactgggtaaataatgaaatgaaggcagaaataaagctgttctttgaaacaatgagaacaaagacacaacataccagaatctctaggacacattcaaagcagtgtgtagagggaaatttatagcactaaatgcccacaagagaaagcaggaaagatctaaaattgacaccctaacatcacaattaaaagaactagaaaagcaagagcaaacacattcaaaagctagcagaaggcaagaaataactaagatcagagcagaactgaaggacatagagacataaaaaacccttcaaagaattaatcaatccgggagctggttttttcgaaaagatcaacaaaattgatagagcgctaccaagactaataaagaagaaaagagagaagaatcaaatagatgcaataaaaaatgataaaggggatatcaccaccgatcccacagaaatacaaactaccatcagagaatactataaacacctctatgcaaataaactagaaaatctagaagaaatggataaattcctcaacacatacatccttccaagactaaaccaggaagaagttgaatctctgaatagaccaagaacaggctccaaaattgaggcaataatcaatagcttaccaaccaaaaaaagtccagcaccagatggattcacagccgaattctaccagaggtacaaagaggagctggtaccattccttctgaaactattccaatcaatagaaaaagagggaatcctccctaactcattttatgaggccagcatcatcctgataccagagccaggcagagacacaaccaaaaaagagaattttagacctatattcttgatgaacatcgatgcaaaaatcctcaataaaatactggcaaaccgaatccagcagcacattgaaaagcctatccaccacaatcaagtgggcttcatccctgggatgcaaggctggttcaacatatacaaatcaataaatgtaatccaacatataaacagaaccaaagacaaaaaccacatgattatctcaatagatgcagaaaaggcctttgacaaaattcaacaaccttcatgctaaaaactctcaataaattaggtattgatgggacgtatctcaaaatcataggagctatctatgacaaacccacagccaatatcatactgaatgggcaaaaactggaagcattccctttgacaactggcacaagacagggatgccctctctcaccactcctattcaacatagtgttggaagttctggccagggtaatcaggcaggagaaggaaataaagggtattcaattaggaaaagaggaagtcaaattgtccctgtttgcagatgacatgattgtatatctagaaaaccccatcatctcagcccaaaatctcctcaagctgataaacaacttcagcaaagtctcaggatacaaaatcaatgtacaaaaatcacaagcattcttatacaccaataacagacaaacagagagccaaatcatgagtgaactcccattcacaattgcttcaaagagaataaaatacctaggaatccaacttacaagggatgtgaaggacctcttcaaagagaactacaaaccactgctcaatgaaatagaagaggatacaaacaaatggaagaacattccatgctcatgagtaggaagaatcaatatcatgaaaatggccatactgcccaaggtaatttatagattcaatgccatccctatcaagctaccaatgactttcttcacagaattggaaaatactactttaaagttcatatggaaccaaaaaagagcccacattgccaagtcaatcctaagccaaaagaacaaagctggaggcatcacgctacctgacttcaaactatactacaaggctacagtaaccaaaacagcatggtactggtaccaaaacagagatatagaccaatggaacagaacagagccttcagaaataatgccgcttatctacaactatctgatctttgaaaaacctgagaaaaacaagcaatggggaaaggattccctatttaataaatggtgctgggaaaactggctagccatatgtagaaggctgaaactggatcccttccttacaccttatacaaaaattaattcaagatgcattaaagacttaaatgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactcaagagcttctgcacagcaaaagaaactaccatcagagtgaacaggcaacctacagagtgggagaaaatttttgcaatctactcatctgacaaagggctaatatccagaatctacaatgaactcaaacaaatttacaagaaaaaaacaaacaaccccatcaacaagtgggcgaaggatatgaacagacacttctcaaaagaaaacatttatgcagccaaaaaacacatgaaaaaatgctcatcatcactggccatcagagaaatgaaaaatcaaaaccacaatgagataccatctcacaccagttagaatggtgatcattaaaaagtcaggaaacaacaggtgctggagaggatgtggagaaataggaatacttttacactgttggtgggactgtaaactagttcaaccactgtggaagtcagtgtggagattcctcagggatctagaactagaaataccatttgacccagccatcccatcactgggtatatacccaaaggattataaatcatgctgctataaagacacatacacacgtatgtttatagcagcactattcacaacagcaaagacttggaaccaacccaaatgtccaacaacgatagactggattaagaaaatgtggcacatatacaccatggaatactatgaagccataaaaaatgatgaattcatgtcctctatagggacatggatgaaactggaaaccatcattctcagcaaactattgcaaggacaaaacagcaaacaccgcatgttctcactcataggtgggaattgaacagtgagaacacatggacacaggaaggggaacatcacacactggggactgttgtggggtagggggagaggggagggatagcattaggagatatacttaatgtaaatgacgagttaatgggtgcagcacaccaacatggcacatgtatacatatgtaacaaacctgcacgttgtgcacatgtaccctaaaacttaaagtataataataataaaattttaaaaaatgtccatatagtagaaaaagaagtaacactttccttactcatttacaaggctaaccttgttgccaaaaccacatgaggataatacaaaaagaaatggaaaattatgagacaatctcgctcatcaaatagatataaaaattccaaatccaacaaatagtaatatttacataggccctgggaattattatgaaatagcccaaagcaccttggaaaactggtgtaacaattcattgtcgcttttcatactggaatatgctttcataatgtttttcactggaaaatgtgtacctgactgagatgcaaacaagcttttaatagattgcacttaggtcctggaaacactagatttcagattgtatattgcagaagagaactggccctatgcaaattcgtggataggtaaattttgcctttagaacctagtctgctcctctccctaccctctgcccacaacttcaccttaaatggtcctattacctttccctctggggaaaggctttggggtcagggttggccatttactagctgtgtaatctctcttaaaacagtggcaatatataattccttcagctgttatataatgacaaaataaaataatacatggtagatgtgtagtacagcacttgggaagtagcaggatctaagtcattttttttctgtttgtagaatgaaagatgttgctctatgttctgggattgctggcctttcaggagcagagaggtatgatagaaaataatgccttcaatataaaattttaatgacttacatacagagtaatccatcaaccagattccaaaacatactttgaggggcaagtatctgttaaaggcttaattttatttgttcccagatagttcgaattgcctttgacagtcctttttctatcataaaaaccatctctttcttttacaagtctcagctgcttatatccaacaaaataaaagcatctcattaaacctcagccctctttgatgactcaacaaatattcattcattgaacctattaaatgtaaacatattacttttaaaaaacatatcttcaaggtcattccttggtccatccaagtgagtatcattaaatccatacccaagccatctaacacttgatatcataggagtgcataattcagtcagaaaggtggcctgcaaaagcagaaccagatttccatactcaaaaagaggagttctggcccggtgtggtggctcacgcctgtaatcccagcattttgggaggccgaggagggcggatcacgaggtcaggagatcgagaccatcctggctaacacagtgaaaccccatctctaccaaaaaaatacaaaaaaattagccaggcgtggtggtgggtgcctgtagtcccagccactcgggaggctgaggcaggagaatggcatgaacccagaaggtggagcttgcagtgagtggagatcacgccactgcactccagcctgggcaacagagtgagactccatctcaaaaaaaaagagttctgtttgtctatttcacaactaaataaagcatattgatgcctttgtgaactcccaatgcctagtttcccactttcaattctgtagtagagggggaagtaacagagtgatttggagtatatgacatggctaagacattcatcatagatccatcactgggtaggatgtatatcacatcacaggaagcttttgctcagtttttttcctatagctctttccactgtggggcactccagccataaagagggaagactatcttcttctttttttttaagacagggtgtcactctgtcacccaggctggagtgcagtggaatgatcacaatcacggttcactgcagtctcaatctcccatgctcaggcaatgatcccacctcagcctcctgagcagctgggactacagtcacatgccaccatgcctggctatttttttctattatttgtagagacaagatctccctatgttgtgcagactggtctcaaactcctgggctcaagtgctcctcccacccttgtctcccaaaatgctaggattacaggtgtgagccactgcacccatccctttttttttttttttttttaacattcctagatactaaatttcaaaccacaactagcccaaaattagctctgataacaagtgcttgactggatgactgactgcttatttctatggatactggttctccatgacagttatttggattctgatatgatgcctaattattaacgtactccttgcctgcttcctatcccaaaacaaatatcttaagctccaggaaggcaggactgtgattgactcaggacatccatgctttactgtccttgccactgggaaagaccctcagggaagaggatcaagacttaactgtccctgtgggagctctggagaaatgaacccaggatgtaaggctaatctgatcatctgaatcaccaagtctagacggggaatggcaacctgggatctgagctatgcataaatcaacagccaagagtcacacctggtggcctgggggacttaattaagtagggggtagagttcttaacgatttgggctcttccacatcaccgcagatgacttctgtggtcctatttctaaggcaggtctgtctggttggaggaagagaacagccaataacttgaggacatgaaaaaccaaaatcagaccccccagataaagagatcctgttagacccaagactttctgttaatgatttaattcatattcaacaggctgaatagatcaaatgtaaacatattgcttttaaagggcacttttgtccttccttgatccatgtaagtcgatctttccactggcaagattcactgagaaaaagaaagagttgacaatgcattctaaataattttgacctcttcttggttgtaccccatccagtccagttgtccagccactcattagataaactagttcagcaatgactaaaattgttcatcagccctgctacctaagtagaccctatatcctcacagccatccttactcctccctgttataaaatatctccttttcctccccttagaaacagagatagagtaccagatgcaaatgttatgatgaaatccagctcaagtggtagtgatctgtccagttttgtaaaggcaacacctgtgcatactaggaccagtctctagttctgaaacccacctacagctttaattatgtcacctactggaatcttccttcagattctaccttgctcctctactggcttccagagtatgagtccttatgaccacagtcttcctctgaggtgacctccagcctctgccaagctcaactcttgccaatgagccaacgttcttagccccaactacacgtagactcagctcagattctacccaagtccttaagcgtgacattccccaggaaatataaaaggtagaatgcactgtacctaaatgcagcccctaggacgttcatttcagtaacatcttcatgttgcaatactcatgagagggctttgatccttcacaccaatcgctaataaaaagctctcagctgggcgcggtggctcacacctgtaatcctagcactttgggaggccgaggcgggcggatcatgaggtcaggagttaaagacaagctggacaacatggtgaaatcccgtctctactaaaaatacaaaaaattagccaggcgtggtggcgggcacctgcagtcccagctactcgggaggctgaggcaggagaatggcgtgaacccgggaggcagagcttgcactgagccgagatcgtgccactgcactccagcctgggcgacagagcgagactctatctcaaaaaaaaaaaaaaaaaaaaaaaaaaaagaaaattagccaggcgtggtggcacatgcctgtaatcccagctactcgggtggctgaggtaggagaattgcttgaactcacgaatcagaggttgcagtgagccgagactgtgacactgcactccagcctgggcgacagagtgagactctgtctcaaaaaaaaaaaaatgcttagctctctgggcagccagcccattctcacctttacctaatataaatctgtaccagggtgagaatccaggaagcagagggtccgaaaatgtgcttctttcttctaaaaaggaagacacatattccccagatcaaattaaaaaaataaatccaggagaaaatacttgctctttcctaacttatattcataaggttctcttagtggacttctgtagccttagtgaaacccaaactagaatgtttagcaaaatccccaaatgtatcctattttcaatattttcagaactcaatatttttagaatgtaaaattgtgttttataaagaaataattcatttgtcatgtacattgatgacatgaaatgtacataaaattcagaaaactgaaattatcagttaacagggaggttaatagaattatttttacagcaatttagattcacagaataattgggaagaaggtacagagacttccaacatactcccctgaccccacacacgcacagcctcccctactgtcagctctccctaccagagtggtgcttgttacaattaatgaacctatattgatacatcattatcacctaaagtctatcatttacattagggttcactcttggtattgtacactctgtgagttctgacaaatgtataatggcatgcatcagccaatgtagtatcatatagaatagtttcactggcctaacaatcttgcgctccacctattcatgcctccttccccctaatccctggcaaccactgatctttttactgcctctatagtttaccttttccagaatggcatacagctggaatcatacaacaagtagccttttaatattggcttctttcagttagtaataagcatttcagtttccttcatgtcttttcatggtttgatagctcatttcataatattcccttgcctggatgtaccagtttatccattcactaactggaggtcatcttggctgctttcaagtttttgcaattctgaataaagttgctataaacatctgtgcacaggtttttgtgtagacataagttttcagctcttttgagtacattccaaggagtgcaattgctggatcttatggtaagagtatgtttacttttgtgtgaaaccaccaaactatcttccaaagtggctgaaccattttgcattcccaccggcagtgaacgagaattcctgatgctccacatcctcaccagtatttggtgttgtcagtgttctggattttggtcattctaataagtatgtagtggtatctcgttgctttgatttgcatttccctcgtgacatatgatgtggactatctttttgtatgcttttatgccaactatgcatcttctttggtgaggtgtccaagtttttgcccatttttaaattgtggtgtttgttttcttattgttgagttttaagagttcttcgcatgttttgggtaactgttctttatcagatgtgtattttacacacatttctcccagtctgtggcttgtcagattctcttaacattatcttttaccaagcagaaggttttaattttaatgaagtttagcttatccatttttttcatgaatagtgcctttagcgttttatctaaaaagtcatcactgaggggtgttgtgcttccagacagtgctgctgcgtgctagtgcccgggtccctcaaaaaagaatcttttaaaattttttaaataataatgtcatcaactaacccaaagtcatctagacattctcctatgttatattctgagagttttatatctttgaattttacactgaggtctgtgatccattttgattagtttttgatgagggtataaggtctatgtcaaagttcaactttttgcatgtggattccagttgttctggtgtcaattgctgaaaagactattctttttctactgtattgcctgtgttgttttgtcaaagatcagttgtgtatttctgtgtaggtctattttggggctctctagtctattccactgatctatttgtctgttctttcactgataccacactgtcttgattactatagctttatattaagtcttgaggttggacagtgtcagacctctaactttgttcttttccttcaatattgtcttggctgaatgactttttaaaattaattaaaacatttttggatagaaactttgccactggtataattccttggcttatgaaacatatatttatgtatcttaatttttaatgactgagaaatgtgtattattctttgccatcacataaaatgaccccagattgtattatcttttagtggttttactatttctataacctattccttttgttctcaccccttcagttcctccaagcctctctccttcataccatgtaattaagtgggaatcagtctaggtttccaggggaaccttattttacagttaagtttaagatagctgatctaagagttcctgaggagaattttttgtctcttctgtggaatgaattatcctcaaaagttctagattcagaggcataatccaggcagccatgatacccaagagccttacgtcaagttgtgaggcactattctgatacaactataataatgtcaacagtaattagcagctaaatattaaatgcatcactcttcaaaaattcagcttctgggaaattttccccttcctttcagttttccccccagttcacttttaaaaaaataagcaacttgagctccctctgaacttctaaaactatttaatacatgtcactcttaaccatcacccaaacctgcatctatcagtgacacattccccctcaaatcccccacccagacacctgcaggttacttttcaatgcatctttgcatctcgaaatctgggaaggactgtagcttgggaaaaattacacagttgagggcttagaattgatctaatgaaagttgataagacttatttgcctgggtcattgatttgtagccaagcccacttcaatgagtccagtttctatgttatcacttttcacctttcatcaagagcaggcactggagggacaacggaatccacaaagccagtattgttgactgtgattaaaaagagtgtgggattcactttctcctacacaagggggaaaccgaagctgactcaactaaaaggagggcaaaaggagtcctggccagtgtcacctcacctggagagaggatccagagaagactggggtttccattgtgcagtgtctggggaatgctagaagaacagggctcttattgtttcacttccagcacttaactaccaaagatgagagcttcctttctacttattacccagagtccagagtcactgggagaggtaatcagatcatactgtaacatcctttgaactccctggagagcttgtgctacagtaaagcatgtgggatccttatcaactctaattctctggggtcttcctctgccatcaatttcacctgtgcagagtcattcaaccttgttcagtcattcattctttgctgctgctgtttgtttcaagtccattagaagctcattccaggaagcagaaactaacatagaaaccagtgtcagcctcctgagctccaaagcacacctgacccagggatggggggtggttagttagcatgaagtcaacctctttccaaatactaaagtaatcatagtacaaacggattctgtaattaaaaccatcaaaagatgccttggtcttcagtcagcattattgtgcccacattaaccttccccacaagcaaaaacactactttttcctctctgttttctacattcttcttcattaactccaaatcgagagtttcattatttttcaaatcagaaaggagggtttacaaaaggatctgcagatttgaaagatgctgacaagaaagcaaacatgaatggaaacactactttttaaaaatgtatttccttccaggaagagctgagcagtacaggcatgtggcagaataggaggtcatttcaaaatatatcatgttgagcttcactcccaattatgagcagcaattctgtttgataattacctgggcaatacggaaatggatcccatttacaagcaaacaaaaatgtgtttcactgcaatatgctccattctgaaaacgttcccccttttaccaacttaataatcataccattctctacataagatttctttttctcactcacctctcctctgtactgcttggattctctcccatctggccaatgagtctaaaatgcagggacttatatcttaatttcatttttcaaaataagacttcgctcatgcctgtaatgccagcactttgggaggccgaggtgggcggattacttgaggtcaggagttcaaaaccagcctgaccatcatggtgaaaccccatctctactaaaaacacaaaaactagccaggcgtggtggcgcaggcctgtaatcccagctacttgggaggctggggcaggacaatcgcttgaacctgagaggcggagattgcagtaagccgagattgcgccactgcactccagcctgggcaacagagcaggactccgcctcaaaaaaaaaaaaaaaaaagctcaaaagctcaaaaaggtcaaaacctcttaacatcataggaatagatgaatactttcttgacaatgttacatatgaatatacgtagaaacaatattgcctgtatataaaacaaaaacatatatattttctctgttaaattcttaaataaaacaaggccatcaactatcactatttctaactctgtttaatatgattttggaagcattattctaatcaagtagataggaagaaaaaattagaagtataacccttggtgatactaaaaattcattagaaaatgtataaataataagaaattgaaggtgcctaggtacaaaattaatattcaaaaatcaagtatttgtgtatacaaataacatctgcttagaatttataatgaaaggaaagatcccaattacaatagtaacaaaagataaagcacctaacagtaactgaaaaaatacatacaagagaattgtaaaatgctactaaaggtccacccctccaaaaaaaaaaaatatctttagcatatgaaaaatagtatgtgttcccagataggaaggatcaacatcataaagacattaatagttcctaaattaatctaaaatgtatgtcatcctcataaaatattaaatattatttggaactacacaaaattatcctaaaattcatttgaaaaataaatatgcaagaattgccaggagaattctggggggaagatagtgaaagaagtctattctactaaaatttagctaattaaaacagtgtggcactcattcataaagatgtcaacagaatagactagaaaatcaagaaaatttcttaattcatacaggagtttttttaagataaaggtggaattttaaatcagtgcagacaagatggatcactcaataaacagtgttagacaactgggtcttcatctcaggaaaaagttggatttgtattcttaaataataaaataaaatccaagtgcatcaaagatttaaatgtgaaaaattaaccataaaaatattagaagaaaacatggaaaattgtttttatgaatcttgtagtggggaaaaccctttctagtgtcccagacactgtgagtggtctgttcattataccagttgtccactttcctcttctttccagagaaacagaaccccaattctgttcagggtgagaataagcctaaccccaaaggatgggtcatactggctgtcatgttctccactttcccacactcccttgcagctacagtgtctgtgtggcttggtttgggtcaataagacataactggaaatctgatgggaaaatccttgctttctcaataaagatggatagacatgctggtgtcccatctcctttgaaaggttagttctgtagaaatcacctagggatcagataagagaggccaagagagtagaataaaagatattagccctgacattgttgaacagctgaaccagtgctatcaaccacctattcctggaattctcactatgaaattttaaaaataaaatcctatttacttaagccactgtgtttagagttttagtttcttgcagttgtgtgattcttggaatcctacctgacacaccatgaatgccataaaattcagaaaccctaaaggaaaagattgagcaatttgacaacatgaaaaattttttaattctttgaaaataaaaaggattccaaaaagaaaaaaaaaactaatataagatctttttcatttacattatagtccagagctaatatttttactatataaagagctcaccaaatataaagtaaaagaccacagtccagcaggaaaatgggcaagggatagaaacagtgttcatcaggaagtcctaacagagcaatcaggtaacagaaagatataaaaggcatccaaataggaaaagaagaagtcaatttatctctctttgctgatgatataactctatacctagaaaattctaaagactctgccaaaagactcctggaactgataaacgacttccgtaaagtttcaggatacaaaatcaatgcatgaaaatcagtagcatttttatacactaaaaacattttcgctgagagccaaatcaagaatgcaatcccatttacaatagccacacactcaaaaaaataaaatacctagggatacatttaaccaagaaggtgaaagatctctacaatgagaactacaaaacactgctgaaagaaatcatagatgacacaaacaaatggaacaatacatgctcatggattggaagaatcagtatcattaaaatagttatacttcccaaagcagtcttcaggttcaatgtcattcccaaactaccatgtcatttttttgtatatgtgctgccgaagcgagcataccaatgtcatttttcacagaattagaaaaactattctaaaattcatatggaacaaataaagagcctgagtagacaaagcaatcctaagaaaaaagaacaaagctggaggcaatcactttactaaacttcaaactatactataaggctacagtaaccaaaacagcatagtactggtacaaaaatagacatataggccaataaaaaagaataaaggatccagaaataaagctgcacacctgtagccatctgatttttgagaaagtcaacaaaaaataagcaatggggaaagggctccctgttcaataaatggtgctgggatagctggctagccatatgcagaagaatgaaactggacccttacctttcatcatatgcaaaaaattaactcaagatggattaactatttaaacttatgtgttcatcaaaaaagaaatgcagatggctgttcatcacatgaaaagattttcaacctcactcaaaataaataataaaataataacaaaataattaaaactataggaatatagcattcctataaatttgtctgatagagatttaaaacaaaatactgtatttgtggagaaacggatactctcaggcatttttgttagaagagaaaaccgaaataacttccatggagagcaacttgtcaatgtcaccaaaattacagatgccaccccagcaatcacaacctgtgtatacaattaaagggctgacaataatctaagtttctgtgaatatagggcttgttacttaaattataataataattatgcagctataaaaaatgaagaggttctatacgtatagatgaagaacaatcttcaagatacattgttaaataaaacaaaagtcaaagtccagaatgtgtttgtcatgcagccaattcttctaaaaatatattaaaagggagtgagcggagattgcgccactgcactccagcctgggcggcagagcaaggctccgtctcaaaaaaaaaaaaaaaaaaaaaaaaaaaaaaatatatatatatatatatatatatatatatatatatatatgtaaagggaaaatatgttattgtacatttataaacttccttaatagaacacacaagaagctggtaagggtggctgtctctgagaaggagaactgaagtgctggtgttcccattatctgtaactataatgaaccaccctgaagcttagtggcataaaaccacatacattttctcatgctcacagattctgtgggtcaggaatttggacaagacgcagcagggatggcttatctctgcccattgatgtctggagctccagctgagaggaagtgattggcagtgtgtgactccaatggcttgcggctggaaaaatctgaaggtttcctcactcgcacgtctgggctcgggctgcgataactcagctggcgtttttaaccaacgtgcctacatgcgacctcgacacggagcaggggcatcctcacagcatggcagcctcagagcagtcagaccccttccgtggtgggctctgagagcaagggttccaacgagaagggcagatcagcatctgccttttatggctagcctcagaagtcacagagcctcccttccagcctgctccgttggttgaagcagtcaccagcctgcccagattcaggaagcagggacatagaaattgaaggtcatcaacttgctaacagttgttatccctacagagtggaatctggggagattttcattttccccattggcctacatttattgcctaatttctctaaacgagcaagtacaaactgtgttataagtgttttggaaaaatcatagatcttgcttaagattctcttccgtgcaacacagcaaatctatgtttctcatgcattttccttgtgagttcgatacagcgacagagttcagaaatacactgtatattttccataaactctttctacacagcgatgcatgacctaagaggcatcaagattacctgtgactgcatgagtgaaaggacatctcatttatctgcagaatcagggtcttgcaggcccagaagcactgcttccattttcttcacttgggccttctccagcggtgcacagagctctgtgggacccacaccctgcgtccttgtccttgtcacatgagggtagtgcaagcccaagagaacgagtggccggcctgtctttgtccttgagcctggctgtcctgcctttactggaagcttctctttctctgtctcttttctcctccttctacttttattctttgctctctgctcaccccctttaccctctctacatttttcctctttccccaattttctctctagctctctgtactctctcctttcatttactccctgcaacaatcataccacctccctaagcacgatacaaaaacaggtgagggaaggactggatgaaattaacaaagcaggtttacatggctctgttgccttttctcagctaccagttttggttggttggtttttccatctcaatctgtttcattttatctgtctcatttccttcttttttcttgtaataaaatatacacagcatgaaataaatcattttaaccattttgaagttcaaaacatttgcacagttcagggcactaagtacattcacattgtacatcaccaccacccgtctccagaactcttcatcttccaaaacagaagctctgtgcccaatacataaccagcccctcactctccacacacccaccccatggcagccaccattctactttctgtgtccataaatttggctacattaggtacctcgtataagtggaatctcatgatatttgtccttttgtgactggcttctttcactaaaataatatccttcaagcccatccatgtgctaacatgtgtcagaattttcttcctttttagggctaaactttattatttatctattgtatggatgtaccacattttgtttatttactcttctgtcaatggatacttgggttctcaggtaccattttttctcaaacaaggtgacatgggctttttcccttccctcacctcaaagaaggggttccctccccctgctccttcatcccagcccacaggcaggtccgctctccactgcgggagctcctcagaattggggccagccaccctcccccgacctttgtccaccctcttcctgattaatggcatctatttctatggcctttggtaccctccagggctggtgatgccaggcttctctctccaaagacaacttctcagagtcccaaacctcacacccaaccaggtatttcattgcaccacttacgactatctcatcacatggtcaaacccagaaatcttgatttttcccacccatccacttgcagaataaatgtcatcagaacctttctgtaagtctgacaggagactagaggtttgatcttcagggaaattaaagcttgctgctccagctccagacaccacacatagagaaggatgagagggagactcagagctgaaaagagggtaattcatagaaagtctgtacactctatggtaggaagcatatccagcactgctaccagaaaaataggaccagtccccaggcaagaacccccaggcagtttcgtcactggagaaactgagggtgtccgcaaaagtgaccttcagacatggctgtgtggccacttttcctcttgagaagcctcctggtaaccagtggcaaggccgagccatgcctacaaagctttgagtcatgcagtagggcctcactcttacctgtaaataaacagccaaggatcaacaggcatttaaggaaaacagcaaggtaagcagattatttagaaactgagaaataaataccaagagcagagctaaaggagttgaagatatttgcctctgggcagcaaagttgttgaatgggaaagaactaatatgttcaattgtgcattttttagtgctgtttgatttttaaatatgtttgtgtatatatatacacatatataggtaaaaataattttttaagagacagggtcttgctctgtcacccaagttggagtgcaatagtgctattgtagctcactgtaacctcaaactcctgggctcaagcgattatcccacctcagcctctcaagtagctgagactacaggcacgtaccaccatacctggctaatttttttaaaaaaatttgtagagtttcagtctcactatgttgctaactcctggctttaagagatcttcctatctcagcctcccaaaatgctgggattacaagcaagagccactggacctggccaggtaaatataattttaaaaaaagaaaatatgagtaccgccaacaacctatctgctcaagaatggagaaatctggaaattctctctgattcttcctttttttcccatcctacaaaactagtctatcactaagattcacccatttaacatccaaaatatttcttgattcatccacttctttccgtctttgccaccaccgtcctcaaatatgccaccagcacctcttcctggttatacacagccccgtattggtctctttccttccaaccttaccccttctcaaggtaatacacttattcttctcaaggcaataaaactgatcagcataaaaggtaaatcaggctgggcacagtggctcattcccataatccaacatttggggaagctgaagtgggaggatcacttgagcccaggagtttgagagcagcctgggcaacctagtgagaccccacctctaaaacagaagaagaagaaaggtaaatgagatcatgtaaaaccctaaaatgtctatcaccctcaaactgcaacataaactccaatagttacccctaaggtcctgctggatctgacccccacctacctgttcaatcccagcttgatttgctccactctcttccttgctcattaagctccagcctcattattttgctttcctccaattccaaaaaaaaaaaaaaaagccaagatctttgctgcttcgggcctttacctatgtcatctacatgcatggagatgtggttgcctttctcctcatccaacaggtcccatcccatccgagtctcaacagaaacatcacctccccagggagaccgtctccaccaacctatcaaaagtaagtcactcctgtgatcgcctatttcatcttacttgcttccttcatatcatttttcattgtattatctattcatttgctttatttttctgctcctccagcagaaaattagcaccataaaggcaaggaccatgccctatctctagtatctggcacagcacctgtttgaataaattactttctacagtgaatgcaaatatcatttgcatctctccaggcagttttccaggttgtactattcttcggaataagcacaacaaacttgcttaaggattaaagatgtctgacaacagttgcttcttagtgtgtgacacagcatcagccactctccaaactgctaagacgtctcccttgtggggctcatgcaacagtttatctatttatattggagggagtagagaataggaaaagtacacagacaaattgattcgggggtggggaagaatgctgtttttaaaaagtgatcaatacatcttccttagatagtagggaggaacccctatcttgacaggctttggggagatagggtcaaatgccaatttctacttgaatcacagcagtatgggtgccgtaacagcctagcatttcatcattatgatgactattaaaatggtaataatgcaagagagcagggaaccagacgatgaaaagggataggcagctaaatacctcactgtgttcttcagacattttagtcatagctacaccataatcattaaaaagatctgcaggatgttagagtaatgctggtgatggggcatttgcactttctttgacctgaaaagaactatctattttgttaccttaaactttaatccctgtcacttcttctttctttcttttttttttttgagacgtagtttcgctcttgttgcccaggctggagtgcaatggcacaatctaggctcactgcaacctctgcctcccgggttcaagcaattctcctatctcagcctcccaagtagctgggatcacagatgcatgccaccaggcccggctaatttttatatttttagtagagacgggatttcatcatataggtcaggctggtctcaaactcctgacctcagatgatccacccgcatcggcctcccaaagtgctgggattacaggcataagccaccatgcccagccatccctgtcacttctataacccatcttgtccaaaatcatgatgacttatcttaaggactattggacacacatttgaaaggaaaggtgtccactgagatgatgttgagatcggaaatcatacagtcctctcttccctcccacttataatggaacagaaacccaagtccttccttgaggagaaggaggaaccaaatgattcctcaacatcctttccagctgtaagattcaataactggatgatccatcatttcctgaaggaacttagcctaggagattggatggtagtaaactgtggaaatgtcataagcctcatcatacctgctaagcagtcaaagctatacatgagcatcctacaaaaagaaaagcccagaagagagaaagagaaaatataaaattttatatcagcaaacaccaggaggatgaaatcacactcattatttgctcattaagcaaatattcttttagcactcactatgtaactggcacagtgcttgaaactggaggcagatatgtaaaataaggccctgggctcaaagagtagtggagatggccttcaaaataaataattatgcacagtctcatgaatgctgttgtgagagtcagtactgcaaagttctgtaggaatccagaaaggtaagtagctctactgagagaataaagaaaaactttatcaaagagatgacatttgagttgaactttgaagtatggataggagtttcctggtaatttaggagaagggattgcaagaagaaggaatggcatacataaaggcttaaagacatatttggagtgagaggaccaaggctgagtttccctgtctgccctggtatcaaggcagacaaggaactgatttaaagtgtactgtacgccttgctgaaaccttagatttttttcctgtaaacaatggacataattgaatgacttttactaagtgtacttcatgatcagatttcttttgttaaaaaagaattctctagtagaattgccgaaaattaggaagggataaagtcaaggaaaccagtcacgaggctactattaataatccagccaagaaatgagggtgcgccttagcatataaaaagatgttcaacttcagtataatgagagaaattcaagctaaatccacactgagatacaatttctcacctatcaagatagtaaaaattcaaattcttgagaacacatgcagttggtgaggatttagataacaggctttcttatatattgctggttggagtacaaaatagtacaactcatatgggctgggcgcagtggctcacgcctgtaatctcagcactttgggaggctgaggtgggtggattgtttgaggtcaggagtttgagaccagcctgaccaacatggtgaaaccccgtctctactaaaaatacaaaaattatctgggcgtggtggcaggcccctgtaatcccagctacttgggaggctgaggcacgagaatcacttgaactcaggaggtggaagttgcagtgagctgaggtcacatcactccactccagcctgggcaacaaagcgagactctgtctcaaaaaaaaaaaaaaaaaaaaatagtagaactcatacagaggagaatttggcaatttcctgtgaaacaatgtatgcccataccctttgatctaactatcagatttttaggaatttaccctgaagatacttctacaaataccaaacaatgtatgtataagattatccaactgcagcattatttgtattaacaaaataatggaaatactgccaaatgcctattcaaaggagtctgattgaatagatgatggtagagtcacacaatagaatattatgcagctatgaaaaagaatgtgaaaaatctctataaattaatattaaatgatttccaggatatactattgaatgaataaagcaagatgcagaagataatatagaatataccaacttttgtttaggaatgaaaaggaaattaaaaatgtgaccacacatatttgcttatttttttaaaaaaagaaaagaaacacaggaaatacatttcagaaataagtgaaaaattgttaccaagaaaggatgggtgaaaatgagacagaagggataaggataagagcaatggggatatagttttttaagcaaagcctaatgttgaacacaaatataaaaagttaattgaacttagagataaggtaagcatgtcccctctctcatcactgctttcaacattgtaccgaaagtcctagctaatgaaataagacaaaaaaagtaagtaaaatgtatagattgagagggaagaaatgaaactgtcttggttcccagatgacatgatcatctatgcagaaaatctgaaagagcaataataacaacaacaaaaactcctggaactaataagcaattatagcacgtttgcacaaaacaagggtaatatacaaatgtcaatagctttcctacacaccaacaataaacaagtgaaattagaaattaaaaacacattaccatttacatttacattagcatccaaaaatgtgaaacaggtataaatctaacaaaatatgtaaagatctatatgaggaaaactacaaaatgcaggaaaaatataaaagaagaactaaataaaaggatagatatttcatgttgatgaacaggaacactcaatattgtaaaggtatcagttcttccaaatttgacctacgaagtcagtgctatcccaaacaaaatcccagtaagttattttgtagggattgacaaactgattctaaagtttacatagagaggcaaaaatcccagaataatcaataatacaatactgaaggaggaaaacaaagccagaggcctgccgctgtctgactttgagacttactctgaagctacaggaatcaagacagtgtggtattgtgaaagaatacacaagtggatgaatagaacagaatagagaccccagaaacagacatatagagagacattttttacaaaggagcaatgataatatgatacagcaaagatagtcttttcaacaaatggtgctgggacaactgaatatccacatgccaaaaaaaaaaaaaaaatctagacacagactctgtaccctttgcaaaaattaactcaaaatggatcatggaccaaaatgtaaaacacaaaactataaaattcttggaagataacgtaggagaaaacctaaataaccttgagtatgtcaacacctttttatacacgtcacccaatgcacaatccatgagagaattcatcaataagctggacttttctgctctgtgaaggacaatgtcaagacaatcagaagacaagctatagactcagagaatatatttgcaaaggagacgtctgataaaggactgttatctaaatacaccgaaaaacctcttaaaattcaacaacatgatttttaaaatgggcaaagtggaagggggaaatgaagagaggtgggtgattgggtagaaatttacagttagatcaaaaaataagttctttttttttattatactttaagatttagggtacatgtgcacattgtgcaggttagttacatatgtatacatgtgccatgctggtgcactgcacccactacctcgtcatctagcattaggtatacctcccaatgctatccctccctcctccccccaccccaccacagtccccagagtgtgatattccccttcctgtgtccatgtgatctcattgttcaattcccacctatgagtgagaatatgccgtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcaacatgatttatagtcctttgggtatatacccagtaatgggattgctaggtcaaatggtatttctagttctagatccctgaggaatcgccacactgacttccacaatggttgaactagtttacagtcccaccaacagtgtacaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgtttttggctgcataaatgtcttcttttgagaagtgtctgttcatgtccttcgtccacttgttgatggggttgtttttttcttgtaaatttgtttgagttcattgtagattctggatattagccctttgtcagatgagtaggttgcaaaaattttctcccattttgtaggttgcctgttcactctgatggtagtttcttttgctgtgcagaagctcttgagtttaattagatcccatttgtcaattttggcttttgttgccattgcttttggtgtttttgacatgaagtccttgcccatgcctatgtcctgaatggtattgcctaggttttcttctagggtttttatggttttaggtctaacgtttaagtctttaatccatcttgaattgatttttgtataaggtgtaaggaagggaaccagtttcagctttctacatatggctagccagttttcccagcaccatttattaaatagggaatcctttccccattgcttgtttttctcaggtttgtcaaagatcagatagttgtagatatgcggcgttatttctgagggctctgttctgttccattgatctatatctctgttttggcaccagtaccatgctgttttggttactgtagccttgtagtatagttagaagtcaggtagcatgatgcctccagctttgttcttttggcttaggattgccttggcgatgcgggctcttttttggttccatatgaactttaaagtagttttttccaattctgtgaagaaagtcattggtagctttatggggatggcattgaatctgtaaattaccttgggcagtatggccattttcacgatattgattcttcctacccatgagcatggaatgtttttttttgaaaggatcaacaaaattgatagaccgctagcaagactaataaagaaaaaaagagagaagaatcaaatagacacaataaaaaatgataaagaggatatcaccaccgatcccacagaaatacaaactaccatcagagaatactacaaacacctctacgcaaataaactagaaaatctagaagaaatggataaattcctcgacacatacactctcccaagactaaaccaggaagaagttgaatctctgaatagaccaataacaggagctgaaattgtggcaataatcaataatttaccaacaaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccaggcagagacacaaccaaaaaagagaattttagaccaatatccttgatgaacattgatgcaaaaatcctcaataaaatactggcaaaacgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggatgtatttcaaaataataagcgctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagacgacatgattgtatatctagaaaaccccattgtctcagcccaaaatctccttaagctgataagcaacttcagcaaagtctcaggatacaaaatcaatgtacaaaaatcacaagcattcttatacaccaataacagacaaacagagagccaaatcatgagtgaattcccattcacaattgcttcaaagagaataaaatacctaggaatccaacttacaagggatgtgaaggacctcttcaaggagaactacaaaccactgctcaaggaaataaaagaggatacaaacaaaaaataagttctaatgtttgacagcacactggggcgactgtagttagcaaagatatgttaaattgctgctatgtagaagagaggacttgaaatgttcccaacacacagaaatgataaacacccaagacgatggatactcgaaacaccttgacttgatcattccacattctgtgcatgtaaaaaacattcacaggtaccccatcgatatgtaaaaacattatttatcaatagaagaaaaaattaatgagacagttttcaccatattgtaccctctaaattattaataacatttttgtgagagcaaaaagtatttgctatcatttaataatgtagttttaaaatataatttcatcttcatcccaaacttttcaattttttatttctgcatgttttatataataaataatgtattagtagagtaatatattaaaatcttcacaagtaaataaatatgtatatatctaaaaactgggcaaaagacttaaatgatacctcaccaaagaagatatgcagatggaaaataaaaatatgaagagatattccacatcatttatcattagggaatcgcaaattaaaacaacaataagatagcactacacccccattaaaggagtcaaaattcaaaacaccgaaaacaccaaatgctggcaaagatgtagagcaacaggaactctcattcattgctgctaaaattgcaaagtggtatagccactttggaagatagtttgatggtttcacatacaactaaacatactctcaccatatgatcgagcaagtgtgctccttggtatttatccaaatagattaaaaacttatgcctacacaaaaacctgcgcatggatatatattgctataaacttatgaagtttaaaattaaatttgaaattgctttattcataattgccaaaacttggaagcaacaaagatgtccttcactagatgaatatataagtaaactgatgcatccagacaatagaatattattcagccctaaaaagaaatgaactatcaagccaataaaagacatggaggaaacttaaatgcattttactaagtaagaaataccaattggaaaaagctacagattacatgatttcaactatatgacattctgggaaaggcaaaactatagagccaataaaaagatcagtggttgtcaaaactatagagacaataaaaacatcagtggttgtcaagggttagggttaaataggcagagcacagatttctagggcagtgaaactattctgtatgatcccataatagtgaatatgtatcattatacatttgtcaaaactcatagaatgtacatcaccaacagtgaacccttatgtaaactctagaccttggatgataatgatgtgtccacgtagattgatggattataacaaacgtaccactctggtgctggctggtgattgtgaaggaaattgtacactgtgtgtgaaaaaaagtatatagaaaccttctgtgcccttcatttacttttgctgtgaatctaaaacttctctaaaaaatcaagtttattaattttttaaactaacctaactttatctgaattcaatagcatatccacataggaaaaccaagtaattttcaaagaccatattctatatatcactagtaggacatatattctatggacaaactgcaaataaatataaattttacttagtagtgtattagtagtagtaataatggtattatattctgaaactattttatatatattgtaacataaaacaaataagtaaaacaattaatattattggagccaagattttcactgtgaaagaaaaaataaaaatttaaaattttttaaaggccaagaataaatctgaattataattatcggtatgaattcatgatttgtaaaaatatattttttatcactttcattgaaagggcttaggtgtaatgacacaccaatagcaatgagcacatccaacaaccagatgttggtttctaaacatcattctccactaaaaagaacaagggctccaggtctaggactggagtgcaagttgagcctgggatctcttccctccctctccaaaataaagaaggacacagagtccaagggtcacggtaaaggttcacaggccctggcttgaagggtcagtccgggcaatttataaacattgattcagcgaggatcatgagaaaatgctgaagccactgggtaactttgttgggcatcaggattttcatacaacctgaaactattactcaaggattgcatactaactacgaagggagaaattacttttacaattgagagatataattgatattttcctttctctcttccaggcttttcttttcctaggctgctaactaagctgctatctgtggtaactttacactgtgtcagtctaactaagcaggaaccatgcctcccaaaattcactcccctgcatgtcccagagtagagctggtcaaattaggcatttgtgagcgatctggaaggtggacatgaaacagcatggtcaatgaagtaacgttttctggggcttaaattccactgagttaagggtcattccagtcatctgctcttccatctagttcctactgcttccatttctaggaagtgagatcaaagttctggcttagggaatagaagtacaggattagttttcttatttccccccttaacttccctcatcataccataacttgtcctggaagccatgaagagaaaaataacacctcttatttaaaccccaacccaacccacatgtgggatccaggaattacttaaaggccttatgtgcttggtcaaaaataaagaagcccatttaaatatttgtgacatcagtggagcagacactgatctgacagatggacaagactgtaaactgctatgtcccccaaagttcatgtgttgaaattaattgccatcattacagtatgaagaggtgaggcctttaagaagtgattaggccatgagagctccatcctcatgaatggattaatgcccttatcccaggagcagttagtcatcacaggagctgagtcctgataaaaaccacaggtgtggtctgatttcctctcttcatctcctgcaattgcttctgccttctgcccttccaccatgggacaaccctcaccagatgccagtgctgtgctcttggacaccccagcttccagaactgtgagaaagaagtttcttttctttataaattacccattctgtggtattctgttatagcaacagaaaacagactaagccagtggcatttttagtataatatgccctataagcttagcagaaaaatcactcggcccaccatgttagtgactcatgggtgttaatagtgacaattcaaaactctactggggatacagccaatttctgcttatccacaaatagatgattactttgccaagtatttgcacagcaatctgttccagcttgggctaccacagtaggccccagcttgggtggggtcagccctgtataaaggaatgtggagaggccaggcatggtagctcatgcctgtaaacccagcactttgggaggtggaggcaggtggatcacttgagttcaggagttcaagaccagcctggacaacatggcaaaaccctgtctctacaaaaaatacaaaaattagccagccatggcggcatgtgcctgtagtcccagctgctcgaggggctgagatgagaggattgcttgagcccaggaggaggagatggcactgagtggagattgcaccactgcattccactctgggcagcagaaccagaccctgtctttaaaaaaaaaaaaaaaaaaaaaaaaaggatgtggagtgcaggggtggtggtgattgggagtagaatatagagtgacgattaagggggtattattttcatcccagcataggcctgattatattctaaggtgaaatgttattcatctgtgccactccatatttactgagcatctactgtgattgcaacactgtgtaagccagtagggattcaaaagctataaaatagaatcccaacttcagaaaccttaacttgggtttaagacgcaaaccatagacacaaaaattattgcatcaatacccacctgcaatgataaatgcctgagcgtgctgaacagacaggagagagtttggaagagaaattatccaccatgtaatgcaataggcaaatcacaggactgacggaattctctagaaagaaatgagaaagcagtaggagcaaggaacatagttattaagcatctattaatgatgctactaacaactaccatttggaggcatttactgaatgccgagtgctttacctgtgatttctcattgaagttttgcaaccatcatgtgataaaatgaattattaatctcatattttaaattaacaaagtgaggtttcagataagtaattaccccaagtcacacaatctgtaaataactaagcacaactcataaacaggtttttccgactcagagttgatgttctttctatgtctaggcctgggctctttgctttgtttcctttctcactagaaatgcgtcatatgtgccatgtgtaacccccatggcctctgccttcaaggagcaagtcatgtacgcaagacggtggtgggggacaagaaaatgttgagccaggctgggtgcggtggctcacgcctgtaatcccagcactttgggaggccgaggcgggtggatcacgaggtcaggagatcgagatcatcccggctaacacggtgaaacctcatctctactaaaaatacaaaaaaataaaattagccgggcatggtggcaggcgcctgtagtcccagctactcgggaggctgaggcaggaagaatggcgtgaacccaggaggcggagcgtgcagtgagccgagattgcgccactgcactctagcctggatgacagagcaagactccgtctcaaaaaaaaaaaaaaatgttaagccaaagggtgattgaaagcccagatgtatggtagaggcaaatcatgctgcaggggacgtggtttgcagggatgtctctcaggaaggggttgtgccttaggaagaggccaccattctgaaagcatcacatccctctagctacctccatggaattctaccagtgctcccaggacaaattctggatacaaaaattgcaaactgcaacagcagcccctcaggaggtctttttacctgatgctacgcaacagggcatgctaattatacttaaatagcagaaaaatggctcctaggtggctggatggggtagattacggacataagaggccactagcattcattcccaagcccagtcagcctatctgagtaacggtggtgctcctggggcagagtgtattaccccccgcctgcaatgtgcctaactagtgtcaatattgacagaggagctcatgggagaacagatggatggagtgaaccaaaagacagccacttctcagtcttcattgtgcaggaggagtgatccgggcgaagtcgtgctccactgtcaccttagcaaaccttatcgcctcctcataaacatccaggtaactcccagcaaaaggtgaataagaaatggcaagggttcagtgaagcgtttgtatttctgtctcagcaaaaaacaaatcctctccccatcacttgactgtaattttcttctgtgtaattttctagcaatagttggcaggtttgggaatcactagcacatagtcattagctgtaaaaacgacagttgatgattctgggagtccagagagaagagaactggccaagaaaaaccctggggaatgccaacatctaaggctgtggtgtgaagaaaggaagcccacggatgaggtagcttttcaatgatcgcagatgtacatgaagaggaagaactaggactgaggggtatctcaggagccccaaagtgtcaaaggcagcagaaaaatccaggaagaagagagctaaaaaatatcccctgggtttggtacataggtcatgaatgacattctcatgagagctttggtagaatgatggggttcagaagacagccccacatggaataaggagcaaaagggaggtgaggaagcagaggggaaggagaagagttttcagagatgtttgaataagaaattggagggttgctggcagggaagagtcaggggataattttttttttttttttttgagatagggtctcactttgttgcccaggctggagtgcagtggcacaatcctgactcgctgtagcctctatctccccaggctcaattgatcctcccacctcagcctcccgagtagctgggactacaggtatgcactactacgactggctaatttttgtattttttgcagagctggagttttgccatgtctcccaggctagtctggaactcctgggctcaagcgatccaacgagctcggcctcccaaagtgctgagattacagtcagatgacacctcacatggccgagaataatttattgaggatggtaattatttgagcatgatgagaggctcaacattgagaaatcctaatggaagtgaaggcactgatggaagaacattggtagacattagagggagagcctggaatatgagcccctcaatcaaactcccaaagttttcttgaaaatctgtaaaccactgaaatcattctttgatatccttttttaacctactcaaggacaggaggcccagactggccgtctttgctagctgccactaaacagtttacctgccaccccctacccacccccagagagcatagataagatttattgtgtatacactgcagtttttcctcaacctccacttatttttataaatccttaactaggcttcagagctgattccctcacatatgaggaaacaatttgcatacaaaataattaaccaacatgcaaactaactagatgtttttcagttattttttgacgagagaaaaaatcgcagaagatgcatgagcaaatggcaatgccggacataggatccaaacaggttgggagatgacagcaccagaggcagcatgatgaggttgcctttaagtaggagagggggcgctctgggctctgaccctggaggaagtgcacaaaggatgcatattgattggcaggggaaatgggtgagggggttccaggggcatggggtgagcagagcagggagtcaaagggctgtctgctcagagtgcagaaggccatgtatggggaatggcaaaggtttctaagttgttgaagagaataggaaagggatgtagcaagaagataaaaggttgctggtactgggcatcgaaagacccagttgaggctgagacacaaatggtggcagtgtgcatggcctttcccccaaaacactgctcagctgaccaggtgtgaaaggataggagagtagggggaggtgttttgctgagtgggtacagaggaaggatgggtgcggggaggcaaagatatcaagggtgttgaggggagagtagctcagatgatcacaggacttggactgggaagggaagggagggaggcgaggagggtgcttctgttagccagcgttctcgttagagggagcaggatccgctccagctagtttagcagaaagtgatatagatagctcaaaaaaatccctgagaggtgcaaagaaacagactcttggctgagcttccaggaatgactccccaccacacacggtggagccggcccatcaaaggagctgagcctccgccatcatcacgaagctttcacttggggaccggccaccacagctgcccgcgagagaaccaaacccccaatgccaccaccatcctcctggaaaacagaggcctctgctctgccttccctggagaactcggttttgagtcaaagcctgacgtagaagcattatggttggtgacacctaaatcacacatctgcccctggcagcaagggggcaagggggacctgcgtgtgtgtgtgtgtgtgtgtgtgtttcatctcccttcccccttgcacccctgttgagaggttggtatttacactatgaaaaaccatcaaagtgtggaaagagttcaggaggttttgggcagccagtcactatagcacgggtccccaatccctgggctgtggactggtaccagaccatggcctgttaggaaccaggctgcacagcaggaggtgagtggcaggtgagtaagcattaccacctgagctctgcctcctgtcagatcagcggggggcatcagattctcataggagcatgaaccttattgtgaactgcacatgtgagggatctaggctgtgagctccttaggagaagctaatgcctgatgatctgaggtggaacagtttcatcccgaagtcatgccccttccacctgccattggttcatggaaaaattatcttccaggaaaccagtttctggtgcctggttggggcccactgcactatgggggatagcaaggctgctgcttgggtacgtgctgcttctctgttaaaatatcctgctaggcatatgcaatcctgcaggcacatgacttggcaaggtctgttctttatacgaagagaaacatgctccttctttgggggacattaccctgccccagtgcacagcttgctgagcaaagtgcagcttagatttcagcccctccctgactcctcaactggcaccaccatttgtgacaactccagagctgactgcctgggaggaaacagaaggaaccagggcctctcggcctctcggagtctcttcaaagtcaaacagcttgtgtggtgggaacaagatgacggggagtcagaaggatgggtgctgtggtcacagcatgaagcacggggtgtaagacttctggggggatcctcagcgtgggatagcaagtcctgtgggagggtggagtgcagtggtgataagatcttgaaactgaggaagcagtttgagaggcagatcatctataggggtattaaaaattgagtggaagaaaatgaagaatgaagcctcagtgagagaatcacaaggaaacagtaggtgacaatgagaggaggtagagccaggtggtaatagcctcggacgacttcacacaggggcagagtagccatgggagcaaacaagcgacaaccacaacagtctagctttcctctcctggccccttgctacctggaacatcaatttgttcatttaagcaaatatttatttatttaaaccaataatgaacctccatgtcttagttggctcaggctgccagaacgaaataccatggcttaaacaataggaatttatttttcatagttcttgtaagagtccattctcgcactgctttaaaggaatacctgagactgggtaatttataaaggaaagaggtttaattggctcacagttctgcaggctgtacaggaagcatagcggcttctgcttctggggaggctttaggaagcttccaaccatgctggaaggcaaagcaggagcgacaggtcccacatggagggagcaggagcaagagagagagggaggaggaggtgctgcacacttttaaacaaccagatctgacgagaactccctcactatcccaaagagagtaccaagtggggggggtggtggtgttaaaccattcatgagaacccgcccctatgatctagtcacctcccaccaggcccacctccaacactgggaattgcaattctacatgagatttgggtggggagacagacccaaaccatatcagttctggagtctggaagtcggagatcagggtgtcagccagcatggctggggtctggtgatggccaccttctcactgtgtcctcgcctgaggtcggggcagagagagagagcacatatgagctctctggtgtctcttcttataaggacactaatcccaccatgagggtcctactcttacgacctcatctgaacctaatcacctcctaaagaccccctctccaaacaccatcacattgggcaacccaacttgttatctccagcctgagcctccccccagaactcttggacccctgtgcttcatgctgtgaccacagctcccatccttctgactccccgtcatctcgttcccaccacaaatattctttgactttgaagagacaccgagaggccaagaggccctgggtgcctctgtttcttcccaggcagtcagctctggaattgtcagaaatggtggtgccagctgaggagctcctcagtgggcttcaatgcatgattggggaggggagggacacaactcagtccacagcactccactatctgtgaacaaaaacaaagtctctattctcatgaagcttacttagcttctactagagggaggtggacaataaacaaaaaataaataaatgatatattgaggtaacaaggccataaaaagattaggttggtggggtgaggagcggctgggcattactctgtatagaatgaacatggaagatgaaggagtaagacagtgaatatctgtgtgaagagttttcaagtctgagagcagcaagtgcaaacaccctgaggcaggatcaggttttacctgtggagctgccgaagagagagggaggaggaggaaagtagaatttgtattcgttggagtgtaactggggggccaaccacgtaggcgcattgtaaagacttcagcttttacagctgaaggtggaaagccatggcaggttaaaggggagggaggtgacatgaccgagaaagggaggatgggaaccctgaggtgagaaagtgacacgggggtgctcctcgggagaaaggtgtgttgcagaaaggacaaggaggtggcagcagagtggtttggataggctgagtgtagtggtgtgagggtcccacaggcacagacccctggggtctgcagcagccagaaggggctgccctgtgggagacccattctggggaagggctgaggttccatgtggaagccgccggcagcaagttccacaaggtctcaggatggaagatgagaggggatatggcaaagcctgggtgcctcttagaatgtgcagaaaggctttctggagagtaggcagagggcatgagtctctctggccaagagctgcctcctgctacgttttgagaggaaaaggtagcacagtggaaactaggaaagctgtccagccaggaaaagcccccatccctgagatctgggtcagcctaaaggttctgatgctttggtgagccggaggaggagcttcacaaggaagagtcactggaaggagaaaccagaagcagggagggaagggctgccacctgaggagacgtcctccttcacgactttgctggcctggtcacctgggcctgcaggggaagggcagggaggtgccacctattgtgaaggaaaatcagccacagtgtatgtctaagcaaaagccactctccaaaccctcgtttgcaattttgtcacttctttggcaacaagccccctgcagctgttccacccagagcctctgccaggtgacctggccgtgcccagtgccccacagctgcagcctgctggcggggactccaagtctcccctgctcccagctttcctgactcggggctgttgggcttggagggagctgcattgggggacaggtgagggaggaggccggggcaccagcaggaagctctggctctccttctctttcctggtaaaagcaaggcacaaagcactctttgatctgtgccctctgccagttctggcagggctgcgcttgtcactgttccaaaaaagagcagaaggttacttagctatggatgaataataattgggcatttgtctaacagctactgtactgatgaataattaaaatttttattacaattgaggcaaagagcactctacccatacggatggtctgtcagctctgccagaggaaatgcaggtaattgaagagtgtcctccaagttctgaaataatagtcatgatcatggcaaagatgtctgggttaaaagctgggaaaataggtggacaaccagacccaatcaccaaggcttcttcctttttgggatgtaataaggtaaatcggctaaagctggtcttgggagtgcaaatggctggaacagtcagggaaagctaggagtgaaaaccaggaggaacagaaataaagagaaatagatgaagacttactaggcaaatgcccttatatagtagctgatgaggatgactttgatgagataagaggggacagctggagcataatggaaaaagtcagaaatgagaacacccttgtcaaatggcttggctcctttttggctgtaatcttgtgcaaactcacttaacctgcacaagcttccctttctgcctctataaaatggggatgatactgtttaatcattggctcatcttctgaggattaaacaagataatgttgagaatatttaataattatgaaggcagacagcaaatgcaagtaattataactcagaagtcagaattaaaggtaactgggttcaaacagcttaagagttgggacgggttgagtgaatgaggatacagaaacagtggagaagaaaatcagtggtgttggggttggaccaaatgaaatcaacagtggaatttcactaacttaaatacattgtgcaaggtaaacaaattcctttagttatcaaataccatttgatacttcccgggtgtgttaataagacagtccactcaaaaaatggaccactaaatgataattattttgatgggagagtgtctatggaattcatacacccacgaaattatactgtgaggtgtgaccatgcacaggaaagactattatgcccaaccttttgagagcatgtcatgtgcaagagaacctggacacacccgagagataaatggcaagaatgccctggctccccaaacatataaggaggaggctgtggcttgctcttcccctgctcttcctctgtagtgatcggccatgcagtccatgtgattcgagtttatgatgggaaccaaaaatcttcaatgtaaaacattttttatttgttacttccatccatttttcctgctgtccttaaccctgctttttctcttttttccatcttaccttccttgtaattgattggggttagcatcctcctttttactgcctttattttgaacaactgataccatatttctatttcatagtgattcactttaaattgttgttatttaaatttaacctttaatattattattaaaagttaataatattaaagtaccttgagctaagcactcaaggtacataatcttttttaatccatacaacactcctgtgttcctcattttacacagaataaaaataaggttcaggccaggcacggtggctcatatttataatctcagtgtttttggaagacctaggtgggaggatcacttaaggccaggagttcaaggctagcctgggtaacatagcatgaatccatctctaaaaatatttcaaaattagccaggcgtggtgttgtgcacctgtagtccctgctactcgggagactgaggcaggaggatcattgagcccaggaggtcaaggccactgcaatccagcctcagtgacagagcaaaaccccgtctcaaaaaaaaaaaaaaaaagaaagaaaagagaaactgaggttcagagggatttaagtaactagctcaaggtcccaagacttctaatgcatagagccaggatctgaagcttatttatctcttaagaacaatcaaattcactataataattccttccaggccagacgcggtggctcatgcctgtaatcccagcactttgggaggccaaggtggacggatcacctggggtcaggagtttgagaccagcctggctaacatggtgaaaacctgcctctactaaaaatacaaaattaactgggtgtggtggtgggcacctgtaatcccagctacttgggaggctgaggcaggagaatcacttgaacctgggaggcagaggttgcagtgagccgagatcatgccactgcactccagcctaaacaacagagtgagactctgtctcaaaaaacgaaacaaaacaaaaatccctccatagttcatatggcaggtgcagcattgaccacagtgcagtccatttgccttacaatctactaggagaaataatagcacaacaaattaattcagcaagtatttgttgagtgcatttgttcaaggtatggagaaaccaggtgtaaatgagagatgaagccgcgttcctgggagtgactatgaggtgagcatcacgtgtgtggtgcccagcgctggaggccttgcagggccaatcacgacctctcgggatgtccagagatgctgctaccacccaagcagcccctcccagactggagtgtccaaaaacaagtgaacagcaggcaggctggcatggaaatggacagatgggacttgaaggcaggaacctgggtccagtcctggtctcaccatcactaggcccacgacctctgtaagaccctcgcctgctcagtcagtttcatcgtttgtaaataagaatactgttgagcagagaggtgcaggtgagagattgtccaaaaatgctttgaaaaggatgctaagtaacagttagcttttattatccctatgtttctgctaatcaaacccaggatagttttctacagcaatctgtgagaggctccattatatactgtatttgaatattccaaactactcctttgcaggaaggagtaattctctcacatgctcctgccttgagtgctgagtggagttacagaaggtgaagggccacagaggagaatggctgccaggcatctttccataccagctccttctttccattccttcttgggcatggatttatatagcacattaacaaagagccagggaggaaaggaagaatttctaaaccctttgctagaaatcctcaagtgtttagctacactggagctaccccaggtgctgctaccccaggtcctctctgtgaccctgccccgtctctgctggctgaacaccatatctgaatgactgtgccctgactactgagctccaagggtctggaatgccacttcacatcacaggataacaaggcagcagctgtccacccctctgagcacgcctggacatctggctggtgtctttccaaaggtctccatcctgagcagtcctcaagcaaacactcgaacctcctgtggtgaactcaggccaagactatgtgcttgactgtcggtggcagctgctgagctccagatgacacgggtcatgaagagttgggcttttatctcagttcttcaaacaaccagatcagacgtaacaggtaagcaatcggatttatttgcccagctctaaactcttgtgcctatcagaaagaatcaagccaaaccctgaaaggtcaatttcagatgctgtgtcattatcctcaccgagactttttccttctttctcagttttctcaagttgtttagaggagaactgcagggaattttcccacaatatccaggaacgaacacccagtaacatctccctgaatctgcagtgttatcctaaaattcaagtacatttgtagccgatccgtctgcatctgcacaatatccctaagtatcatggtggggagactgggatattcgtagtctgtaccctcagggagaaggctctcctatcttggtgcctatagaatggcagggagaggagataatgctatgaaaacagtaggaagagcccctgccattcaaagaatcagtctacccttgaaattagacctcatgcaacctcccttcctgatgcaaacctgaaaccacccatggcctcatggacaggaagccacccagcttgatctgtacaaacgtccttagagttggctgcatgaggctgcccctggctctgacacacactcaattatttgggaaaaaaaaaaaactgccttatactgaaatgaaaccagcttctttagcacttccttccattgatccatcagctataatgcacttgcattctatcttcaaaaaatatgggcagccaaaataaaaggaacgggtgtctgctctatctcttctagaccttcctctctgagaggtcctttagcttgttttgtgacactttttaaagtaagacatttagactcatatcttgacaaattataaatggctttctccagttgccccttttcctgccccactcctctgtccttccttacagcataagaccttctagtcattgcagttttcaacataaacagatagcagagaacacccggcaaagaccaacataagtggctgtgcacatcaagaaaaagacagttatgcctgcttctcagtgattattaagggaaaataaaacctacaatgataaacttcacattttgctaatttccagtcatgtgtctccatccaggcattgcccacaaccttaacttctctccaaaagtatctgagccaatgtgtcaacattgctccaaatacaaggtgcaagtatacactactgacatgaaccatcatccaaaacttacctatcttcctctcacagtcacccccacctgccagaacactccctggtggtgggaagagaggtggcaaaaagcagggcattaactaattaacacgtcctttcactcaacacgcttgccttgaagcaattttgttttcacagcatcgggctggaaaaaaaagaccttgaaaaatcatagccaatgcctcatacgttctggtagatctatatttgaaatctccaaagcagtagagaatttttttatggttgatgttgatgatgatgatggtgacatttttgtgtgttgtttgttttacattataagtatttcaacgtaaagagagaagcgtaggcaataataaatatctatgtagccacaatctagctaacacaataatttaccatattttgttccaatttttttgtaaaaaaacaaacaaacaaacaaaaaacaaaaagcattgagatgcatgtacttctgttggagcatccctccctgatcccagtcacttccctccactccagcaggcagccactggcctgaggctaatggtaaccatgccatgaagatctttaaaagatactcactacatatgtacgcataaagaaatggaatttttctttctacataaattctatcatattgtatgttctaatctgcacttgctcttttcacttgacatcctccttttcgatagagccataatgacccatgctgcctaactcatacatcccaatggctagtatttctcccatcttaaaaacaaaaaccttccatgaactttgccaaccatgtactgcccccctctctgttgtactcttcacctttcttgcaatacaactccctgcaagtgttgtccacactcccgatctcctagttttctcccaaactctctcaactcactccagttagacttcactagcaagaaacttgggtatcgtagctaaaaatccttccagcctagaattaggactttgcttcatgagtggccaagagaagcgtcatgtctcagttcccggtggtggtttctgtgtgccctggtagcttgacagcaccttcctcagtttgtctgtcctccacgttagcacatgggaccaagcacctggtgaactggcccaccttggaagctgctggcaattctgctgcctctgccaccacgagactctgaagaatactgtacatacacagatgccccgtctagaagtcctttctgacaagtcctaaggacatgcatgaacatcacattgagcctttccttcccttgcgaacaccatcatgtgggagaaggggaagagccactatccaggtctccccacctgtggatcactctcagcatccactcatctcaccagctgctaggctgacagagatccacagtgtggccaagaagagcttttcactccatccgctccgcccctaaaaacacacctctgttggagttactgtaagggtctgtgaatgaatgtttagatccccattagggaaagagatcagggctcagggatcaaggatacgtggttctcagagctcatcacctgcgagaggatacctttattgttcatccatatgctgatcccagccttgctccctgccccactcatacgaaaagcctaactatagctaactctatttataaatcccatgaatacacaagtcaggcttacggtggttttgtaaaccatttctctccttttatttttatttttttgtcctattcaattactttgcatctcagttgatgccaaaatatcagtggatatgcacacattctaaaaacttcagtgtactgctcagaaaatatggaaaaacagacactctgaatatcctctccaaagctcagcactgagaaacaaactacctgtgcaaagaaaaccgcaaatagatgctgtttgccctgtttgtttatagatgaattttcattttgcattatgcttttcatacgagtgcatcctaaaaagattttcacaatgaactgtgtacatgtagtaaagattgcaaaaagagggaaataataaaggataaaagcaaagactaaactttctaccaaagattttggaggaaaaagcgttggccaggataaataaaatatttttaaatgagtggtgtataattaaatggtcagagaaataactgaaggcaagtaaattgactttcttttcctttttttacatttcttatttctcccttgcataagacaaccaaggtttgagccagctgctgtcttcttcctatctatgggactttgagaagtttatttctgttacctccataagcctcagtctcttcatctgttaaataaaagataattggaggctgaggcaggagaatggcgtgaacccggaaggcggagcttgcagtgagccgagactgcgccactgcactccagcctgggtgacagtgagactccatctcaaaaaaaaaaaaaaaaaacaaaaaaacaaaaaaaaaaaaacacacataattggctgggcatggtggctcatgcctgtaatcccagcactttgggaggctgaggcaggcggttcacaagatcaagagatcgagaccatcctggccaacatggtgaaaccccgtctctactaaaaatacaaaaattagctgggcatggtggtgtgtgcctataatcccagctactcagcaggctgaggcagagaattgcttgattgcttgaacctgggaggcggagactgcagtgagccaagatcgcaccactgcacaccagcctagagatagagtgagactccgtctcaaaaaaaaaaaaaaaaaaaaaaattacaggacccatctctttgagtaactgtattaaatgtgaatgcagcacctagccacattactatgcacatagaaagtattcaataatgtttactgctattaatattaatatttccttcataaatttattaatattcattttctcccatcttaacccttctgggcccctcaatccactggacctgccttcagcctcctgcctctttactgccttcattcgcacttctttgagtcaggttggcaaaccccttcataatccgcccaatctagttttccagcccccaatactctcctgacctataaattcgctttctgcattggccacaatgaactcctcccaggtggcagctctttggatctctctatccttcctttctttgtgctcttttcctggaatgtccttctcttgtcatcctacccaagacaatcagtttctccctctatcgctccttgaattcgcctctgatattgcacttgtgtctgcatattgacaggtttatggaagacacttcctagccatcttgtgagctccttgaaggaactgtgtctttatctgtatagccccacctagcagatgctcaaggcatgcttgtggaatgaataagggaacagatcatttcttctgagctgtttgcagtctggctaagccaattgaaagaatgccttctcttgcaatctacaaattgaaaagcctgtgagaccctcaggacactcaggcaagttttccagcatatgtgacaataccaagccttagtgcatttgcctctcacgtggaggagtctcttctaaaaatgaaacagagatgaagggtgagactcttacagtggttcaactcccctaagatcctcttgtgatttagaagcatcttggaaagaaatccttgacactcgcctcgcccaccctgagctataaggtaaagctctcggtggtaaacgtggctccctggtagggagacttcttttatcctcattgtttctggagggggaagtgttagcacagagactccctgggaaacccgaggatgcctcaccacctcaccataacagcaggaaacccagaaatgattcacagctgaaacctctggcccacatcgacacatcacatcacatggttgtttcaactggaaaccaaacagccatctgggcatgattatctgtatttttgtgaaggtgtaaatacacagtgagtaggaagagtccaataaaacctattataatgttggtggtgggcaccacaaagagagcaccccttaatagacattccctggtccagtgaaagacatactttgtactgagtcccgcgcctgggagaccttccaggaaagtaaatccccaggagagagaggcatttcccagtaggtgctttgctttttggttgttttcttttcttggttgtttactttgttctactttgtttttactacagttctgtcctactggtggcggagtgggactccttcatgatgtggcacagtttccttgagttttaggaagaaacggcccatgtggcagattcagaaacaatgaatcagcacctaaacaaacaggaaggtaagcggccctcccaaggtcacctgggtagtggcagggtgtgaaccagagtccaggtgtcctgaccacccaccaccgcctgtcctcctccctcatacaagatcccttctaggccagcgctgagaataaaggcagcggcatcatggggagggggtgaggacagaagggtcagggaaggcactgggagggagaggcaatcccaacccaactccaacagcctagggtcaaagcccagctccactcctggcagctgtgagactttggtgcatttaatgtccttgagcctctatttcttcacctggaaaatgggattgatgacaatatgcgtccctccaacaactaaatggcacatcaaagctttggttaaaggggttggcacatcgtgaggaccacgtcagctcttaatactccaatgatggcttccctataagtgcagagtcttcttcaagtggtggttagcacgggttttgcctgttcctttaatcatggctgtgaatttgctccggcaccattgttcccaaagtagaatttactggcagcttccccccacccatgacccatctctgcttggaaattttttagtagtagtactggctacttttaaggagaactcattccactgttgcacaatggcagctcttagaaagatccctcttgaattgggataaaatctgatctccctctctataatttctccccactggtcttaacactactgctttgcttcccatacttggagaaatgctcccccagagactctaggtgatgtattggggatcagtaaacccataaaataaataaggcatgttttccttatgaatcaaattaaaatgaagatttcttagggaaacagaatttaagctttgcattgaatggttatgctttttaaaatatgtttcaggctgggcatggtggctcacgcctgtaatcccagcactgggaggccgaggcgggcagatcacctgaggtcaggagttcgaggccagtctggccaacatggcgaaaccccgtctctactaaaaaatacaaaaatgagccgggcttggtggtgggcgccagtaatcccagctactggggaggctgaggcaggtgaatcgcttgaacccaggaggtggaggttgcagtgagccaagatcacgccactgcactccagcccaggcaacagagcgagactctgtctcaaaaaaaaaaaaaattacatttcaatttaagatattttttattaaaacaaacaagcatattttagtatataatataaaattcaaatcatttctttttcagatttggcacaaaaaagtttgcttcgggcaaccattgccagctctatccagacctccaaggagtgagtatctattcacttgcctctgacactgaggatttctagatggagaaggctgagaaatgctactctgttgaacagagctacaaagaacaaatgtaattcctttcccatggggctgcccatcaagttttcctaagatcttacagttggaaagagacttagaagttgtctaaatcgatctcccttctgcagcaatcctaacagatggtcacccagcctccgctggatcaggctcagagcggagaagagaccacatggtaatcattgccattgcatcgctggccagctctgattgttagaatgttcttttcttaagcctagcgccatgcacaggggccctggaatgtggcagacctgaggtggactcttgaaccagccgcttcacctcaccggggctcagtttcctgtaatcccagcactttgggaggccaaggcaggcggatcatctgaggtcggtagttcgagaccagcctggccaacatggcgaaacgccgtctctactaaaaatacaaaaattaaccgggcttggaggcaggcacctgtaatcccagctactcgggaggctgaggcaggaaaatgctgtaaaatggggtgaatggtgttagctatatcacgaggaacaaaaaatggacaaaaagcccttagcattctgcctggcatgttgaaggattcaataaatgttccctatcatcaccattcccttccacagcttccataagctaaaattctagagcctgtttgtaatgcttctgcaacaccatgctttacatatttgaaaacagttaatatactctcccctggctgcacctaaaaagcttttgttcctaagttaaatatgcccccaccttccttgatagaattaacctcgaaacctttcagtgtatgtttttcagaaagctgtttgaaagcatgttaaaaattcttaggaatgaactggagaaatgtcagaagacaaaaagtgccacggagaaaacaaagggagcagaggaaagggatggaaaaggctagaatgcagggggcgggtgcagtttaaaatacaggagtcgagtagctcacattcaaagaactgggctttcttatgaagtttgattggagaccctggcctggaccaaaatggggcactccactccttctcagagttgcaggcagacagatctgccgtgcagcactggccacccaggctgaaaagcaggaagacccgaggaggggcttggcgagggcagcccaagtctgctcactgggtggccagaagcacagcatcatcctgtggcctccacagagagggccaggaagcaggaggtggggcaccaggagaccctgtctttacatcatgctccaacccctaaaaatatggcccaatgcatgtatcaagctctcatccatccaattaattcctccttctcttatagagaagagcaaccaaggcccggcatgatggctcatgcctgtaatcccagcattttgggaggctaaggcaggaagatcacttgagcccaggagtttgagatcagcctgacctacatagcgaaaccctgtctctactaaaaatacaaaaattagccaggcgtggtgacacatatctgtaaccccaggtacttgggaggctgaggcaggagaatcacttgaacccaggaggcggaggttgcagtgagccaagatcatgccactgcactccagcctgggcgacagagggagaccttgtctcaaaaaaaaaaaaaaaaaaaaaaagcagcaaccaagtgttaggaactgaactgtgtccctcagaagttcatatgttgggccaggcactgtggctcatgcctgtaatcccagcactttgggaggccaaggtgggtggatcacctgaggtcgggagttcgagaccatcctgaccaacatggagaaaccccatctctaccaaaaatacaaaattagctggtcgtggtggcgcatgtctgtaatcccagctactcgggaggctgaggtaggagaatcgcttgaacccaggacgcagaggttgcagtgagccgagatcacgccattgactccagcctgggcaacaggagccaaactccatctcaaaaaaaaaaagttagtatgttgaagtcctaaattccagtgtgactgtgttcgaagatagggactttatggagggacttaaggttaaatgaagccatgatgatgggaccctaatgtgatagaaccagggcagatcacttgagcccttgtaagaagaggaaaagacaccagagctcgcttcccacctgccgcagaagaaaggaccaagcgaggaaaccgtcagaaggtgatcatctgcaagccacaggagaaaccagccctgcccacaccgtgaccctggacttccagcctccagaactgtgagaaaatgcatttctgttgtttaagccacccagtgtgctattttgttacaacagcccaaaccaactcaaacacatagcatagcagttcctcaaaaaagtggcaatgttagtggaagtttcttcctttatgggttgaagcagaacatggggagagaagagttccccattgtaggtagattcttaaaataattcaatgctgtaattataacagataagaatgtaggctaaaactaaatttaaacaggaagttacttatttacctctagctatgagttcaatatattatcttattcttggaaaagaaagaaatgaaataaagccttgaacagaggaaacagtaaagaaataaatctgcatggaagaaaatggaaaaagtaaatgaagttggaagttgttaagtaccagtattctttaaattatttacatgaattcagatgtgtaaatcctcattgaaggcaggaacatttgtaaagtatttactggacgccatttgtaaagtcctttactggacgtattcagggggctgaactaagtgtggaagctattaataaaataaaaggtaatattgatcgtgcctttagaaacttctattttagaatgcaaatactaataatacccgctgagaatttagagactatcccttatctccagaggcactagccgccctgcaaaggttagggagctcaacagaagaccaaaggggctaacagcaagatggagcaggagagaacccatttacctggcaggtgtgagaagagtcaaggtgtttctaagcacacagctgaaaatggaaaacaggtgggtgctcctgagcaggggttgggggccagaaacaaagaggggcacccatcagcactgtgttgacaggggggatgaaatttcagagagatcatctgggcccaaacccacagagccgaagggcccggaacacgggtaacgggtgaatgtattcagtcgggcctcctgccgcttgtggacctgctgaggcctttgacgccacataaaccaaaatgagctgaggcttggagactgggtggaagcacttgggaatctcatttgacctgtggattttactgatgggaaaaaggagaagatgctcagagtggtggtcagctgctctgcccacatgggccacccaagagcacccacaacccgcccttacaccatgtccatagaaagggagtggtttttgggttcagaggagaaagatatcacttccttctgggagcaggcgtcgggtagagaaagggatcaggcaggtctcaggttacgcaacaagaaagctcaaaccacctctgtcaaactccctctgattctccttcatcctcctgttccagagcttggtgactaggatgctcctctgtgtcctgtgcaatctcacaggccttgagcttgttccccgggagtaacctctgcagaagcaggaaatgccctctagtcagctcttccgaatgtgagaaatgaaagccttaccaaaggaaagctgaggaaacgtgttcttccttccttcctcccatccttcctccctctcttccttccctccatcttttttttttttttttttttttttttttttgagacagggtcttgctctgtcaccagggctggaaaacagtggcaccatcatggctaactgcagccttgacctcccaggctcaaagaatcctccaacctcagcctcgcaagtagctaggactataggcatgtgccaccacacctagctaattttaaaataaaatattgtacagacacaaggtctcactttgttacccaggctggtcttgaacttctgagcgcaagggatcctcccaccttagcctcccaagtagctgggattacaagtgtgcgccaccatgcctgactaatctttgtatttttagtagagatggggttttgccatgttgcccaggctggtcttgcattcctggccccaagtgatcctcctgcctcggcctcccaaagtgctgggattacaggcatgagccaccacacccagcctccgtcccttctttctttatcttttcttccttccattcttcttctatctttccttctctcccacccttcctcctttcctccctttcttttttcctttcttccatcttttattccttccttcctcactttctccctctattgtttaccatttattgagccggtcagccctttgccaaagatcacagaatgcatataaagatatgttctagatcatgattttgcagtgcttacaaccttagggggaaaaaaaaaacggatgatgagttaaaaattaaaccagccggtgaggggccactagcttcactgaggcaaagaacctcgaagcatgattccatttccacagatggggccgcaggagaatattctgagcccagcacagaggcccagatacactgtgttcttctgggagtccaaatccagccctgagagccctgtgtaggagggggctacggctcagtggaggtttcctctgcctttaaaatagttctgggatgtgattttttgccttgagttactaagctgaaaaaacaagccagaaatacctattttgctcaaaatagcccagtcctcccttatgccaggttctcggaagctgccttgggtgcctctgccccacacaaactcccagcaccgcccaccttggtgactgatgatgtgggcagaggggagcagaatgggaagcagcagcttggcttctctgcctggcctctctgtgctcttttgttttgtgtttttgagacagagcctcactccgtcacccaggctggagtacagtggtgtgatctcaactcactgcaacttctacctcccgggttcaagtgattctcatgcctgagcctcccaagtagctgggattacaggcacgcaccaccacgcctggctaatttttgtatttttaggagagacggggtttcaccatgttggccaggctggtcttgaactcctcacctcaagtgatccgcccgcctcggcctctcaaagtgctgggattacaggcgtgagccaccactccaggccagtgactttttgaattacagttttttccagatcctgaagtctcccattcctgctcagtctctaccctctactcatcatagttcctgttttttgagtactagatactttgtatatattttttaacttgtctttaattattgtcctatttacagatgaaaaaactgaagatcagagaggttgtataacttgcctaaggtcataaaactacttaatgatgaaaatttaaaaccaagtctgtctgactctgtagccatggttctcactgtctggtccctggaccagctgtatcagcacctcctgggaactcatcagagacctaatgagtcagaaatttggggggtcaggtggagccatctgtgtcctggcaagcctcaaggtgattctactggacactcccaaccaagaaccactgttccagcacgttcccttcatctccacgccatgctgcgtctccaacttcctgctctccaaaggcaaaactcaccatgagggaatcatccagaaataaagttgattttcacttctccctgcagatgctcccagggagttaaaggtgactcttcactccagactctaaatttgaccccctttcaggcggccaccccaggttcattatcacaccaatcagccaactgttttgagtagaaatctcctttcccaccctgtaaggaattccaggacaccgtctatgaagagggaaatcataacttggctatttgttcaggacacccctaccctcttccagaccagcagctcattgagacacctgccctcgagataccacttgactactgccgccagtcgacaattattgatcaagtactgtgtcaggtcctctgctaggccgtttgagacatgttatctcaattaatccttacaacaacccaagaggtagacatgattattagcccatttcaaaaacaagaaaactgaggcacagattatttgcctaacttcactagctaataaattactgagatgagacttaaactcagtttgtctcaagaaccccatggtcttatccagtatgccctattgcctgttacgggcctttgtcaaacaagtcttctctcttggtgcactccaggccaactttctgtgttccagcttgagagtcctctttgcagccatgtgaatccagtgtcttcctctcgttaatcctctaggacacctctgcccagctttcttccatccccccgcacctggccatttccctctggagctgtttcctactagctgggctctcacctcccagacacttttccttcctttagaccagcttcatctcctctatgtgctgctcagcatggaataaattctatctttttccaattcccaatttctaaggcaggtttttttttttttttaatcttaccatctctgctttgaccagacacttggtacaacttcaaacattgtcgcctgtggtttggctgcctaacaaggagctcttggcccgcttcgaagccagccttcttgaagcctgccctcacatttagcgcccttaatatagactctgtctaccacagatcagcgtgtactgagaagatagatcggaatcagggaggaggctatttcattgcctggtggtggaaccaatactcagtctggtgatataaactgaaaaatgcaaaagtggggaaggcaaggtgaagagcgaaggcagcttctcagacttggctcgtgagttcatagtaaggcatctccaacaagagtcttgcagcggcctcctggagggtcccttccatccacagtgattggggcacaggctggctcaaccataaaggcaaacaggaaactctgccagcaaaggaaaaaggaagctctcagattcctgttccaagcagccttctgggaaggactttatcttgggggaaagttttactaaaggaaatttgacctgaagttgcaagtttcctttgttgagaaaagcaaataacatgaaaggggagaaaagcaacaagatgaaagattggtcatcacagatgcagatctaatctctgccataatataaactggaagaacctagaaccctgggaggtgagagtggcaggcggtgggggggtgacatgagcagaaacaacagacaagacgaggctgacctcccacaggggcagcgagggccctggctgaccagagaacaggacgaaataaggctttccagggcaggttagagtcctttagtatcaggatgcagtgtttataatctcatgggccatggagaattctgtgctctaagcatctgggaaatgagataatcaaagcatataaataataccagtcaacttttttaaaaaacggtcagtatttttaaacacatattaaaatcttcttgagccctttgcacatattaactaatttaaacctcacaacaaccctatgaaatacataaccaatattatcacttccctttataggagcacagaaaggttaagcaccttgttcaaggtcacacagtttgtaaggctcaaaagcaggatttgaacgcaggccatctggtactaacgtcactcctcttaaccaccatacctgactgcaaagcagtctctaaaattaacgaagtgtgatatggtttggatgctttgtttcctccaaatctcatgctgaaatgtgacctcccatggtggtggaggtggggcccggtggtaaggacagacctcccatgaatggcctggtgccctcctcgtggtaatgagttcttgctctgcggtcacaggcaatctggttgtttcaaagagtgtggcaccttcctagccctctctcatcataggaggtactggctccctcttcaccttcctccataatcgaaagcttcctgaggcctcaccagcagcagatcccagcactatgcttcgcgtacgaactgcagaactgtgagccaaaataaaacctcttttctttataaatcccccaatctcagatattcctttatagcaatgcaaaaacagactaactcaagtgtatcttcttcgctctgttctttaagaagtttggcaactcttgggatggtaaaagaggatagcagaaagaaaactgggttggaatcctaactctatgattgaagaaggggagctgggaccttgaacctcataaggtgattataagtaatgagataatatgcgtctctggcacatagtagatgctcagtaaatcattacactagctcatattcattgatgtttatcaagggctaagtatgtgctaggccctagacataaatctcctgaattgaattcaaccagattagatcgattttacactcctgcttcgtttcagggcatgaggaatgctgagagtcagcctcttggggaagttctcaaaacttcaactcaatttgtgtagtagttgtgcacaattcaggtgaggtgctcatatttcctcttagtcatattttaataaatgaaatatattctatagtttacaatcataaaacaactttctttcttctgttgtcccttcaaaccttctctttaagaggttctttctctgcccctagttgagatttcagacaaggcaggtggctttctgagtcattcccggacacaagggtcattttcagtcgcaggcaccacctcatttgagtattttaagtagccaggctatggtaataatacaaaccctgagcttttatttatattggagagtctcccctcttacagtagggcaagactgcagatggtgattgtttgccagtagccaggcagggctgtgtggccaatgtcctccccatctcccccactgaccctcctcgcacactccccagctgccgcttctgagccattcaggatcagactcagggcagtgggtattagaggaaaagagcagcagtcttacatgatggggacgctcagaacctggtgctggtgcccgctgagcctggcagatatgcaaagctgacccttttgtgaaagacactgcaggttgtcctgggaacctccaactcagttaacataacacaaacgtgaccgtatgtccactttgcagggacagttccagtggaattctgttgcctcagctatctgttagtaggcagctatttgagaaaggattctttctcaaaagtatctccagttaggtgataagttatagagcatcctacttaaaacagatgaggcttctctggaggcacaaagttcagcttccccccagagatctcctcacactggtcaccgcatctgtccaggggggtctatggacagagtcccttcaggaaggctccgggctgtctgcctcccgcatggctcaatctatatccatggataatggatgcctttcctcaccattgtctaggaaactgcagctcacacctactgcaactcactctccctccctctctttttgcagttcttccttctcaggcctatcttactgtcacttctcagtcttcatattcctcccactcccagtagtatacggaagccccctaaagcccctctcacttggcttacagtgaggggaagtgtccctcactcctctgctctacgagccttctaacacgtgcctccaaaggaatctgcactcttggctgttttttgtttttgtttttgttttttttgagacagtgtctcttgttctgtttcccaggctagagtgcagtggcacaatcatagctcactgcagcctcaacctcctgggctcaagcaatcctcccaccaaagcctcccaaatagctgggactaattttttatttatgcagacaagtgtcccactgtgttaccctggctagtcttgaactcctaggtgcaggtgatcctcccaccttagcctcccaaactgctgggattacaggcatgagtggccacgcccagtctcaactctctttaaaggttggaggtgggtgactattagtcttagcaggcctggttttatcatttcttagcatgtcatgaataacagttcctcttcatattctttataatgtggtgtcagttaatacctattgtaatattttctgagtttaaggattctgcccatcacgtgaaggacctcttcaaggagaactacaaagcactgctcaacgaaataaaagaggatacaaacaaatggaagaacattccctgctcctgggtaggaagaatcagtatcgtgaaaatggccatactgcccaaggtaatttatagattcagtgccatccccatcaagctaccaatgactttcttcacagaaccaaaaaagaggctgcattgccaagtcaatcctaagctgaaagaacaaagctggaggcatcacgctacctgacttcaaactatactacaaggctacagtaaccaaaacagcatggtactggtaccaaaacagagatatagaccaatggaacagaacagagccctcagaaataatgccgcatatctacaaccatctgatctttgacaaacctgacaaaaacaagaaatggggaaatgattccccatttaataaatggtgctgggaaaattggctagccatatgtagaaagctgaaactggatcccttccttacaccttatacaaaaattagttcacgatggattaaagacttaaatgttagacttaaaccataaaaaccctagaagaaaacctaggcaataccattcaggacataggcttgggcaaggacttcatgtctaaagcaccaaaagcaatggcaacaaaagccaaaattgacaaatgggatctcattaaactaaagagcttctgcacagcaaaagaaactaccatcagagtgaacaggcaacctacagagtgggagaaaatttttgcaatctactcatctgacaaagggctaatatccagaatctacaatgaactcaaacaaatttacaagaaaaaaacaaacaaccccatcaacaagtgggtgaaggatatgaacagacacttctcaaagaagacatttatgcagccaaaagacacatgaaaaaatgctcatcatcactggccgtcagagaaatgcaaatcaaaaccacaatgagacaccatctcacaccagttagaatggcgatcaataaaaagtcaggaaacaacaggtgctggagagtatgtggagaaataggaacacttgtacactgttggtgggaatgtaaactagttcaaccattgtggaagtcagtgtggcgatccctcagggatctagaactagaaataccatttgacccagccatcccattactgggtatatacccaaaggattataaatcatgctgctataaagacacatacacacgtatgtttatagcggcactattcacaatagcaaagacttggaaccaacccaaatgtccaacaatgatagactggactaagaaaatgtggcacatatacaccatggaatactatgcagccataaaaaatgatgagttcatgtcctttgtagggacatgaagctggaaaccatcattctcagcaaactatcgcaaggacaaaaaacaaaacaccgcatgttctccctcataggtgggaattgaacaatgagaacacatggacacgggaagggaacatcacataccggggcctgttgtggggtggggggaggggggagggatagcattaggagatatacctaatgtaaatgatgagttaatgggtgcagcacaccaacatggcacatgtatacatatgtaactaacctgcacgttgtgcacatgtaccctaaaacttaaagtataattaaaaaaaaaaaaggattctgcccatctccgaaacaacaggaagagtgaattgaatttaatatctaattatgtatgatttaataaagaagaaggggaaaaaaccctcctggtctactaaatcctgaaaagaagatgattcctgtctcagtgcatgacccaaagctacagcagattccagaaatgcaatgttgaccctgcaggaaagtagctgagcaagtgcagccttagccagaatttccctcaccataaagaggggacagatgccaccaggtctgcctcagcccattttcttgaatttcttcttcaagatgccaatggatgtggcatctgaaagtctgattcaggtttatggcactcataccctggaaaaaaagctctgtacaagttttagctcagctttgaacatgtgaacaggaagtctatcctagtattgccccttctatatgggaaaacctggctgcacagctaactaaggtgtgcacagaaacatcagcctcgctggttgcagttctcagtctttcacccaatccaaaaggtagagaaggaagatgctcttctctgtgtcttcagggggttcacggtggtatccttcgaagctgaagggcagaaatccaagaatacgaccacacagaggaatcactgtgttcacctccgtttttcctatgggtacctcgagaagactgctgggcattcccaggccacaggttggctcagtagcttagccaggaacaatctgtgaggcctgacttttagctctgtgtcctgctcactatacaactcaagctctgtggagtagcgtgtctgcagaaacaaagaaaagctttttagagtaatcgcaacttttcccacaagccgtgttttcataggagctttttgctttttttcccagcagcaaggtaaagcaagcaattgaactaacttgttctcagatcaacgagtccattgtgtgcttcagggagcaaaagggtgttttgttgttgttgctttttttctctctttcgatgttggtttggagcagaaattaaacttggccatgggctaagagggaaaagaactggatagacaactctttctttctttggttgggattcagatttctgtaaaaatccataggtttataagtgaaattgttactaaatatgtacctactgatacacatgtcctctttcaaacaccccttcaccctgctcctttcctcctcacagtagcgccagctacactccagaacactaggacaactttaataaggggctaaactatttgtgcctgacattgcttgattatcttgccaggaaaacagatgcaaggtcctgaggtactatctcaaatactggcaaagaaagggagattgaaaagttcatgcttaccatgaacaaaatttcagatcaaaattctacaatgtcctaatctacttacaaattggggaaaggagtggcactattttttccctgtttctcctctgctcacaggtgatttcaacagagtctgttctcagttctggactagtttaactgtaactggagccaaaacagctcaataggaaagaactgtttttttcagcaaatgatgctggaacaactggatagccacatgcaagagaatggagttgggtccctgtgtcagtcagcttgggctgccatcacaaaataccatagactctggggcttaaagcatagactttattgtctaacagttctggaggctggaagtccaaaatcagggggccagcattgtagggttcctggcttgcagatggccgccttctcactatgtgcgcacatggcagagagggagggagagagagaggcagagagagaaagatcttccccttcatacaaagccacagtcctatctgaataggctccacccttgggagctcatctagccataattacctcctaaagaccctatctcctgatacagtcacactgggagttgttaggacttcaacatgtgaatttgggggagatacaattaagtccatagcagtcccatcctcacactacacacaaaaactaagtcaaaatagatcagagacctaactgtgagagcaaaaactgtaacacttttcagaagaaaatataggagtaaatcttcaccaccttgggttagaaaaggccttcttagaaaagataccaaaaatacaaatgagaaaaggaaaaaagatagataaatcagacttctaattaaaaactattgtgctttaatggacaccatcaagaaagtgaaaagacacctcgtacaatgagaaagaatatttgcaaatcatatacccgataagggacttgtatctggaatatacaaagaactcctacaactcaataatagagacaaagaattaaaacataggcaaagaatctgaatagacctttctccaaaaaacatataaaaatggccagtaaacacgtgaagaggtgttcatcattattaactatcagaaaaatgtaactcaaaaccacaatgagatatcacttcatacccactagacaactataatcagaaagaaagataataacaaatgttggtaaaaatgtggagaaattcaaatcttcaatatgccgctggcggaatatgaaatagtacagccactttggaaaacagtctggcaatttcttaaaaggttaaacctaaagttatcatatgaaccagcaattctattcctgggtatatactcaggagaaatgaaaacatatatccacacaaaaacttctatacaatgtttatagcagcattattcataacagccaaagaccaaaagcaatccaaatgtctgtcaactgatgaacagacaaaatggtaaatctatacagtagaatatgatttggccataaaaaggaatgaaatactgatacaagctacaacaaagatgaacctagaaaacactttgctaagtcaaagacgccagtcacaaaagctgcatattgtatgactcaatttctatgatatcagagtaggcaaattatagagacaagaaagtagattagcgagttggcttgcgtagggtggggtgggaagaaacagggagtcactgctaatgggtgcaggatgtcttcggggggtgatgaaaatgtcctaaaaatgattgccatgacggctatatggctctgggaaaatactaaaaacaattgcgttgtacattttaagtgggtgaattgtatggtatgtgaattacaactcatcaatgttgatagatgtgtgtatgcatatatgcacaactgaaaaaataacattccccgagatttgaaacagaagcaaaattaagagaaaacgttgggagttagacccaacatttgggctttcattcacttgggagaaagcgtcaaagtgtctgaaagctagaaaaatggaattaagggaaaatatactcaggaaaaccaagctggagtgtagattgtgttaagctgaacaaaataataaggcactatcttgtttaaagaggacagagcactagcatatgactttgaccatgcttagaatgcttcctgataggaaggaaaaggaacccacacagaccagccacatctccttccctggaagtgaccccatctgtgatacgtgaataacacaactcttcccccaattataaaaataacatatttaagatagtataaaaatgcagagaatggcgcgggcaggaatcatttaatcttgccatgcaaagataagtactaatatttgtcagaggtccctcctcagcacattgttccatatattcaagctcatgcaatacatacacttttgtatctatattttacacttaaaatcaacatttttcattatcatttcaaactctcataaatattactttcaatcagaagaataaaccataatttatttaagaattttcctaagccagggcttttatcttttcaatctttcacttttttttaaatgttgcaaagcaaattttgagcatagaggccaggcatggtgacacatgcctgtaatctctgcactttgggaggctggcagatcgcttgagctcatgcatttgagaccagcctgggcaacacagcgagaccctgtctctactaaaaatagaaaaaaatagtcgggcgtggtggtgcacacctgtggtcccagctacttgggaggctaaggtgaaaggatcccttcagcctgggaggcagaggttacagtgagccaagatcatcccactgcactccagcctgtgtgacagagcaagattctgtctcgaaaaaaaagaaaaaagaaaaaagaaactttcgagcacagatttgtcttatcagattcaattatttcttaacatataaataattttatactaaaaggtgtgaaactagtggtcttcatagtgctaatcaaaaatgttttattaagttggtgcaaaagttattacggtttttgccagtatggcaattacttttgcaccaacctaatactaacttatacattaacagcagtaggtgatacgcccattcactatcaaacatgaggactcctgttccccttccagaaggaatcctaaggaaagaattctcactgcagcatgatttaagatagcaaaaattgaaggaaaaataaatagccatcaatattggaaaagtaaaatagatcctggtgagttatttttcagtgattaaagataagtggtttcaaagaatatgaaaaaaaagattttcagcctaagcaatgtagtgagacctcatctctactaaaaataaaaattaaaaattgtccaggtgtgatggtgcacacctgtagtcccagctacttcggaggctactgggaggatcgcttgagcttgggaggtcgaggctgcagtgagctacaatcgagccgcagcactccagcctgggtgacacaagctgaaaagaaaaaaaaaaattcacaaattctcaaaagaaatggcttgtatgtcaaacaccaaattctttgtgagctcgggtaatataaaaacacaccagcagtgtaggccgagcgcggtggctcactcctgtaatcccagcactttgggaggccgaggcgggcagatcacaaggtcaggacatcgagagtatcctggctaacacggtgaaaccccatctctactaaaaatacaaaaaattagccgggcgtggtggcgggcgcctgtagtcccagctactcaggaggctgaggcaggagaatggcatgaactcaggaggtggagcttgcagtgagccgagatcgcgccactgcactccagcctgggcgacagagtgagactccatctcaaaaaaaaaaaaaaaaaacaaaaacaaaaacaccagcagtgattaagtctgggttgtgggatcatgagtgattttgtttacttatttgcacttttctctatattccaatctgcctatactgacaacttactactttcatagtttttaaaaatctttgattttataaattagcccataagtaaatttgctttcagagactatcctgcatagaaaaggtggaaggtggaaatccacaggtgcaattgaaacatggtcagggggccaggcgcagtgtctcaagcctgtaatccaagcactttgggaggccaaggtgggcggatcacctggggtcaggagttcaagaccagcctggccaacatggcgaaaccccgtctatactaaaaatacaaaaattagccaggtgtgatggtgtgtgcctgtaatcccagctacttggaaggttgaggcaggagaatcacttgaacccatgaaacaaagattgcagtgagccagtgggcgacagagcaaggctccatcagaaagaaagaaagaaaagaaagaaagaaagaaagaaagaaagaaagaaagaaagaaagaaagaaagaaagaaagaaagagagacagagggggggggagggagggagagagagaggaaggaaggaaggaaggaaggaagaaggcaagaaaggcaggcagtgggggatccggagtcttgcagctctggcttctagctccatccatgctgccttctgggtgtgctttgtgtcaaggccttgactggacctcattcctcattgttacagggaaatggcaggctacctgtatgcactaatgatcctgagcccatgttcctcaagagtgccatcccagggctgggctgcagccgtctaatgtgcattaacagttgatgcacatgaggcaagcatccaagaaaggattctacatttcctgccaagcatgggagaaggtgaacctggataatgcttgcacttgggaagctaaacacaatttcagcttcaaggaaacccccagattgcaaaattcttggacagaaagcaaaatatatctaatatttctgccaccatctctgtgagttttctgccaccattctccaccatgacctctgatctgtctagcagcctgctggatttcacacgagcaaagctaaaatgggaggaaagagggcatatgaaaaaaaaattagattgacagaaaacccagagtcaataggacagtctagactccccagcttgtaaactattcataatgactcactcaatagtcaggcattgacaacaagctgaatgactgtggacctagagctacaatattggcaatgttatctttaatttgaagagctcaaataattctgggaggcattaatcaggtaaagaaacacttgccctggatcaaaaattagtgtcagttggttaccaaggatgggaatatggttaaccatattcttttatttcccaggttattgtcataacatctctgtataattttatatacccatatgcacaagtggccagaaatccctttctagccagcagggacccacaaggttctgtttagcagatttatcccaataatctatcctcattaatactgtataagaaaccacctaaaaatccaatggcttaaaacaacaaggatttcgctgggtatggtggctcatgcctgtaatcccagcactttgggaggtcaaggtgggcagatcacctgaggtcagtagttcaagaccagcctgaccaacatggagaaactccatctctactgaaaatacaaattagctgggcatggtggtgcatggctgtagtaccagctactcgggagctgaggcaggagaatcacttgaacctgggaggcagacattgcagtgtgccaagatcacgccattgcactccagcctgggcaacaagagcgaaactctgtctcaaaaacaacaacaacaacaacacaagaatttagtctcacgtctacaggtctgcaagactgactgtggttcagcggctctaggctgagcaaggctacagttcggctgtgcttaacgccaacctgtccttagctccagcctataggttgagctgtaggcaagcgtgttcattctgggcctaagctgagtggataacagctgcctggggaaagttcttcccatcatggtcactgagatacaaaaagatcaagctttaatgcgcaagctcttttcaagcctctgccatcacatctaacaagtattctttttggccaaacccaaagttaaggggcaagaaggacactcctcccaccatgaggtcacagcaagggtgttgatgaataattctctttaagtgctgtgatgaattgagaatagcaattctattatccactgtgatggttaaatctccactggttaaatcttgaccagttcctcttctgactacttctgattttctcctttggcttcccagaccacatgcacaacccctgcaggtgagccagaatgccaagaagtcagcattataaggctaaatagagaaagaacaagttttctttttggaaagttcctcccaacctgcgatgtgtcaagacatcaccattaattggaaggggacacgattatgcaaaataactgagtataaagaacttagagacaaaaggggagtgaggggaggaaggagatgtagcagtttgaactatacgaggtttaaattaatttcaaccaaaacataacaagcaaaggatgttctcctgattatcttatgtttactattatatttcaaaggcaatacatgcttattgtgtgtggggggaatcaatctagtgagtagaaaacacaaccatctaaaaccccatcacccctaattagctgccattcaaatcctttatacatggactactttgggcattggaaatcaaggtgctgctacctaaacagtgtcgtgaaaattttaaggctctgagaaaatgttaaggccatttgaacaccagaaattcttgttctcatctctcaactacaaatgcctaggtgagttctcgcttacagatttttttcaaatttacagtatatgcaatttatttatttatttatttttgcaaaaatggggtcatctattacataccacttttcacattagaacaattttcctcatcaacaaagatatgtctatatcatcattttaaattctgccttatatttcatttataaattaccataaattacttaaccaacaccccattgatggaagtttaggttatttccagtttttcacaattactttctgcatgcataataactcacgtcacttcatatacaaactgaggcatttattttcattttcagatctaagaaatctaagcagtgccttattgacaataaatagaaccacccttgtggtgttaaaatgtgggcagcaagaaaggaaatagtgtggttgggtggagattagtcatttttgaaagagcacgtatgtacattttgcacgttggtgacaattcactcaaaattttaaagaacccagcttaagttttgaatcagcctgaagcactccgaacttcagatgctcatctcagcctcttaagtctgccaaccaagctggagacaaaacaagatctggctccctggtggccgcctgggaatcctgcccttggcgtcatttctggaagggcaaaagaaccctacggactcttgtatcactaggatagaaatgccacccagctcctcagcccatctccatcaccatggcagtggggaggggcctaggcattatcagaatgggtcaggactagctcagagccagtgtcaggctggctgactgtaaactaagccaggctttcaagggaaggcttttgaaggaaataagccaacaaaacagcatcagaaactgaggaaccattccttctccaactctaccccccaagagataccaaggtcacacaggatacagcagttgttgaaattattactgctatggaacagagcttttttggcaccggaagaagtcattctcttctgtcaaccctcttttcctttcccttggattttcaatcctccccatagaaaatcaagaccgcccagcaaagaacatgcttacccaaaagaccacagtgccattcagaaacaagaaattccaactctaccatacatataaccttctatccatcctctgaccttctgacttcataatgtatcttcccaagataaatagatgcatggcatgttaaagcctaggaggaccatggagattgtgtcaatatctttatccttcagtgaatagatggaggcctcagagaggatgagcaacctgcccatggccccacagaattggtggcagagcccaagactgttggcccccaaccacactgtccagacttcaaaagctgatcctcttgccaatgcccccacactagtaacagcctttttgcctgaatgtctctcagtgatgtcatgaagacaaattactgtctagctgtatggttctttagtccttgctgtatgttattgtacctggcaggccctcatggaaactaagctggaaagaaatgaaggagctcaacttggttaaaaccattgacagaacactcatcccccatcttttgctctctagacaaccgcaggtaaatgtgaggcgtttgagagagttaagccttctgtatcagttaagctaaaagaacagtttatttcatacccctaaacttcacaggaatagaacacaagctaccaggcagcaagaacaaaggaacagactagatacatttatttttcagaaattttaagccatggaagaacaaaaaaaaattcttcaaagaaaatttaggggcaggggattgaaatacatgcaaaacttatttttagtgccctttacagatataaagtcatgctgttcgtttaggaacaaaaaaatgcattatgtataacttgtttcactcataaaattaccatgttttgtatattgatatatttagacattgggagatctgaaaaaagcatttttatgatttctttcctggttattttctcgggcaaaagggaggtttttaaaaaaaaaaagtcctcagtggaaaaacttttcagaattttgagaaaatttacagattttagaggatttttacttttcccaaaatgactaagtcatcaggttctcaagtcattgaactctaatgtgttcaaccagcgtcctctacttatcaagataatagcacaaccgggtttagtaatggtgacctattgtggaactttcaaaagtccactgtagaagtcccacaaatttgaaattcactttgccctccaaggtaaatcttttctgttcttcccactgtagcactacttaaagtccatttctagaaatgaactgggagaggtcataagtcatttaatttagaccctacatgagcacaaatcctgtctatacgaggtctacaaatggtcaactatcccttgcttctccacagtcaatggtctaaggcctaattgtcatgctttaccatatacatttatgaatgtgtgatgatctgagccatttctgtcttcctcactagactgcagctgccatcagggcaagaagcaaaccttctctgctgactattttgtcctgaatgtctaccagcaatgggaacagagcagtaaatctatgctcatatcttctgagatagctcttaatattacaatttctctctgtgtattgaacttatattactttccctataacttctatgtactgagtggattctgcccttcttgtccatctagatctttcacaagacagcccttcaaatatatgaaacatgtcatcctccactcttctctcctctaggctaaatatcctgtttcttcagcttctcctctaggctaaatatcctcagctgtcccacatgtggtgtgatttttcagttccttcattaccttggatgcccttctcggaagacatcactgctctggttctataaacccacacggctaacatggaaggggagcagtttctggaatggaaggttattgacatattaagcgatctcccccaaaaatggttccaaagtctgggactaaaccagaaccctgtaatgctctttgccacaaactgattggtgaccaagtcaccttctacagttacataaggcatttagaaagacacaaggaacagatagaggagtgactggtgaccaagactgctagttgtccgctaaaatacattctccccttcctctatggcaatacaacccctaatttttagctggacatgtagctgtctacagtaaaggcagtgtttcccaacctgtcttgtagcttagtgtggccctgtgaaaaagtttttgttaatggaatgagttaggaatggaatgagcagactttgagaaccttccctaagagatggcacacctgcactcttggcacagctgctctatatttcttccattcttttccctcaaatgccagcatctgagactatgagcccaaagtcacacacaaatcaaggagtgtctgtctacaatacttttttttttggtctgaaaaagaaataaactgctatcatgttcaaaccattgttaccctgggtttttgttgttgtttttgttgttgttgctgttgtcacagccaaaactaatcctgatagtctattgctatgtcttcaaccttattcaagtagttttgtaactgaagcagcacatggtgtaattaaacacgaacctgcaagctgataactttcccagtgtcgcctaccctgccaaggatgagggtggcaagcttagggtctggcatcagagagggtgtctgcagctctaactgaaaagagcttccaagagctgactctcttcccagtaaaaaaaaaaaaaagaaaaaaatacgaagagaaaagggaggtgatgccaccatacaagaggaaggcataggtattattttgcaaaagaggatatactatttttcttctcccttcattacatttttgagatttaatggctaatttcaaaattgcttaatgggtcaaaagcacagccctcagatagagtaggacaatccatggaccctagggaacctgcagagacgctcacatggaggtgagtggcaggaacaccaaatggcggagcacgcctgaggccggggaaaggcaagtctagaagactccaccttcacaggtaggggtgacaggcttcccaaagactggaatttcagctcccatgtgccatttcctgatttaatgtcagtcatttgccagttcttgttaaaatcaaacttctattacaaaaaacttagaaatggtcaaagtactaagaagaggcaggttgtagtagctccgtattttcaaatattcccaggcattatgtttctgcttagaatgtagaaagtcacaggagaccatggttctccccttacattaagaacaagctaaataagctactaatcatgttctaaaactcatcacaaagagctgaggacacaaagaaatgaaaacaaagtaaattccagaaagtgataagcactttctaggagaggagagacctatggctgctttcatccctgacagagtaaagaggagaaatcagccagagacagagataaggagaaaccagccaaacttttaataaaagttaattattgcaagcgtgaagctgggcacggtggctcacacttgtaattccagcaacttgggaggccaaggtgggcagatcgctcgagctcaggaattcaagaccagcctgggcaacatggtgaaactccatctctactaaaaatacaaaagttacccgggcgtggtggcaggcacctgtagtctcagctactcaggaggctcaggtgggaagattgcttgagtccgggaggttgaggctgcggtgagctaagattacaccactgcactccagcctggttcacagagccagaacttctctcaaaaaaaagcaagtttattagaaactttttcctagaatgcttctatcttagaccatgacctactattaatagaacaccaagcagctccagcctcagagcaagtcggcacctacccacctcttctccataggccttcactagtgcatgggactactagacagaagtctgaaggcaaagcaagagacctaagagagtgccgcacacaccttgaaacctctggaaaaaatgcattttccatacatatcacttaatcaagtaattttgtgccgtatttcatcatattcaagacactatcaattataagatgcaccattattttaggaccactacatataactaatgtattaaggatagtaatgtgcaacacatgaatgactcacactgtcctctcgttacctagaaatctgagatttgcttatttctcctgccttaggttgcagcgtttcaaatgcaacagtgcagtgtcataatgtaatctttctgaagacatttctgatcccacttaaattcaacatttgtacttctgacaatgaacataacccaagtgaagtgcagacattgtgccaatctttgaagaagctcacacataagtaaacaatgactacgtctgactgctgcctggcccacaatgtttgtgagacaccgctgctggtaagagacttcccaatttcagaggttaatatgagcccaaaatgtgcactttaggatcatcacaatatgaacaaaaaattttcctcccgatcagtactatctatgactcttctgttacttgtgtatttctaaatgtcttatgtatctatagaaaggaccccacatttgcattttcctttctcttctcatcattatgtctattcagagttctctccttcagtggtgatactagatttttttaattgacagataaagttgtatgttatttatcatgtacatgatagtctgatgtacatgtatttcaagctaagcatggtggcttatgcctataatcccagcactttgagaggctgagacaggaatttgcttgaggccaggagtttgagaccagccttggcaacatagtgagaactcatctctacaaaaaattttgaaaattagctgagcatggtggcatgcacctgtagtcccagctactcaggaggctgaggtgggaggattgcttgagcccaggagatcaaggctgcagtgagccatgatagcaccactgcatactccagcctgggcaacagagtgagacccccctccctaaagaaaaaaaaaaaaaaagcatctcctcatattccttacatagtcattacttttgtggtgagaacacctaacatctactctcttagcatcagaggtgatattttaaaataaggaatgaagtgtgtgtagaagatagtcaggagggatatccccaaaatacaaatattacctgtgggtggttatctatgagtggtaggataacgggtgatttttattttcttctcttggtttattatattttataattttccataaaaactattattacttgggtaatttctaaacatttaaaagaaataagcctaatgcaaaatgttttaaaatatcatttgaaaaaagggtaaacaaaatcaaaatacaaatgatagctgggataaatacatacaacacaaaataaccaatatccaactcaatacaatagaacaggcaactcactcaagaaggaatacacagggccaataaatgtatgaaaagttgctcatctgaattaaagcaacaaagagatgccatttttttttcactcctcaggttggcaagaaaacattgtttaaattaaaaacctatagcattctgtgctagcaagcatgagaagaagcaaccactctcacacactgctaatggaatgggaatcgctacatccttttttggaaatccggatggtaacagctactaaaaattgaaaaacacatagcctttaacccagcaaccccacctctaggactctatgctatggaaatgaaagtgctatatatttgtaagtgaatttttagttttagaatagttttaaatttacagacaacttataaaaatagtacagggaatttgcatacaccctacacccagtttttcctacaaacatcttacattagtatggtatatttgtcacaactaatgaaccaatattgatatattattaactaaagtccatattttgtacagatgtccttagttttcacctacatccttttactatttcaggatcccatccaaggtaccacatagtatttgatcatcctgccttctaaggcagcagtccccaacgtttctggcaccaggaaccagtttcttggaagacagtttttccacagacatgaggggcaggcagaggaatgagatggtttccagatgaaatcattccacctcagatcatcaggcattagttagattctcataaggagcccacaacctagatccctcgtatccataaccatagttcacgttagagcttgcctcctatgagaatctagtgccgccactgatctggcaggaggcagagctcgggtgctaatgctctggcccacctcacacctcctgctgtgcggccgggttcctaataggccacagaccagtaccagtccaccgcttgggggttggggaaccctgacctttttttcttttctttcttttttttttttttttttgagacagggtctcactctgtgacccaggctggatggagtgcagtggtgcattcacagctcactacagcctcagcttcctgggctcaagcaatccactcacctgggccacacaaagtcctgggattacaggtgtgggtcaccatgcccagccaggggcccctgttctaaggctcttctacactgtgacagtttctcagactttccttgtttagtgtttatctaattgacaaataataattgtacctattcatggggttcgtagtgatgtcttgatatacataatgtatagtgatcagatcagggtaattagcaaatccatcatctcaaatatttatcacttctttgggctgggaacattaatatcctcctcctatttgaaactatatattaactacagtcatgttacagtggtgtagaacactaaaacttaatccctctatttagctgtaattttgtaacaaatctctccatatcctccccttccccttagccttcccagcctctagcattctctgttctactttttacttctacaagatccatttattttagctttcatgtaagactgagaaatgcagtgtttaactctgttcctggtatatttcacttaacatcatgtcctccagtgccacccatgttaccatgaatgacaggatttcattcatttcaatggctgaatagtattccattatgtatatataccacattttctttatccattcatctaggttgattctatatattggctattgtgaatagtgctgcaataaatatggggctgcagatgtctcttcaatataatgatttcccttcctttggataaatgcccagcagtgggattgctggatcatacggcagttctatttgtagttctttgaggaacctccatactgttttccaaagtaactatgccagtttacattcctaccaactgtggataggagttcccttttctctgcatcctcaccagcatgttatttttttgtctttttgatagtagccatcctaagtgagatgcgacgataccttattgtggttttgatttgcacttccctgatgattagcgatgttgagcattttttcgtatatttgttggcatttgtatgtcttcttttgagaaatatctgtttaggccatttacccatttttcaactgaattgtgtgctcttctgctgttgagaagtttgagctccttgtatattctggatattagtcccccattggatgagtactttgcaaaaattttgtcctattctgtaggctgtcttttcactctgttgattgtttctgttgctgtgcagaggcttagcagtttgatataatcctatttatttattttttggttttattgcctagtaagcactcattttgaatgatatatttacaagaatatttactgcagcattacatctagaggtaaaaactagaaacttcttaaaatccattaaatgaagattaaataaatttgggaacacccatacccttcagataactctaaagctattaaaaagaatgatttagctattttgatctggagagagatccatagcaaaatgttatatgagaaaaacaagtcacatagaactaaatacactttgatcctaatttttcgaagtaaatttatatatttttattagcttgggaaaagtcatgaaaagatgcagaataggtcattgtcattggttaccttagggaaccaggggtagaattgctgaaatgaggccgggcgcggtggctcacgcctgtaatcccagcactttgggaggccgaggtgggtggatcatgaggtcaggagattgagaccaacctggctaacacactgaaaccccgtctctactaaaactacaaaaaattagccgggcgtgatggcaggcacccgtagtcccagctacttgggaggctggggcaggagaatggcgtgaacccggggcacagagcttgcagtgagctgagaattgctgaaatgatgagaacaatgcttaatttttttacttctttcttcatattattttactagtgataaagaacatctgtgaattctccaattttggaaacgtaatttaatagaagatttttttaaactgaagaatatatgccgtgcatcctatctttctggagtggtgcagattcaagatttggtcttcctccaggtgacagaatgaatccatcttctgcttagctgagttaagccaataagtttccttaggcaacctgattctttgcctgatcttttgatatattaacttttttttttttttttttttgagacagagtctcgccctatcacccaggctggaaaacagtggtgtaatcttggctcactgcaacctctgcctcccaggttcaagcgattctcctgcctcagcctccccagtagctgggattacaagcacgtgccaccacacccagctaatttttttgtatttttagtagagataggattttagcattttggccaggctggtctcgaactcctgacctcaggtgatctgcccaccttggcctcccaaagtgctgggattacagatgtgagccaccatgcccggccatgatgtatgaatatttttatgtttttatttcttgaaaaaagttctagtgtagtcattctatcataaggctaactggatacagcatctctaaccaaactatgccatgccatcatacgcaccccaataattccaggaaggatgttgtgtggttaagtgagaaagagttgtcaatccttggcaagaaggggggtaatgttcccaaaagtgaatgtaagatgaagatttgaaagctgttccaatgagatctctttggttccttccattctagcccagtctccttgcttccatcagccaccactgcagttcagtcgggccgaacagctgtacaattgagagggatttaaactgtcccccaagtttgcctcctgcacagcacccagagttctgctgaagatgccaacaggtgccatgcatccatgccagcacaggggtcccttagtgagaaaggccctcacagccacaataaccatccagtggggcttggcaatcaagaacctaattaaaagataacttgtcaagagaaactctagttgaagtctgccccatctttacatgaaaaatatgtggctctgttataacagtggtcaaacctctctcaaaactatgagaccctgggagaaagcagtgacattcttctatttgttcttttcccaagaatagggaacaaaaaattactttcctctgcttttcagtaattaccaaatcaaatggcctgaagctttcttactatctaaccagaaagcagatcccttgccagattcctagttgataaagtcatcaccagacaccgtattgtggctcctaggctttcatctggggacacagattggaagggaaaaaaggcacaggcttttactggtctgggaacggtcagatgataaaatcgggatctgtgatgatccagcaagcatccgctgagaggcaagattatttgaacactaattattcttatgtgcctgatagttcaggaagacccatgagcctatatttctccccatgcttcaactgcacatataaaattgctgtttataccaactctctcctccaggcagctgtttacccaagagagaggcaggactttggagttcatcagcttccaacaaattttcaggaaggagcccggtatattctcttctacccacgtgttccgaacttattacagacaagacagcgggaggatctcagagaacaagagcctaaaactagtgactactgaggttacagatagagtggacaactgacatttgcctccttaacatccattctacctttttttgcctacagctaaagacttttgtttcaggaatatatcagtcagagttgtccaggaaaactgagtgggcacacacacacacactcacacacacacacacagagagagagagagacttattatgggaattagcgcacatgattatgaaactgagaagtcccaccatctgctgtctgcaagctagagaagcaggaaagccaatggtaattcagtctgaggccagaggcctgagaatggtgtggggactgctggtgtaactcctagagtccaaaggactgagaaccaggagctccagtgtccaaaggcgggagaaaacagatgtcccagctcaaggagagagagtgaatttgcccttcctcttcctttttgttttattagaacgctcaaacagatgagatgatgcctgcccacactgatgaagattatcttctttactcagcctactgattcaagcactaatctcttttggagacaccctcccagacacacccagaaataatgtgttgcaagctatctgggcatcccttagctcagtcaagttaacacctaaaatcagccctcacaagaatctacctctccttctctcagtcaaagcgctgcattctctgcaataatccaatagcacccataatatgcaatagcaccaatgagatgaaatggaacttttgctgggacttctggaaaagtgacctgatatgttttcccctgagacttgaaggtgagaagaggtgagcgtggagttgtgcagccaccgtgaccccaaaggaagagactctgagaataaggccaagatgaaggtggctagggtcatgacatacatagaaagggggcatgatggcagcaatgtgaaaacaagcagccccccaggcccagagcatcacatgaataataaattccctttttgcctaagctatttggggtaggactgcttttgtcgagtgctaaagaaagcatcctgtctgataagacatgatatggcaaaaaaaaaaaccacaggtcagaatgagaccagtcacatgttctctgttttccattttaaatttccaagcatgtgctcactattcacatggccaaggaaggtgtcacattatcacctgaggaggggctccttccagtttgtttcagccttctgtaggagacatctattttcagaacaagaaatcctgatgggaggccaatgtattgcttactgtcattttaattttattcttattaatagtaattacgatgcatctctcaatatccagagatcattcagttaatccaacattggcaggaggtgtgttctccacatttgtggagacagttttgctattagtcatccacattctcatatggcccccatggtgacaatggcttatccaaatcctccctagtcctcctgtgtgttttaattaagttggccactctacactagccacttaagaaagatagggttattggggactgtacacagcaaaggaaaagatagagaagccatcactctattctcccactctaggtcccaatgcagcgtattcctccaatctgatatttcttgctcaggatgaatgaagcatgaggatgttcattacctcccttaacgtataacttggcaattgaaagacagtcccctctttttttttttttcttgcctttcttttatgatggaaattgtaaatatcaggttaggtctcaaattatcatccagctaaacaagacatgcaccaaagcactcactctgaggaggacttacaactctcagggtgctcccactcatccagatggctaggaaacagctgatccccctctccatggccatgagatcagaatggggacctgcccttcattggctagtttctttttaagatccaggcagaggagttgagaactaattgttattggctgtgctagtgtattgtcctgagattcctgtgccttcagaagagaatttttggaggggctgaggtcttagaaagtcagacaaaataactgctaaatgaacactgttgatttccaaaccaaatcatacttaatgactatgcctggccaggcacattggctcatacctgtaatcccagtactttagaaggtcgaggtgcgaggattgcttgaggccaggagttcaagattagcctgggcaacctagtgagacccgtctctaattccaaatttttttgaaaaagaagaaaaaatatctacacctggctgggcatgttggctcctgcctgtaatcccagcactttgggaggccgaggcaggaggatcacctgaggtcaggagtttaagaccaggctgtcaacatggtgaaaccccgtctctactagaaatagaaaaattagccaggtgttgtggtgcacgcctgtaatcccagctactcgggaggctgagacatgagaatcacttgaacctgtgaggcaaaggttgcagtgagccgacagcaccactgcactccagtctgggcaacagagggagactgtcgcaaaagttacaaaaaaaaaattatatatatacatacacatatacacctaacatgatcaacgtggcttttccttcacctttctccaagggcaaaagttgagtaacaataacaatattctgtgggaaattcctggtctgatacatccaaatccttccaaattggcacttgtattccttttcctttactttctcaaggtgagataatcacaaacaggatttaaagaaacctcacacatgctggcaaggtggagagtaagaatgcacaacggagccaaggaaagagaacaaggctccttcccacctggccccacgcatcttatcagctttaactccaagagcctgtgttcgcctcttcctcgtgaaggatggggcacctgacgtcttgcagctgaacttacgattacattgcagcagaacacatcaaaagaacaaatccaaataatgacataagggaaaataatcaaagaaattcaagaagtaatccaagaaatcatagccagggagcgtcagtgcacagagaactcagaatcctttccaaaatcaaagaatcattgtgtcagtaaaattcagaagagaaaacacacaaactgcttttcctctgctttcacgcaacaaacaacacggacacaagctgcatgtccttcaattcaatgccaatgctatctatctgaagatagcatcccatcctgttaccggaaaggggccccgatccagaccccaagagagggttcttggagctcgcgcaagaaagaatcgaggcaaatctaaaaagtgaaagcggccgggcgcggtggctcacgcctgtaatcccagcactttgggaggccgaggcgggcggatcacaaggtcagaagatccagaccatcctggctaacacggtgaaaccccatctctactaaaaatacaaaaaattagccgggcgtggtggtgggtgcctgtagtcccagctactccgggcggctgaggcaggagaatggagtgaacccgggaggcggagcttgcagtgagccgagatcgcgccactgcactccaggctggggacagagcgagactccgtctcaaaaaaaaaaggtaaaagaatgaaacaatggctactccataggcagagcagccccaagggctgctggctgcccatttttactgttagttcttgatgatatgctaaacacggggtggattattcatgcctcccctttttagaccatataggataagttcctgacgttgccatggcattcctaaactgccatggctctggcgggagtgtagcagtgaggacaaccagaggtcaatctctttgccatcttggttttggtggtttttggccttttttattgcaacctgttttatgagcaagtcttcatcacctgtgtcttgtggcgacctcctagctcatcctgtgactgagaatgcctaatttactgggaatgcagcccaggaggtctcagccttattttacccagcccctattcaagatggagttgctctagttcaaacacctctgacaatcccacaaaatgagaactcagtcccacagactgtccccccacttcagacaccagtcacaagttcgggtcccccggacttctgacagcttcaagttggagtttccacaaccctctctttgggttccattaacttgctagagcagctcgcagaactcagggaaacctacttacatttgctggttcgttataaaggatattacagaggatacagatgaagagatgcacagggagaagtatgggaagaggcacggagcttccatgccctccccagcatgccaccctccagcaacctccatgtgttcagctatccagaactctccaaaccaggaattttgggtttttatggaagcttaattaggtcggcatgattgattaaaccactggccattggtgatcaacttaaccttcagccactccccctccctgaggttggggcatgggaaggaaagtcccaccctctaatgctaatgctgcctcagtctttgtggtgaccagccttcatcctggagctgccagccaccagtcaatcggtagcatacaaaaagacatcactttaaaaattctaaggatttgggccaggcgtggtggctcacgcctgtaatcccagcactttgggaggccaatgtgggtggatcacgaggtcaagagatcgaaaccattctgaccaacatggtgaaaccctatctctactaaaaatacaaaaattagctgggtgtggtggcacatgcctgtagtcgcagctacttggaaggctgaggcaggagaatcacttgaacctgggacgcagaggttgcagtgagccgagattgcgccactgtactccagcctggtgacctagcaagactccatctcaaaattaaaaaaaataaaaataaaaataaaaattctaaggattttagaagttgtacgccaggaatctggtataaaaccaaatataggccgagtgcagtggcttacgcctgtaatcccagcaagagactagcctgggcaacatggcaaaaccctatctctataaaaaatacaacaattaggcagttgtggtggcatgcgtctgtagtcccaactattcagaaggctgaggtaggagaatcgcttgagcccaggaggtggaggttgcagtgagctgagatcatgccaccgcactctagcctgagcaacagagccagaccctgtctcaaaatatatatatattttttttttcgttataaaggatattatatatatacacatatttcacaatatcacaaaaatatatctattttaaagtactgaacaaaaaaacgttgggaggatcagaactctgatattttctgctttaaactctgaaattagttcaaagattctggtgctatttcttgatgatatccatcgtgtgtgtgtgtgtgtgtgtgtgtgtgtgtgtaaaacacacacagcattggcagtcaagcaaacaggccaaggtagaaattgagaattctgagatctgtctaagtcaacctttattttctttatttggaaaataagaacaaaagtaacaaaaatacagcaaaattatgacaaataaatctgacatttaaaaaatccataacacttttaacatccacatctattctgaattacataactatggaatttcttatgttcttcatattattttgtaagatttatgtactgtctgcccaaaaaagtgtacactattatccccatttttgcagaggtgggagttagatatctagacattgaggatcttagctaaggacaacagctggtaagaggttgcatagttaaaaagtgttaccagaaaggggtctagatccagaccccaagagaatgttcttgtatctcgcacaagaattctaagtgaatccataaagtaaagtgaaagcaagtttattaagaaagtaaaggaatactggctcacgcctataatcccagcactttgggaggccgaggtgggtggatcacctgaggtcaggagtttgagaccagcctggccaacatggtgaaaccccgcctctgctaaaaatacaaaaattagccaggcatggtgacacagtcctgtaatcccagctactcaggaggctgaggcaggagaattgcttgaacttaggaggtggaggttgcagtgagctgagatcgcaccattgcactccagcctgggagtcagagcaagactccatctcaaaaaaaaaagaaagtaaaggaataaaagaatgactactccataggcagagcagcagtgtgggctgcccaactgattatacgtataactatttcttgattatatgctaaacaaggggtggattattcataagttttctggaaaaggggtgggtgattcctagaactgaggctttctcccctttttagaccatatatggcaacttcccgacattgccatggcatgtgtaaatagtcatggcactggtgggagtgtcttttagcatgctaatgcatcataattagtgtataatgagcagtgagggcgaccagagatcactctcatcgccatcttggttttggtggggtttggctggcttctttaccacatcctgtttttatcagcaaggtgtttgtaacctgtgtcttgtgccaacctcctgtctcatcctgtgactaagaatgcctaaccttctgggattgcagcccagtacgtctcagccttattatacccagctcctattcaagatggagtcgttctggtttgaatgcctctgataaatgcaaacccaggtccttctggctccaaaattcaatcaatgttgcctcttttcaaaatatttctatctgcttgggaaaattccagctgatttgccttaggggagaatttaggatcccctattagtcatggtcccctggggaaggaaggcatcttctccaacctggggctgcctgaggagaactcaccagtcaccaccaagacacactgactgcaatgcagccagccccctgacttttggaggaatcctggtgcttcttcccaccttgaatatgctctagcctaactgtctgcctggggcactagtgttcctgcatggcttcccgaccagccaggccttttccatgatttgcttcttttcttctctaaagtatccttgttactttttttgtttttagacagggtcttgctgtattgcacaggctggagtgcagtggctcaatcacagctcactgtagcctcgacctcccaggctgaagtgatcctcctgcctcagcctctcatgtagctgggactacaggcctgcaccatcatgtccagctaatttttgtaggggtttttttgagacagagtctcactctgttgcccaggctggagtacagtggtgctatcttggctcactgcaacctctgcctcccgagttcaagcgatcctcatgcctcagcctcccaagaagctgggactacaggcacatgccaccacacctggctaattttttgtattttttttttttttttttttttaggagagatggggttttaccatgttggccaggctggtctcaaactcctggcctcaagtgatctgccagcctcagccttccaaagtgctaggattacaggcatgagccaccatgcccggccaatttttgtatttttttgtagagatgaggttttgccgtgtcgcccaggctggtcttccttgttattttctaaggagactctaccttgctccagttctggcctgaccatcctcttcttgagtttcccatcctgatactccttttccttgggtgggtttgatgaagttacagcaattccaaccaaattagctgtctctccccttcttcaaatcttcataaagtaacacccccggcttctgcctacccttgcctggtctccccaggccatcctggctccaatgcagcaagctttctctggctcaacctttgtgctgggttaagatcctaatccgacctgttccttccctccttccaatacccaaaaatgttttggatgttttaataaatcaaatgaggagttatgaccttctgattaaagtttaataaatttatcaaagaactatgagaacattcagattaaaaaataatgaaatgtaaaataaaagcaataaagacgaataataaaatcaatagatattattctaacatcaagaagcaaattacaataagaaaattagattataccaaaggcaagaagtgattcattaagagaaagagaagggacacatttcaaatagaaatcatgttaagtaataaattattggattatttgataatccaatgagtgaatcataaaaatacataggaaaagatttaaatttcttgctgatgacaccaaatactggcatcaatgaagctaacataaaattcatactataccacgaaaatgaggacatgaatatcatcagttcaaagagtatttaagatagaaattcacgagaaaatctcaaatgccctgagatcttaacaggtctcctcagaaagaaagtagatagtggtttgccaaaatttgacaaatgctaaatattttcttggcattaccaatcataagttgtgaagctggaaaaaatttttataagctatcaataataaaaataaattttttatcaatcatgcttgataagattgaataatctttccattctctacacagaaaatcacacaaaattgctgtcatagaaaaacataatcaaaaagtatatagctaaaataaagtaaaaaatattttttaaatataggtgtccgatgatttgtatattgttacaatttctgttcttattctaaatactcacttttcataactaattttgcatgcttttacttatagaggcctccaaaaattgtctaaatttcagccctacaaaccctgaactcatcttcaatgggatattgcgtttctccctccccctctcctcacgcaaactcagggctgaccctctttcagacagacagacagtggccagaacagaaccagaacaagataagcggaaatcctacccactgtgttttttaccttaaaagtcagtaggattggctgggcgcagtcgctcaggcctgtaatcccagcactttgggaggccaaggcaggtggatcacgagacaggagagactagacgagaccatcctagctaacacagtgaaaccccgtctctactgaaaatacaaaaaattagccgggcgtggtggcgggctcctgtaatcccagctactcgggaggctgaggcagacaattgcttgaacccagaaggcggaggttgcagtgagctgagatcacgccactgcactccagcctgggcaacagagcaaaactctgtccccatcccaaaaaaaaaaaaaaaaaaaaaaaaaaattagccaggcgtggtggcgggggcctgtggtcccagctactcgggaggctgaggcaggagaatggcgggaacacgggaggcggagcttgcagtgagctgagatcgtgccactgcactccagcctgggcgacagagcgagactccgtctcaaaaaaaaagaaaaaaaaatgtctgtaggattgattcactagcaagtataaagcccatgaaaacgccaggtactcggggactcaagaactgttgtttttaccaaatcatattaactccaaacagacataacagctggatgaacatgttcaactttatcgttgtttttgttttaattattctcttttttgttggtggtggtagggggagagtctcattctgtcacccaggctggagtgcagtagcgcaatcacaactcactgcagcttcaaccttccgggctcaagcaatcctcctacctcaacctcccaactagctggaccacaggtgtgtgccaccacacccagctgactttttaaaaagtatttgtaaagatggggtctcactatattgcccaggctgctctcaacctcctaggctcaagtgatccgcccgccttgacctcccaaagtgctgggactacaggcatgagccaccctgcctagctgttttatttattctgtcttctcaaaagtaaatattttgctgacataaggtagcagagtaaacatggagctctccttccttgcctaatgaagcacaggtatcgaaatggatttacacacctgaggaagacctggcaatcctctcacaccaatttgcaggatggtatttatgtggactgtggtcacatttcttaaaaaaaaaaaaagctctttattgcttgaataagcatttgttgatacattagacaagctaaagccatttccatataactgtttcatatagaagttgttttatttcattatttccttgattcttatttgtccttcatgaggtctcaaagattgtctattatatttaatgaaatgtaaattgcaaagctttacaaaaactgtaattctagaaattatttcattgatgagtttttttgtatcaattcagcagacactggttgagaatcttctcgaagtatgacaggcactgaactgggccctggggaatgcagagatgacattcaggatgctttctgcaaacgtgggtcaaggtgataaatgctgcttcgatgattagatcaaagtgttgaaagaaacagagaggagggagcagttaatcctgcctgctccaatcgggggtgaaaataaaaagtagattcaaagtgtgttttgtggaccccaagggctccagagaggagtctccaggtgtctgctggggaagtggggagctgagaggcagggcttcagatctccaattattgttcacccaaagcacagctgcttccatctgttttatttgttggaaggtggcattagacttctctgacaaaaagccactgcttttgaaaaataattttttagagatgaggcctcactcttgcccaggcagctggagtgcagtggtgcagtaatctcactgcagcctcaacctcctggaatcaagtgatcctcccacctcagcctcccaagtagctgggattacagatgtgagccaccatgcctggctacaatattttgaaactactaaatgagatgtcctttggtgtgagctttaaggttatagaatttatccaaagcgagatgaaatccagtgccttcaactcccttctctatgttaaaattcccaaacctacatctttagccccaactgttctcctagcaccagtatcccccatcctcaatccatccttttctctccacaggacatgttttagaagattgatggctcccattgagtagtggataaaaatccaagctccctgtcatagtctataaaatccctcccaatctggctccaaatgtcttttaccatttattgtcctccacttacccaaagatgctgctgagagacaattctccatgggtctctcatttctgtacttcttgcaaaaagaagcactgaaaaattttattccaggctatcttttcaagaatgtttgtgtagtgaacagctttggaaaatagagacagtgattctctccagagcagagggaaggtttattcgctttctagtaaagatagtatctccctccaggaaaaggttcagtggatttgcttgccgcccattatacaacactggggtttcctacgtgtggggtttcttagctgtaacacaaacccactgggtacagcatccatctgggccgctgcattgctacagtggacttagaaggctagaaacccaatgcaaaaaggaatctcatcctgcttttttgtgtgagtaataaaaatcctttgtctctaactcagggatctcatgcatgcaagtaactgccgcaggctagcttgttagcttacatacaatgagaaatcccagacccttcatcttcacacagttctttttttttttttttttttgagacagggtttcactgttgcccaggctggagggcagtggcgcgatctcagctcgctgcaacccctacctcctgcactcaagtgatcctcccgcctcagcctcccaagtagctgtgactacaggcacgtgccaccatgcccagctaattttttgtattttttggtagagacagggttttgtccttttgcccaggctggtctccaacttctgggcttcaagtgatccacttgcctcggcctcccaaagggctaggattgtaggcatgagccaccacacttggtctccttcacagttcttgacaggtccctgtattggtcaggataaactaagtgtgctgcagtaacagcccccaaatctcagtggtttacaacacaggcaagtttcttgctcattcttcatgtcctttgcaggtcatctggtggccctgcttccatcaccattgtcctcactctagggcacaatctgacaaagcatccactctctggaacattgttaggggtcaaagaaaaagagaatgtggcaaagaatgtgcccacttttaaatctcccacctggaaatgagagacatcctcctgcttactttgattggccacatctaaattcaggtctattgaaaagtgcaaagctaccacatgcacagaaagaaggagagttggaatattgccaaacatccctaatgactcccagaacaacctggtctccatccacaccacatgcttggtctttatacaaacctgctgtgctcgttcatgcctgtgtaattccttcttcccaaaacacgcttcttctccctgaacgtttagcccttcccacacctcttattacatggataacccctactatttttcaacatccaactcaaatattacctcctttttgaaaactttctctgaccatccctcacccagaaaaacacctcacttccctaagattctgtaacactctctatatcaaagtactaacccattgcttcatactgggtcatgaatttgatgcctgccataaatcaagatcccttgagaatggatgataaggagtgggcccatgattttttaacctcctttaggcaaacctagcaccattttgattaaaatatttcagaggttttctactcgattaaaaaacaacaacaacaaatcattgccacaaccttcaaagcgcacacagactgaccatctccagcctcagttggtgccatgatccttctgctttcaagtcccacttcagtctctcaaacctgtataccttctctctccacgtctttgcatctgcctgaaaccccccatcctcccctctccctcacctcattaatctctcctcatccttcagatctgagcagggaagcatcacttccaggggagtgttcctgtcacccacccccccccgccctggtcaaatctccgcttgtctgttctcatagcactgtggacttctgcgtagccctcagcacagcaagtattctgtgggttttgtatgactattttactgtgttctccccacactcaaccttaaactacaagttcacaagggcatgaatcctatccatttttgcccactattggatccctagttcttagtatattgtctgtcacatagtaggactcggtagatatggacgagtaaatgagtgaatgaatgaatataataagatacccaatgtatgtgtcttggattgaagaatttcaagtagagaagacaacagttaaaaaaaaaaaaaggtacaaaagtttgtctggtctgcagggcaaattttttttatgaatgacaagagaagcacaggaggcaaatgaaattttacataaatcttccagtacttcatctcagtgtagaatctgaattatgaaagatcgactcagtagataccacattccaggagtttagagatataatctcattatttttcaacctttgtttctaggtgtaatttacacctaattttttttttttttttttttttgagatggagtcttgctctgtcgcccaggctggagtgcagtggcgcgatctcggctcactgcaagctccgcctcctgcgttcacgccattctcctgcctcagcctcccgagtagctgcgactacaggtgcccgccaccgtgcccggctaattttttttgtatttttagtagagacggggtttcaccgtggtctcgatctcctgacctcgtgatccacccgccttggcctcccaaagtgctgggattacaggcatgagccaccgcgcccggccacacctaatttttaaacaagcggagattcttctaagccagttgccattatcattatctaaaatgtatttgatttactatttacaaagcattttccttatgctatcatattaaacactaaacaacccttataatcaagattaaaagtaggtcataggctctaactctgacatcttcacagaataatttttgatatatttgtgaaataacgagatggcaggtaaggcggaaaagaagcctcccaaacaggcaagaagagtagatggcagaggcacagagaaggagatggagagacatggaaccaaaaggaggggtcacaagaggaagagtatcgtccaaaagtaatgtggggatgggctctgaagcagggaagagggcggcggtctttgaagttggcctcgatggtggtcttttttttttttttttttttttttttttttgagacagagtcttgctctgtcgcccaggctggagtgcagtggcgcgatctcggctcactgcaggctccgtcccccagggggttcacgccattctcctgcctcagccctccgagtagctgggactacaggcgcccgccacctcgcccggctaattttttgtatttttagtagagacggggtttcaccgtgttagccaggatggtctcgatctcctgatctcgtgatccgcccacctcggcctcccaaagtgctgggattacaggcgtgagccaccgcgccctgcccaggcccggctaatttttgtatttttagtagagacggggtttcactatgttggccaggctgttctcaaactcctgacctcaagtgattcaccctcctcagcctcccaaaatgctgggactacaggcgtgagtcaccatgcccagccctcagtggtggtctttgaggttggtatcacagattgtggggagggagacacataatgtgtggggtaggaaattcgtgagaatgtttagaggcagtaagtccctgaggcagggatgacataggagtctatagagacctgaacttgtcaacaggaaaataaaagatatttttaggtgtctgtgtcattaaaggacttctatgggtgggcgtgggccgtaaggtttgactaagagcagtaaaatggggagtaggtaacaggtcacagaaaatggaaatcggtcattactgtttgtttgagattccatcagtgtctggggctggttggtctcattggggaaaggagcatcttgagtgggaaggatgcccaggaaatccaaatagactagcaaagtagccaagaatacagaaatgccctcatcacctcaccaaagcccgtgtcccctcatgttgctctgggagggctgggccacccacaggagacttgcacaggttccggggaccccaagctgctggcagagccccccaccaagtcctgtccagcttctggggctctgtgagcagcatgagccaatcctcctcacacacatgcagagcctcagagaaggagcatcatcctccatcctgctgcccaggacaaaaacctggaaattctccttgacttttctcccactttactccccaagtctaataggctctaggtccttatatctcccaaatccactcacctcttgctatccccataaccactaacatagttctggaacccaccactgaagcgtgttctaacttcctcccgtctgtcttccttcctgtcactgaaaaactgatggcagtccttcctctgcttatacctcttcatcagctcccttccaccattagaataaggcccgaacttcctaacgttgcttcgatatccgcatgagctggcctctggtctcctctccggctctcaccaggcttccctgccagctttgtcccgccataccaaactacttccagtcccatacaagtgcctgtctccctttcactcctggactcagaaaattcatcttgctttctctggaaatcatcttaacctcacgccccttacccttggccccatcaggccagattccctgggttaattcctgttcttgagacttcggctgtgatgtttcctacttcacagctctttcggggctgggtgagcggccctaactttgtgctgccgtagccacttgcatttgccaaaaccagagcatatcatcctctgcatcatagtgggttttttttttcccacttatctgtctctccatctagatctgtggttctctactccctgtaaaataaattagagtcattgttttttaaaaaaaatgctaatgcctattaaacaaaaatctcttgaggtggatctgggcatcagagttttttaagtttcccccaaataattctagtgggcagccagcggtgggcgccactgagccagacggtctttgttgccagtgcacagggaacaatcctcagtgtctgttacacaaatgagtctctgatcattccactttggtctgcagggcaaaaactctacagagagggcatggagaggaagagatgggtcttgaagaagaaacttgcactagggaggacccacacctcccccctgactccagctccctctggtacaaaaccccaaagctgagctgtgggcccagccccacccacatgcaactctgcgctgttggaaaggcttggaagtcaaacagcaatctactcctcttcatggaggcaaggataaattttcttttcaaaacactttaaattttatcacctcttcagaacaagtacatgaatgaataaactgaggctccaagagactgtgagtggccctcgcctcaaatctctagagcaaggcagagcagaaatcaatacgtgactccccaggagcaattggcctcgtcctgggtggcctctgcgcccaccctaactctcctgcctcctagagcaggcagggctcgccccgaaccaccctgcctcctagtgctgacagaggcacatctgcagggtgaagaatctgcaggcaggatgcagagagtgggaggaggaggacaatttcgcacctgagtgatccttttcataaaaatgggatcacgttacttcctactaagagaagggaaatgttatccgagaatgtggggctctcattctcggatatgagaatgtctctgccaacaatgcctggcctgatcttacctaccccacttcaccaggggcactcacagctagaatctgctgagaaccctcaggctctcaatgggtgtgactcatctcttcctctattccctctctgtagaggttttgccctgcagaccaaagtagagcgatcagagactcatttgtgtaacaaacattaagggttgttccctgggcactggcaacaaaggccaacccggctggctctctgagctcaagaaatcacagcatggctcagcggtgctcattgctggctgcccactagaactatttgaagaaacataaaactctgatgcccagacccacctcaagggttttgttttgttttgtttgttttttgagacagagtcttgctctgtcacccaggctggagtgcagtggtgtcatctcagctcactacaacctctgcctcccaggttcaaggactcctcccacctcagcctcccaaatagctaggattacaggcacacaccaccatgcctggctaattttttgtatttttagtagagacaggatttcaccatgttggccaggctagtcttgaactcctgacctcaagtgatctgcccgccttggcctttcagagtgctgggattacaggtgtgagctaccgcacccagccaagagattgtttaatcagcaaaaggctgggcagggcagtggggcctagggcggcacttgctatcagatgtctggagggcagggttggctttggccatagatggacctcggttcaaatcctggctggccataccacttaccagctctagacctagagcaggttaacatcatgaatctaaactacttaccacttaacaaagtgagtgactatctataactgttgccgttgttacaagaaatccacttagtaactgcactgaaagcccctcatccccaaaaggcaagaaatggggaacaaccgggtgactaaggaaaactgcaagtgaaagcagctgtaatttctctcgctgtggtttgcggtgctcaacactcttgcttggctggttgtcttggagggttaatgaggtctctgctgagtgtcctcagcttagcaatgggcagtggggctctgttcacagtctcatcccggccacgtggcctcccgggttcagacaccctaggctgatgctgtggttccatgtgcctgaacacgagcatccgaactcatttccggcctgcctgtccccccatgcaacggctcctgaaaaaggggaaccaaatgctgcccatttcacccccatcaatagctgacaacgcctgggttcctgctctcctgacattcccactcattgtcgtcagtggagcgagcaggcagaggggaagtgagctgcctatcagcccctgcaatcagaaaaagagccgggtgcctttaagacgaaggtggtgggcagccatccatcttccctaaacacacactcgccttgttcttccatttctggctgagtgataaaaacgttaaatgtcatttcctgtatcagtggttaaccactagatgctggatcagagatttaccagaagtgctgaagttatggaaaaaaaataaataaacctgctgttttcaataaccctttcttgcaccctgtgggaactatgtaacctctggggagggggctgcgagggggtcgctggatttgacttgggcaacacacttaggactagatttaccaaatgctttcttatgcttcatataggaagtgaagagagacaaaatgtaaccatcctatacctgtccccaagtgcgcgtgtgtgtgtgtgtgtgtgtgtgtgtgtgtgtgtgtgtgtgtgtgtagaaacgctgggaaaagcaggaggaaaaatcatccacgtgccttctttgcccacctctctcaggatatcttgcagtcattttggttttattgacccagggtttttgcagaggacagttgccctgactattcgattccctcagcttcctgcaacaatcaatgtcctccagtgacaagaaggcttcctgggggaaaacatgctcccaggaaactcctgagaggtggagagcccagctcaatcctttgttgtgtcctcttcttctttcagttgctccattaaattaatcaagagctcagaaaagggaaggcctggcttagcccccaaggagaggtgactggaccgactgcagcctgcccacagctgtactccaagcccagccatgcgcttctgacctgaggtcaactccccacatacagctgccctgggctcctccctgcggcctcccaggcactcccctcagtctggacatataagacttaggagctgcactttgttctagcaattccatttccttcccagtgccagttgggatgtgctgtgcacaccaagtgcccctagctcctcacctacctctgggatcactgacagtcctgctttacctgggaccgaagggattcatggggcggccggggcgggggagggaggacttttgtttctaaaactgggaaagtcccaggcaaaccgaaatgaattggtcacccccgcaacagatacaatggtttgcataggcacttgcacgttctatgtcagaacggtggccaagaaataaaaaataataaatatgatttaaaaaccagaaaataatttttaaaaaatttaataaacataagataatttttttaataaaattaaaaaaaaaaagaaactggccaaacttgagaacagatctagccagggtactgagaactgcagacggcattgcatggtataagagttccctggggagataggacggagcgcatcacagatctcccactgcacctggcgcatacctagaagtcatcctctctcaattcaatagttactagaggagatctgaaatcaaagtcagaatcagaagggaaaagagcatgggaaaacgtacattccactaaatctcttgtaggcctctgaaactgaaacttctttttccttcctcgcgcccttgagtaccaacaccatcagcccccctggtgcccaggacacaaagattcgagagatgcattgctctttactctgcctcgctcccacttcattttattattatacctagacctgatttcctgccacctaggatctctcctctccacttccacttctatgactatccttccgctgtctctgccctcaaagactggcctccatcctctccaacctcaatttcatctgctccctggcatgttagatgctccctactttttcaaattatattcgagaagtgtttattgaatacctagatcagaaggatgccagagaggtcgcacccggatttcatatggcattggacatttctcatggatgcctttttgaatgacaccatctgtaacatcttactgactgagaaaacctcctggacactgccagcaaagctgggcatggcctcccttgcttcctggtgcaaattgccacttagccctcattacattgctatgacgactactttctgtttccatcttgtctaccagctgcgaaccccagtgtcttatttaccctgttttcccaggtcaatcccagaccttgacagatagtggccattaaatacatgtagaaaagaagatggtctggagatgaaagggggaaatattgggtggatgctattatacttcaatgggtctgtagccatttgaacatatacatttcaaaggctattgattatggttggatcaacctggaagatgatccctattagagaaccaaaggtctcagccctgggccctatcctaatgtttttacaaacttcctggataaagattaaaaaggtacccaaaacagatttacagataaaaccaaagctgggaagtatcactaatatgtagaatgctagaattcatgttccaaaattgtcttggcttatgagatggatagaccaaaactaagaaggtaaaaatacacacccaattagtgtaaaggctacactcgtagtagcaccatcactagcacaatgaggaagatgtggttcagcagcagttcgggtgaaaaactcctagcaattcctagtctttgagctagaagagaacgtagaggactatccaatacagagagtctcaagctcttttcaaacaataacattcatcaagtggaatttcatgcagaggccctgtaggtaaaagaatttttttttttttggggatgaagtcttgttctgtcgcccaggctggagtgcagtggcatgatctcagctcactgcaacttctgcctcccaggttcaagcgattctcatgtctcagtctccccagtagctgggattacaggtgcatgccaccatgcctggccaatttttgtatttttagtagagacggggtttcaccatgttggccgggctggtctccagctggctggtctcgagctcctgaccttgtgatccgcctgcttcggcctcccaaagtgctgggattacaggcatgagccaccgtggccagccggtaaaagaaattttttaaaggtgctgctctggttaggagtaagggaaaggggtctaacaagtcagcctccaaccaattcgcccctccctgctatcttatgaagacccctgaggcaccctcccaaactcctggggctcttctgagtgaacactgtttgaaaacacagacctgagtcaatccccttgctctacacagctgcccatctggtgagtgtcagaattcccccgaaccctctaatccctcagccggctttattttgtgttgcatttcatttttctttatagtttttggccctccatggcactgtatgctgcacttcactctgtgcaccgcctggctgtctcactggagtcctgctgtcttttttccaccagtgcatccctgctgcacggaacacagtgggaggaagatttaatgggaaaggaatgaatgaactggaaaggaacccaggtatcttgacacccacccaacttgccctcccagtagtgtaactgtccccaacaacaaccaaagccaagatcacattaggctgcattaggagatcaaatgggcccaccgtactcatcatggttcaagccttgtctggaatagtgtgttagattctagcagctacattaaaggaaacaaatgtggcagaagtggcatataaataatattattgagggatgactttgtgccagacatactgtacattcatctcatctagtcatgacaattatgctgtaaagtaattattatcctccttttgaatctggggaaacagaggctcagcacgtttcagtaatttctccaaaggcctaggattcaaacccctggcaaagcttgggttctatccaccacaccgaggtgtctcttggaggggcccccaaaagggcaagaagagtatggaggatctagaaatcatgaccagtgaggccagatatggtggctcatgcttgtaatcccagcactctgggaggccaaggtgcaaggatccctttgagcccaagagtttgagaccaacctaagcaacataggaagactctgtctctgcaaaaaaaaattttaattcgccaggtgtggtggcatgtgcctgtagttccagctcttcaggaggctgaggtgggaggatcgcttgagctcaagagttggaggctgcagtgagccatgatcatgccactgcactccagcctgggtgacagagcaagatcatgtctcaaaaaaaaaaaaaagagagcgagagaaagaaatcacgacaaatgagacatttagcctggagagaatcagacatacatgacaggctgggtggggagtgaggagaccatgacagcagtcactgaagaaagaagagcactttttgaggagggaaagtgctgagactcaaggccccttgtcaggtgaggtgtagaggagattcccagatcggtaggaaagtggcccaagaaactctgggctgtgttttggccttgctgcacatttgtgggtggagacaattccctgtgcccaccacacacccacaccatcctctatcaccacatcttctgtgccacaggctctcccgagctgtctgcctgtttattttcctgtgacgagagggaccaagcagcagcagcagcagcggcatcataataactgcccacaagttgtagttggaataattttcagaatggctcgagctctatggttaaagaaacgactgctggtggagtgtagtaaacaggccccagccacagaacacagcaagtgggcacaggacatgggagtccaagagcaaggcccgggtccaggacgcagcagggctgggaggagctgaccacaggaccccactccccgcagggcagcacttcatccagggcccttccctggctgcgtaactgcccagattcgtgtctcctgatctgttgtaacacacaaaggcatagagcagaacaggaaactcaggaaaaaaaaaatggtcttttccctcttgagtgtctgctctgataaagacccttcccagaggctggtccttgtctcaagcccactagaaattctgccatgagtgtgagttttagagacactggggaaaatagaatacacaccagcagccatctcgctcttggttgatcaaaatagaatcataatagttctctcttccctgtccagaatcaccttcttcccatttttctgtgccccctgccgagaaaccaaccaagacaaggggtcagaagaagcactgagaaaccactggagaattcacaaggatagtcaaggttgacagggtccatggaaagacccctaaaagtaccctgtctagaatgtgagagctgcaagggcctgcagagtcatctagtctgactgtaaatatattcaactgcgggccatatgcggtctccgtcacaaccactcaacaaaagcagccatagacaatacataatacaatggccatggctgtgttctaatcaaacttgacttatggttatcaaaatgtgaatttcatataattttcatacattatgaaaacattactctccttctcaattatttaaaaaggtaaaaggcattctcagtccactggccggacgaaaacaggcagtgggctcaatttagcgtgtgggccacagtttgtcaattcctgatctagtccaagcccttcctgagacagaggagaaatctgactcctaggaaaggcagcgactggtggttcagtgtaggattcccatccacacacagtattccattcttgtgctgggctcttgcccatgcaaagtgatatttcagctgccctcatttcccttgggcatgatgtgcctgtactgtgagggcagcagcctggtctaagccctgccaactgtaacatctggaatggaacttcaggacttgacagactctgactctgtcccatttctgcactcactcccaggatgaccttgggcaggtccatcaccctctcttgatcccatcagaaactgcagacatgggaaccacacgggtcatctctgagagtgggtcttcagtcattgtcctgccttcccctctcctgggatcagtaccagcaggcccctggcatcttctccagcagccatctctcggagcaaccagttctgaggccaccaaagtatagtgacttctgggcaggaaaactagggatggaagcaaatgagttgtctgttttcatgcagatgaagtcgtgggaggacgtatgattcatgtgttgagtgctttttcaatagcatgtttctatcatttctggaagacagcaagttagtttccccccgaggtggtgggagaggatgttgtttgtggttttcccttttagaggggagttacatttgtttttgttgttgctttgttggtttatcaatttttttgttttgctgtgttgtgatttgtgttcatgaggagttggagatggcggttgggagagaaagttttggaggggtaggaggaagcagagcctatgtacaatgtctacaggggctgatcacacaaacaaggtcaaggtggttcaaagtcatagtcagatgcctgggggcctgccaaacaccacatgccttggttaggaaattagtgacagtttgacatctgggtcttgtgtgattgccatccaaagataaggaagggaaagaggagagtcctggcatggagttccaagcaggctcagagccccgggcctgcctttccatcacattaaagaatgtggctgctgtgccctggagcggttccctagtcacaccaggtgatgggagccaggagcatgggatagaaggagcctggtcactgtccagcccagagtatcgctcagtgttggctcccctgccagtctcttccagggtatctgacacccaaacaggttggtgcctggaattagggtattaggccactggaccttcttggggagctctagggggtctctgggaacttgaataagagctgctccaaaaacttctctgaatcctgcacccctcccttagcaagcagtatgctggtaaaaggttaacaaccaagtatctggcgaaaaaatgccctgattcatagcatttgctaactcccatggtgtaaatactctcctaccttggccaatttcaagtggccagtgttatgttaactagatcacaaaaatcctgaaaattaacattgagttttctcaagccagaatgagcccctcttctacaccacagccctgagccctctggaaccaaaggagaactcagaaatcaggaatcatttggtcccaggctttccaggtgccagaatgaaccacgagctcccggtgaagccgcaagttttatgagtctgcagcacctcacagtggagggaccctggtgggggcaggaggaaggaacggaagttggctaattagagaccctaaaaagcccccagagaatgcaagtaagagagaaaaagggattgggagtaaatgctaggaactcaagcattcaaacctctgtgtggtccacaaaacaaaaactgtgaggtatttaaccacctctccttcttatttcctgagtgtgttcctgtctcagtccatcattttccagagaaaatcttcctaaaggatgttaggaagcagctgtccatcccatatccctgagaaggggtgccctgcccctgcaacgtactaaacacaaggtggtggctgacatggaggaatctgtcccctacacacataggaccactctgccagccaggcccaggtagcacctgggatgaactcccctcaccctgctccctggtcctctccctactaagtcccatctaacacactcctgcttggctaagggaggaaaatcgcacctcctccaactcctctgatgtccctacagtccatccaaactcacttacaagagtaaggattcttggatcgacacaggccccttcccttgggcagtttcggcttagcaggcgttctgggaagacagccaagcagtaactcacttatgaaagacttcattctgtgcctgctctcctcacccaacagctgacacacatggacccccctcgctgccattttagtggccctggctggtcagaacctactcacctggcccgagaggcccacagtgtcctgcctccactccctttcctagagccctggattccattcctacctctgccgctaattgcctcgaacactcatttaatctcttctgactatggtttccttatctggaacacacaaatggttggacttcaataatattccatacaagttttatagaaaaataagatttgtttggaactttaaagcgatcaagtattttcacttaattattacaaaaagtatgtgatataagtagtaatattagataatattaggaactgaggctcagagagcctgggaaatgcattccagattacctggataagaggtagcccacccaaactcgatctcattcctctgacagccaacactgcacacagacacctgagcaagttgctacaactgggatcccacagcagagtcccacagctgttcctcagttagcattcatgtccctttgattcaccagtttaacacaataaattccgttcattctaggctgagagactaacgtgaatacgctcaatgtccaggagaaaactagggtctgtcctgagcaaagttggtgagtgagcgccatttaccttccctgagccccccaaccttctgtgcacaattctatgtcctatacctttgcctttgcaatctaacattcttccttgtctttttttttttttttttttttttttctgttagagtcagggtctcttgttccgtcaccaaggctggagtgcagtggcacaatcatggcttactgcagcctcatactcctgggctcaagcgatcctcttgcctcagcctcccaagttgaggactacaggcatgagccactgcatctggcacctttcttgtcttaatactgttctagtccatccaaaacaacaacaacaacagcaacaacatttcaatcaaagaaacatacaatactgcctccccacctcctgcaataaaacaagtgctgacacccaccttccacaaaagaggagaaagggaccctttcacccgacatgagggtttctttcacttttttctttctttttttttttttttggtggggtgacaggctctcactctgtcgcccaggctggagtgcagtggtaaaatcacagctcactgtagcctcaaccttctgggtcaagcgatcctccctgagcctcggcctcctgagtagccaggactgcaggagcacaccaccaccattcattagcggccctgcctgactaatttttttattttttatagagatatggtctcattatgttgctcaggctgaactcaaactcctggattcaagcaatccactcgcctcagcctcccaaagtgctgggattataggtatgagtcaccgcgcctggcctatttcacatagttctcgcccttagtcctatgctgccctgtctaccttggggcagaatttttccatctgccccaagcgctgtattcttataaccatcctgtctctttatttattgtatgtcctggatgccagcgaggcccccctctacacacacactcaagaaggttaaggcaagaggaagaaacaaaaagagggacaatttactgccctttacatagcactttgtcataacaatacccttccaaagccctcactgaacggtgagaacaatccaatgaagtaggttttgttatgtctgtttttacagaaaaggacactgaggctcaaagactttgtaggtcattcacctcgtaagtagaagagccagaatgggaatccatgttcatctgactccaaaggcaatggaatggccaggcccctccctaggaaattatctaataggactcttcaaggatatttgccttttaacaggagtgtcttgaagccagggtctcacaaaccaggcaacagagctcgaagcggtcatacccaatacctgctgatgcaatcatatggacccaatgggtttgaagcggggtgatctcttactgcaccaattaaatagtcatcagttctaccaaccataaaaccaaccataaatgtaaacaaagaattcctgatcccacgggtctggacactaaaagtgtccccaaacttagagaagttctggaaaagaacatatcaaaattttggctttgctccagatgctataggaaactgtacgtcacaagagttctccattattgcccagacaatggaaatagcaaccacgcagcaccttctaaaatcccttgcagtctgagacgtgtggtggagaccctggttttcattcattatgcatgaacccaaagtacagacttgcagaccttcctagaaatgagtagtaagttcagaccatcagaatattcagaaacctgatgtatttcagagactttagcagtaaaaaggggtcagaacactagaatagctgtctggtgaaatctaggagctttgttcataaagacattatgattcagttaatgagatttggcaaggtattaaccatcttggtagaccaataatggttggctgctatggagtttagactgggaaatagaaaactgaactgttatcagaaaagtttgagatactttcctatactttttgtataagatgaaagcctgcaaaagatgaggctcaaaagatatggagacaacctaaatgtccatcaatggatgaatggataaagaaaatgtaaaatatatatatatatatatatatatatacacacacacacacacatatatacaatggagtattattcagcgttaaagggccgggggcaggatcctgtcatttgcaacatggatgaacctggaggacattatgctaagtgaaataagcctgattcagaaagacaaatactgcatgatctgacttatgcaaaaaatctaaaataatcaaactcacagaagcagagagcagaacagtggttgccagggggtaatagggagggaaaatggggagatgttggtcaaaaggtaaaaagttttagttatgcaagatgaataatttctggaggtctatcgtacagcacggtgactatagttaataatactgtattgtacacttgaaacttgctaagaggtaagatcttaagtactcccatcacaaaataagagaaaatgactactatgtgaggtgatagagatgttaatagcttgactgtgtgatcatttaatcatgtatacatatctcaaaacatcggttgtacaccttaactacatacaatttctatttgtcaattatactccaataagagttgggggaaatggaaaaagatgagcttccataaatcatctgagcatatcaggaagtgaaacatgcaggtgttgagaataaaaacataattatctgctgggcgaggtggctcacgtcttgaatcctagcactttgggaggccgaggcaggtagatcacctgaggttaggagtttgagaccatcctgggcaacatggtgaaaccctgtctctactaaaaatacaaaaattagccgggcgtggtggcatgtgcctgtagtcccagctacttgggaggctgaggcaggagaatcgcttgaacctgggaggtggatgttgcagtgagccaagattacaccactgcactccagcctgggcgacagagcgagacagagagaaaaataatactaataaaataaaattaataataaaataaaaccgtaattacctagtgtgtggcctttcctggagaaaggctctgcacactgcccaagagcaggccttaatgccatgagctgaaccagcggggctggactcaagggttcaagggtgcggagtgagaggagaaacaacaaagggaaactggggacagctgctctggtgaactcaaggaagccacctgagatggggagggaaggaaaagggggttagtagagcttcagggaaacgcagaggagaagactgatttcacccggtgatagaaacaaaggaaaagggaaaacagaagccacgttgtggtggtcagtgctgcaagaaggactctaggagagatagcttctaatgagaagaggaaccggggccagcaagactggctccaggaggaaagttctgtgaggtccatgaaagaggaagtagggaggaatcgctgttgaaattctcattgtgaatggatggatcccaagtcctggaggaatgggcagaaaacagaaagcaaagaaaaagaaatgtaaaagaaggcttcaaagcctaattaaagtcatataaagaggataaagagtaattcaaagaagcaatgtgagaaaagaaacactaaaaagaagacaagaggaccctagggaaggaaaaactgggtgtacatttgtgtaagaaatctaggtattacctgtttgaagcagtttattcaccaggaactaggaaaggaactggctctgtggatttccttaccagacaattttcagagtgagatttttgtttacagtttattataagaaccttccaaagacttatgggatctggatctgatgatacataacaatgcttatgacctaaaaaagcaaaacgattcacttcatggaaatgcatgttccccgaaagaaatccatagagccccctaatgaaattttcaagagaaaagctatgtacaaacatatgatccgcttcctaaacgccacaagaaaggtacaggtggaaggagtagaggaagatttccacggattcttgagaaaaaaatgaaatgggaaatctaagacgagtgcccaacaaaccaaataatgcaggtttcaagagcacagaactgaatggggtttatttaaacacacataccagctgctgccacatggctaccaaatggaaactgagccaggagggtggcccagtttctaggtacaagaaagaacagaggttgtgacgcaacaggaatgatgtttccatttgtattttatgaagttaacagccaaaattcacctctgaaaacctaagtttggcagtggtataaagaagggaggaaattcctgatggaacaagaagggattaaaaacaaaagaggggagatcagcgggagggcaggcctctgatcttccctggctggcagtggtggacaagtaggaaaatgatgtgagcagatgctcaaggaaagtggccctgaaatcaaaggctttgaagagataagcagagtccctcaagcaaagcaataaacagagaaaccaggatgaatacattggaatcgaaatgatgaaatgtaaagtaccacagagaggtttctagaaaagcatccagagatggaaatggggaaaagagaaagatacagcagaaataaattgcatacgagattctagtgtgtgctagaaatgtagggaggaaagagtgatgataaaattaaaagaaagaagtggatagatcttagtggcatgattgaaatggataatgaaagggatctttatgaaactgttgccaggagaaggaaagatatagaaagcgaaaaaaaggctgtaggttaattccagtatgacaagaataacaaagaaatgcatgaattctcagccaacagcccgtatcaagagacaagcatgttctggctgtgtgtgaagggcacaccatgccaggggctctccctgccaacgcctgcagacttttgctcctcacctggacctcacagcgcacctgttttcaatgacacatggcggaaaagggtcaaaagatgaataaggccaggcgcagtggctcacgcctgtaatcccaacactttgggaggccaaggcgagtgaatcacttgtggccagaagtttgagaccagcctggccaaaatagcaaaaccctgtctctgctaaagatacacaaaattagccaggtatcgtggcacacacctgtataataccagctactgaggctgaggcacgagaatcacttgaacctgggaggcagaggttgcagtgagctgagatcgcaccactgcactccagcctgggtgaaagaagtgagactctgtctcaaaaaaaaaaaaaaaaaggataaaatgatactcatttcttccttggtcccatcgacaaacatttatcaagagatgtctacgtgccaagcacggtgcttgatactgagaaaatacaataattgataagcaacatagatattctgacaaaaatggaagcaaaaaggggaggaggtctaaaatatagaattttccagataagacagagcaaagttcaaagccgtgaaaatgagagtcaatgtgaaatatgacagaaatggggacaccaaggtggacacaagatgaccgtatattctcctcgaaggggaacaagataggaaaggaaagtgggaaacaaaaagtggaagtaacgtcaagagcccctaatggggctctaataggctctaacctgagtcctagcccttactcagctggttcccagatgatcttgagcaaagtgcttctgtgctctgagcctcagttcccttaactataaaataaactaatgatgtctggtctaacttgtggttgtcaccacgacacagtaaggggtattggttgtgccctcctgccataaacaacaataaaactggacgaattatatgaaactgttttcaggtgcaacgctacagatggtgcagggatgtgatgcttgagagaagaaacacaagaggtgaaacccacatttactctggcctcctgcctggggctttccaaccacagcacgcggaagtggagcccaaactgaggatggaggaaagagaccgaaggttagggctgctgcagggattgagtgtgtgggacagggtacgagagaggcaggagctgcacagagcagaaatccaaaaatctgcagaggagaccacctgaatctagttgaaaacaaaactgcacatgtacagggtaatgttttcacaaagcctagtagagaataggtagcaggggcaaggtgcagtagctcatgcctgtaatcccagcatcttaggagaggctgaggcaagaggatcgcttgagcccaggagttcaaaaccagcctgggcaatatagcaagacctcatctctacaaaaaattttaaaaattagctaggtgtggtggcatgcacctatagttccagctacttgggaggctgtggcaggaggatcccttgagcccaggagcttcaggctacagtgagctaagattgtgctgctgcactccagcctgggtgacagagtgagaccctgtttcttaaaaaaagaaaaaaaagagagagagagagagaataggtagtaggagctgtgcactgaacagagattccagaggtcacatggtgggaagagacactgtgttctcagtgtccatggtggaaagagcttgatgaacagcctgggctttcaacagaggcccgggaaaggccacacctgtggagctgggccaccccagcactagagagaggctgcactggacccatcaaaacaaagccaaattacaacactcaataatggatccaagcggatccaccaataaattaaccacctgccaaaacaaatgcaatgatccttacaggaagataataaaaccataatgtttgacatgtaataaaaaattactcaatgtgtaacaaggaggaaacaagtagtatagaaagcagccaatagaaagaatcccagaggtgatacagatggaattagcaaagaaaaactttaaaatgactaaatatattgaagaatttaaagggaaaaagtggacataaggaatgaaaaacagttactcattggaaaatagacattatgaaaagaaacaagatgaaaatcatgggactcaaaaatctacaataactgcctgggcacggtggctcacacctgtaatcccaacactttgggaggcccagccgggcagatcattgaggccaggagttcaagaccagcctggccaacatggtgaaactgtgtctctactgaaaatcaagaaaaaaaaaaaagaactgggcgtggtggtggaagcccgtaatcccagctactagggaggctgaggcaggagaatcgtttgaatccgggaggcagaggttgcagtgagccgagattgcaccactgcactccagcctgggcagcagagcaagattctgtctaaaaaatatgtttatatatgtatctaaaataactgaaataagtcacaagatgggcttaacagaagattagacactgcaaaagaaaagattagtagacatgaagacagaataataaaaattatccaagctgatgcacacagagcaaaaaaggactagaataaaagaatagagcttgagttacacatatgggatattattaaccagtctaacagatacataactgtagtctcagtaggaaagcaaagaggaattggggcagaagaaatatttcaaaaaataatgacctcctaatgtgacaaaaaagtaccaatccactgatccaagaatctcaatgtatcttaaacaagataaacacaaagaaaaccacatttaagcacatcatagccaaacgttgtaaaacaatgatgaagaaaagatctcaaaagaattcaggggacaaaaaaaaaaatcccacctgactacagtggtgcaataatgagaattatcactgacatctcaccagaaatgttgcaatcctgaagataacagaatcccatctttgaagttctaaaagaaaaaaaactgctaacttagaattctacatccagtggaaatatccttcaaaaatgaaggcaaaatgaataaataaaagctgagataacttatcaccagcacaactgcacaatgaaaaatattaaagaaagttcctcaagccaaagggaaatgataccagatagaaacagaactataatacacacaggaatgtgccagaaatggtaaatctatggggtcactatagaacacttttattttttaatttctttaaactacattgtctgcttaaagcaaaaatgaagtctcactaattcaagtcagactgtgctcagctaaggaactgaaataaaagagttgtaggtcagaagtcaatagaggaaagagaatactcacaagcacttcattaacccaaaaagaggcaggagagtcggggagaaggaacaaagaatagatgggaaaatctagaacaaatagcaagatggtagaattagatgcaacctaactcaatgctatggtgaatgaaatgaaaccatggcaatggaactctggtatagctgccctcatcacacgtgaggctctggctgtgcgtttctgggtgaaggggaggaaggtgacgaggaaggaagtagaaaagcaaacttatgggacatagaaattctaataaaataggttctaggtgctcaagcctagagacatgcttctaagtccaactactcactgtgaatacctggtggaaagatgacaccctttccaccagggtggatgacgtcaagcagacccaccaataaactaaccacctgccaaaacaaatgcaatgctctttaaaggaagacaataaagcccataatgtttagcatgtaataaaaaattactcggcctggcgcagtggctcacacctgtaatcccagcactttgggaggctgaagcaggtggatcacctgaggtcaggagttcgagaccagcctggccaacatggaaaaaccccgtctctactaaaaatacaaaaaattacttgggtgtggtggcatgtgcctgtaatcccagctactcaggaggctgaggcaggagaatcgcttgaaaccgggaggcgaaggtggcagtgagctgagatcgcgccactgcgctccagcctgggcaacaagagcaagactccaactcaaaaaaaaaaaaaaaaattactcaatatgtaacaaggaggaaacaaaagcagtcaacagaaagagttccagaggcgatacagatggaattccaccaggaaaactagaaaaaggctctgtctacagaagggacagtgtaaacagaatggcagaagagagcagaaacagaggatctagaaagaagaagtataatccaacgctgacatagggaggagggaactgtaaaattagaatctgacaaggttttaataggcaataggcaacgatcaattaaaacagggctgtcatgatacgtctggacagactcagttatttgacccatgaaggttctggagatgaaggcactgcaacaccaggtctaaatgtgtcatcccaaacatttgtagctaagtggcagagagaaatgaccaagaatgattcagttcagttcggcactcgtttactggggaccttctgacaccaggctctgtgtcaggtacagaggatataaaaattactaagaccaagtccatgcctttaaggggaaacccagttctactgggggaaacaggcatggcaacacatcagaaagtagtgtgtccaagcatccacctgtcacttaccagctgagagagtctggatatgtgccctgcccaaatctcatgttggattgtaatcccccgtgttgaaggtggggcctggtgggaggtgactgacccacgggagtggatttctcattaatggtttagccccaaccccaggatgctgtccttacgaaagtgagttcattctcatgagatctggtcgtttcaaagtgtctggcacctccccctcccttgctcctgttttgccacgtgatatgcctgcttcgactttgcactccaccacgattggaagcttccttaggcctccccagaagcagatgctgctatgcttcctgtatagcctgcagaaccatgaaccaataatacctcttttcttataaattactcagtctccggtatttctttgtagcagtgcaagaatggcctagcacaccagctatgtggctttgcacaaatcctttaacctcagtttcatcatccataaaatgaggataataataaccacctagcaagactaatgtgaacattctagaaataattttaaaagtgcctagctcaccacctggcctatagtaattcagcagctctcaacttgagaacaagacacacattagaatctaggtggcaaaaggagggtatttctaactagtcccagcctacctcccactcatatcctgattcccctggaaggatgtgcctacctattctaaacccattaccctggatgaagaaacactatgtctcatgcacgatataaagtgtgggagtgtgttttgcatgtgaatgatgcataggtagaataaagtttgagaatcactctgtaagcattcatctcagttcaacacttataaagcacctactgtgtgccaggctcataaaaaaactagtttggattatttccacataatgatagaggtatgtataaaatcctaagagaatataatacaggagaaggcactcagcctggggggtcaggaaggcccacaagccttggcagttacccggactagcaaaggtgagaagatcatctcaggggaatagaaaggtataagttggcaatagcatggtgtgtgcaaggaactaggatccaagcatcaaacagggtcaaggaattaaatatttgggagaggcagacaagcgcaagtttatgaaagacatgcaaagaaacctacttaatcctgtgggtggtgagagccacagaagagcatgatgaaaaggagacccaggctcctctgtgctccaggtcagtatctctgaaagcagttcccaagctaaatgtcatgatgaaagcacaaggagcctcagagagctcagcctgcagaggaattcattcctcaggggcagtgtgcactgctcactcaactttgcttctccagcacccacccaagtctgaccccactggaggcactaggttcattgtacagaactgatattaataaacttccttatccagaacttgtgcaatagccgagcatagtggctcaggcctgtaattccaacactttgggaggccacggcaggcagattgcttgagcccaggagttcgagaccagcctgggcaacatggtgaaggcccatctctacagaactacaaaaattagccaggagtggtggtgcacgcctgtggtcccagctactaaggaggctgaggtgggaggatctcttcagtctaggaagtcgaggctgcagtgagccatgattgcaacactgcactccagcctgggcaaaagagtgagaccctgtctccaataaaaaaaaaaacaaaacaaaaaagagaacctgtgcattttaacattatctccaactatggaattcattcaatcaccaacttttattaaccatcaagcagggagggaagatatgaacagaaatacagtcagggctttacgacagggatacatctgggaaatgcatcattaggcagttttgttgtgtgaacatgatagagtgcactcacagaatcctagatggtacagcctacagcctacaacacaaacaggctacggtgtatagcccattgctccttggctacaaacctgtacagcaagtaactgtactgaatatcatagccacttgtaacacaatggtatttgggtatctaaacaaacctcacgtgaaaaaggtacagtataaaagattaaaaatgggctgggcgtggtggctcatgcctgtaatcccagcactttgggaggccaaggtgggcggatcacgaggtcaggagatcgagaccatcctggctaacacagtgaaaccccgtctctactgaaaatacaaaaaattagccgggcatggtggcaggcgcctgtagtcccagctactcaagaggctaaggcaggagaatggcatgaacccgggaggcggagcttgcagtgagccaagactgggccactgtactccagcctgggcgacagagcgagactccatctcaaaaaaaaaaaaaaaaaaaagattaaaaatggtacacctgtatagggcacttaccaaaatggctgttgcagaactcgaagttactctcggtgagtcagtgagtgagtggtgagtgaatgtgaaggactgggatattattgtccactactgtagactttataaacacagtacacttaggctacactgtttatttttaaaataaagtaattgagctacaacatgacaatggctacagcgtcactaggtgataggaatttttcagccccattataatcttatgggaccaccttcatacatacagtcggtttttgactgaaacatcattacattcagcacgtgaatgtaattgcgatgaagtgaaagataaaggttatagttctagtgtatccacagtgctttaggagatgaactgttagggaaagccagaaaaatctccaccacggaaaaaatatttggcctgcgtcttgaaggataaataggaagtcagtactcagacaggtgccagtgtttttcagcctgaggcagggaggtatgagagacagctggaagggtttgagaatgggtggtgagaacttacacttactggggactggatataagaatgcagtaagacgtggacctagcaccgtgatttttcgacctgggctacacatcagaaacacctagcgagcttttaaatcttccagggcccaaaccacattgtgaaccaattaaatcaggacgtctggggctagaagccagtcatcagtatctttttttaagctcccaaagtgattccaatgtgctgccaagtctcagaaccactagtctagaaaggagggataaggattttcagcagcccccacagaaccggccctcctggtgaccctgcaatcctggcacacacaccccaccccgcctgggagaaagaccggccacaccacagtcatcggctgtttcctgctgctcctttcctcccaccagcattttactctgaaatagtggttctcaaagtgtggtctccagactgtagcatcagcctcagggggaaattcttaaaaatgcaaatttcccagccgcaccctggacgcattcacccaaaaactctgggagtggagcccagcaactgagccatgctaaggttggtgagccgctgctctggaacattgatccctcccaaactgcagcaaagcaagcacctgggtgtagctctggctgtgtaggtgctactacaatctgctggagtcactgcttgtcggcagagatgccgtgggagctggcctgggtgcctccacgttggccgtcaccaccaggcagtggcctttggcctggaatcgaaggtaccagagggctgatagctcagtttttttatggcaccaagaaaagactttcagattggaggtatgggattttctttattttttaatcctcttttaatataaagtggccccttagcaaactttcaagatatttcacatcagaactggccgggaaatccggcatgtggacagacacggatatgccgtgtgcatttttccgttggaggaagagggtaggcttgggtgctggagggtgttgcctgggggcggagcgagaaggaagaaagggcgctgctggttcacacctcacccatgccctcctctcaggccccaatcaggatggaattaaaagaccctgggaggaaaataaggaaagcaacaaaggaaatgagttccccatacagaaagggaaattgcctttcccgttaaggtcagactggtccgaagtaaaggactggtgcgccttagcaaccgcctctgctgaagccctaacgctggagctctttcgccctcgcagaataaccgggactttcttgcagccggaaccagccacgtcctgattccacactcccttgaggagccagccagctccacatttactcaaagaatccgaagggcaccaagtggatgctctgccacacgattgaagagggcaagctgtctggggggttttccacctcttttcaactcaactattctgagctgaagtactggacccgttttgtttttcctgttttttcctgcttcggtaaatctggaaaaatcctgcaggtctgaaaaactgttggacttgacagcgtgtgtgtagcgccacctggtgaccacagcttatcaaaacagcttccttctggggctcttgtggatgtacatcaaaggctccagcttccagacaggtacacatcctgttctcacgcccggcccactttcccgtgggaatgtcagccactctgatttgccttggctgaaaacctcctgtctttgcatggaaaaaaacacaaataatatgaacaagcaacagagttttctttctctcttaagtaaccaagcatttaaaatcttctaaagcacacatttccctaattgagaaaggaagcagaagaaaaatttctggctgaaattataaatcataataaatggtcggaaataccttctcccttagattcctggggtcctagtgtagaggagacttcagttgcccttgacactacaacatcctgactaaaagcctgtttccaaggtgatatttgatagacatgaaggacccaggtggaaaagaaggtagtctggacggcacggcaaggagtggaacacgcaggctatgaggtgtcagcagaaatcagttctggtcctggcactgctaccaacttgctgtgtgaccttgggaagttacttaagctttgtggatctcaatgccccagactcgttaacttctttactattttttcccataaattcagtgtttctgaaagatgttgcccaccagaatgcatctctaaaataggagcttaataagctttctgtcttgagggatcagacgtataaatgtcaggcaggccttctgatgatcatgatgcaaccagagttaccacagtgagtccatatcacagacaaaggcgaagacacttgatcccttcttaacctggtctcccacccatgaatgatttttgttaggatttcagcatgttgaaactaacccacagaccctagttacaactttctcagggcctgagagctggggaatcccagtttgggaaccaaaaaactagaaaatcttgagggcaactctggctgtcatgaactaaaacagagcaaagatggaagcctgtggtatgtgcgtgcaggtagaatctcgatttgagaaatggcgttacaaggaattaacacttcagaaatgccagctctgtgccaggatttttttattttattatgtatatttgtcatggacaacatgttttggaatatgtatacattgtggaatggttaaataaagctaattacatatgcatgtgctcacaaagttatcattttaggggtgacttaaaatctctcagtgattttcaaaaatatatgttattaatcatagttgcaatgttgtacaatagatctcttgaacatatattcctcttgtctaactgaaattttatgttctttgaccatctccccaactgccccccaacaagcctgaaagccctggtaacccctattctactctctacttctttgagttcaactttttaagagtccacatatgagatcatgcagtatttgtctttctgtgcctgacttatttcacttagcacaatgtcctttgggttcatctatgtcacaagcaacaggatgtcctcctttttaaaagactgaatagtattccatggtgtgttttctttatccaaccccattttctttatccatccatccgttgatgaacacttaaacacttagttggtttcaaatcttggctattgtgaatagtgctgcaatgaacatggcagtacagatacctcttcaacataccaattttatttcctttggatatatatacccaggagtgggattgctagatcatatggtagtactatttttaattttttaaggaacctccatactgttttctgcaatggctgtgttaatttacattcccaccagcagtgcacaaggcttccctgctctccacaacctcgctagcatttgttatctttcatctttttgataacagcattccaacaggtatgaggtgatatctcattgtggttttaacatgtatttctctgataattagtgcagaagttttagatacagaatcacagttagtcctgacaataatctctaaaatacccatgcagatggggaaagagctgcagagaagttaaagaaattgtctgcaccttacagctgagaccagaaccaggtctgtataatttcagagcacataatctttcaaagtaacctaacaaaatcacagcaacttttaggttcacagagaacaggccaaaaaaacaaacaaacaaaaagaaagaaattatagtaatttccaggtatgaaccagtaatccaaactaaacatattttgttgaatgaatatcctggattctactatgtttctccaagtccccactgtcttaaaacatagcatttggggttcagtagttactgataaaccttttgcatatctatgcactgttagttctttaccctacacattattttattgtagtaaagccaattttctgacatttatctgaaagcaaactgtgaagtacttccattctacttcctggtgatttttagtgacctggtgccatttgaacgtatgtgtcctccaaaattcgtatgttgaaacttaaaccccaaagcaatggtattagaaggtggggcatttggaaggtgattaggtcatgaggccgccaccctcatgtgaatgggtttagtgcctttataaaagggctggaaggaactagctaggcccattgcccttccatctcttctgccacatgagggcgcagtatttatcccttctgctcttccaccttttccaccatgtgagaacaccagagaaaataccaatctgtggccaggcgtggtggctcacgcctgtaatcccagcactttgggaggctgaggtgggcggatcactaggtcaggagatcgagaccatcctggtcaacatggtgaaaccccatctctactaaaaatgcaaaaattagctgggcatgctagtgcgctcctgtagtcccagctactcaggaggctgaggcaggagaatcgcttgaacccgggaggcggaggttgcagtgagccaagattgcaccactgcactccactctggcaacagagcgagactctatctcaaaaaaaaagcaagcaagaaaataccatctgtgggacaggccttcactagacaccaaatctgctgacactgtgatctgggacttcccagcctccagaactgtgagaaataaatctcaactgcttatgaattacccagtctgtggtgttttgctatagcagcaggaacagactaagacattcagggtaatgtgtcatttcaagacatgaaagctcagttctgtaatattttcttctcttattcctttgataattttcttctacccatcatctgttttctctttctgaaacttctactagttaaatattaaacaactctggtttcttaacctttcttgtgtatattatgattcaactaggatcaaaaaaatatctaattaaacagtagcttaaacaaattaggggttttttttgtttttgtttttgttttcacacaagaagtcaagaagtcattggaccagtgttatttcagaggctcaggaatgtcagggcaaaaatatctggaactctcttggtctcttacccatggctacaagatagctgctgcagctccatccatcccatccacattcaaggcagaactaaatgagcagcagaaggaagcagaaaggtttgtatttgtatcagaagaataaagcctttccagaaattttctacagacttaaacttatgactccttgaccagaaatgtatcaaaaggcaaatttaattacaggaaagtctaagaaaggaagttttagtatcccaccatgaaagtgcaggaagacaagagaaaggagggttgtaatgaaggaatgagacaatccagtgccctattttcttttttcttttttttcttctctgagacagagtcttgctctgtccctcaggctggagtgcaatggtgccatctcagcttactttaaccttcgcctcccaggttcaagcgattctcctgcctcagcttcccgagtagctgggattacaggtgcccaccaccacgccaaactaatttttttgtatttttagtagagacagggtttcgccatgttggtcaggctggtctttaactcctgacctcatgtgatccacctgcctcggcctcccaaagtgctgggattacaggtgtaagccaccgcactgggccagtgtcctatttttgtcctttttttttttttttttttttttttacttcatgcaagaattcctcaattttatcttctaaactttctgttgatttttttttgtttctgccctaattattttaatttctaagagtgttttcttctgatattttttgttgtgttgttttaatagcttcctatcttgtttcatagctgtaataccttctcatctctctaaagatatttataacttctctttaagtccattttgttttttgccttttcctcataatattttctttttcttcaaaattgatagctctccccacacatagacattttagcctctgtcttctatttgggtagcgtccctcaaaagtctgatgatctgggctgttgattcatacataaatatgagacaccaagaagttgtttggaggagctgtgtgattaaattagaattgtcccctggcagcgtgcagagtgatcaggtgttgagccagctctttcatggggcagacccccacaaccagtgtcattatgtgtgagtattttctctggatttactgagtttttccattgattttccactctggtcttcaatataatggagttggagaccagggtccaagcagtaattccactgccatagtgggagcagggaggatggtgggagtactctgagccgaagactctggtcaatttctccagagaaggaacttcgtgttctacagaggttagagaaaggtcatactctgatggtgtggattagaggtctaaaagatcctttgagaaaccatcaaataatctctctgtcttcatctccatgatcttgtcctcctttgccccttccactgtactggtgtccccaatttcaaaaggtttcaggtgttctgttgaacaaatcttttgtttctcattactcttcccttcctgagatacgtgggtttcagcctccgctgctaagtgagttaccattcctcaaaccacttttcagcttctctactcttctctccctccaattctctctgtccttatgagtttatgcctttttagtccttcattgtaattttggacagggaggagagggtggaaatgaagctcagatatatgtaagtattgaatctgccatgctaaacgggaagtctacacatatttttttaatatttccaatttcacaacacaattcctccaaaaaaaacttatggagctttttattatgaatgtgtcactgacattcagtcataatctatcttagcaacgatataggcacataccagactgaaaagatttgacaaacggtattctgagaaacccacatttggtcaataatcaaggaaataatttgttaaaaaggaataagatgaaacaaatccacattgcgtttgagctctataagtcaaagatacagttttaaaaagtaaactcaagtaatccaatattacaagatctagagggtcaggacaaagtgagttaggcttgcacatcaaagaaatagctaggcaactaccaaaaatgtttccaggtgaaatcaagttgcaaaattgtataaacaatcttgagataattaaacaaaagaaaatatattttcagatgttaagggctgcagagggaaaaagagcgactctatatagagaaaattaatatactggagcttatctcctaagaatggcttctgaagcataaggtgtttttttttggttttttttttttttgagagtctcactctttcacccaggctggagtgcagtggcatgatcttggctaactgcaacctctgcctcttaggttcaagtgattctcgtgccttagcctcctgagtagctggaattacaggcacgtgccaccccacccagctaatttttgtatttttagtggagatgggatttcaccatgttggccaggctggtctcaaactcctcacctcaagtgatccacccacctcagcctcccaaagtgctgggattacaggcatgagtcaccatgcccagcctgaagcatacattcaatctaacaagtcttctaggtatttgttctacagacacagttacccaagtgctgaattgcatacattcaaggatatttattttggagtattttaaatcataacacaaaatgggaatattctataaatatttcaataaggtctgccagacccatatatccagtagccatgggaatgatatctaagctgtgagtgaaaaccaaaggattaaaaacatgggcatccaagagaaggtcagggttcaacgccagcacggtctttgacacagcggctagcaaagattcattggtctgtgcaccatttccagcagctatactccagagttgctggtgctcaccatctcttcacttctctgcctggtatttagaaataaggctgatctccttacagtgaataattctctggtgcaggccacgagaggagcctggacttcgtcctccttgtggcagtaaagaggagcctctcccctctcttctggaatggtatcagaggagcttagtagagactcgagattttcattattatccaaaggtcacaaggccacccccaccatgatgtcattggagactacctggagaggctcaaggacccgtgaatctataacaaaagatctaacatttatgtcctcagacttccaaaaggagagaagcaaaaagacataaccgaaaaagtattctcacagaaatatagttgaaaacttcccaaatttgccaagagatgtaaatgtacagtttcaacaggctgagcaaacctccaaacataataaacccaaagaaatccacaccaagagacatcataatcaaatttctgaaaactaaatacaaagaaaaaaatcttgaaatcagccagaggaaaacatggcagaaacaattaaaatcgaaatagatttctcatcataaaccatgtattccaaaagaaaagtgacacaaatatttttcaaatgctgaaagaaaagaactgtcaatccagagtcctatacccagtaaaaatatcctgtgagaattaaggggaaatcacaatattctcagatgaagaaaaactaagataatttgtcatcaggagaaccgccctagaagaatagctaaaggaagttgtctaaacagaaaagaaatgatacaaggaggatggaacaccatgaagcaaggaagagagtacatggtaagcaaaaatattggcaaacacaataggctttatttctcctcaagagttttccaaattgtatttgatggttgaagcaaaacttataacactatctgatgtggttctcaatgtatgtagaagaaatatttaagacaattatactataaacaggggaagataaaagggtgttatggggggaaagagttctatacttcactcaaaggataaaaaagaacatcagttgactgaaataggttatggatacacaatggaatacttagagcaatcactaaaagtgctatacaaagaaatacaaatgctaaaaaagaaatacattcaaaacactatagataggctgggtgatgtctcacacttataatcccagcactttgggaggctgaggtatgcggatcttttgaggtcaggagtttgagaccagcctggccaacactgtgaaaccctgtctctactaaaaatacaaaaattagccaggcatggtggcagacacctgtaatcccagctactcgggaggctgaggcacgagaatcatttgaacccaggaggcagaggttgcgatgagcagagatggcaccactgcactccagcctgagtgacagagcaagactccatctcaaaataaaacaaaacaccacagataaatcaaaatggaaaaatgttcaattaacccagaagacagagaaagtgaacagagaaacagaaagcagaacaaacaaaacaagaaataaaatgtcaggcttaagttatagcatatcaataagtacattaaatgcaagtagccaaaataatcaattaaaagacagattgacagattggatttacaaatatgacccacctgagtgaggcctggtggcttgcacctgtaataccagctacttggtaggctgaggtgggaggattgctcgaggctaggagctcaagaccagcctaggcaacatagcaagaccctcatctctaaagaaaaaaaaaaaatagctggaaatggcagcttgcacctgtagtcctagctactcgagagtctgaggtgggaggatcacttgagcccaggagttcgaggctgaggccacagtaagccatgatcacaccactacactccagcctgagtgatagagcaagacccttctctaaaatatatatattcagattgaaaaaaaaaggatagaaaaagacatagcatgcaagcattcataaaaggaaagcagagatcgagcactatggctcacacgtgtaatcccagcactttgggaggctgaggagggtggatcacttgaggtcaggagttcgataccagcctggccaacacggtgaaacccccgtctctactaaaaatacaaaaatcagctgggcttggttgtgggcacctgtaatcccagctactcaggagactgaggcaagacaattgcttgaatcctggaggcagaggttgcagtgagcagagatcgcaccattgtactccagcctggacaacagagtgagactctgtctcaaaaaaatggaaaacagaaatggttatattagtatcaagctaaagtagacttcagagcaaagaaaattgctagagacagggagggagactacataatgatcaaagggtcaatccaccaggaagtattaacaatactaactgtctgtatgccaaacaacagatctgcaaactatatgatgcaaaaactgatagaactgatagtagaaatagacaaatccacaattatagttggagactccaacactcctctctaaacaattgatagaacgagtagaccaaaaatcagcaaggctgtagaaaaactcaacaacaccatcaaccaacaggacctaattgacatttgtagaacagctgacacaatagcagaatatacattctaatacacatcagaatacacactaaacatacaccaagatagaccatatacattctaatatacatcagaatgcacactcaacacacaccaagatagaccatgtacgttctaatacacatcagaatgcacacgtggcctcccaaagtgctgggattacaagcatgagccaaagtgcccagcccaatatgaaatagataatttgaatagccctataactattaagaaaatttaattcataattttgaaattccctcccagaaaaatatccagacctaaatgctttcactagataactctaccaaatgtttaaagaattaacaccaattctacgtaatctcttccagaatataggtaaggagggaattcttagttcatttatgctgctataacaaaatacctgagactgcatcatttataagcaatataaattttttctcacagttctggaagctgggaagtccaagaccagagcaccagcagttctggagtctggtgagggctgctatctctgcttcaacatggcaccttgttgcatcctcctgggagaataaatgctgtatccttacatggcagaaggatagaaggacaaaaagggcctagctagtttcctccagacctttcatatggcactaatccattcatgagggctctccctcatgacttaataacttcttaaaaggcctcatctgttaacactaccataatggggattaagtttcaacatgaactttagaaagaacacaaacactcaacccatggtatcttcataattggttttatttctaccaagaccagatgaaggcagaaaactaccaaaaaaaaaaaaaaaaacaaaacaaaaaagtcagaaaaccacagatcaatactatcttgaaaacagacatgaaaatcctgaaaaaaaaaattagtaaataaaattcagcagtatgtaaaaagaattatacatctcgaccaagtggggcttattatagggaggcagagctagtccaatattggaaaatcaataaatgtaatcaaccatattaacaagctacagaagaaaaatcacatgatcatatcaattgatgtggaaaaagtatttgacaaaattcaacactcattcatgatttaaaaaaaactctcagaaaattatcaatagaaaagaaatgcatccacttagtaaaaagcacctataaaaaacctacagcaacattatacctgatggtgaaagtctgaatatttttcccttaaaatcaagaataagacaagcgtattcacacttacattcttattcaacatagtactgaaagttttagccagtgcagtaagacaaaaggatggggtgagggagaataaaaaggaagacattattatctatatatagaaaattccaaggagtatacaagaaaaacaaactcttagtactgagttcagtaaacttgcaggatataagataaacatacaaaaatcaattgtatttctatatactagcaatggacatgcagacatcaaaatttaaaatataatatcatttgcaatcactcaaaaagaatggaatacttaggtgtcagtctaataaaacatatccagggattttatgctgaagactatgctatgccgatgaaagaaataaaaatatctaaataaagggagagacatactgtgtttatgactagaagattcaacataataaaggtgtaaattctcccaaattgatatgaagtcttaatataattcctatcaaaatcccagaaagttttaaaaatagatataaacaagcttatcctaaaatttaaatgaaaaggcaaaggaactggacttcaaaacaattttgaaaaagaagaaaaaaagtgggaggtgactcagtctatctgatttcaagacatattatataggtcagtaatcgagactatgtgatattggtggagagatagacacataggtcaatggaacagaataaagaatccagaagcagatccacataaatatgcccaactgatttttgacaaggtgcaaaagcaactcaacaaaggagaaacaggctttcaacataagatgctggagtgattgcacatctattaccagaaataatgaacctcaacctaagcctcacacctcaagcaaaaattaactcaaaatggatcatgaacttaaatgtaaagccataaaacacttaggaaaaaaacataggataaaatagtcaagatctagaatgacgtaaagtgttgtgtttttttcacatatggagaatgccctgtgatagggttcttagacttgacaccaaaagcacagttcataaaaggaaagatgtataaactggacttcatcaagattttaaatttttgttctgtaaaaaatcttgttaagagaatgaaaagacaagctacagagtgggaagaaaatatttgcaaaccatatatctgacataggactagtatctggaatatataaagaactctcaaaaattaaacaataagaaagcaaacaatccaattaggaaatggacaaaacatgtgaagagacattttaacacagaaaatatacagacgacaaataagcacgtgaaaatatgttcaacagcataagccattcgtgaaattcaagttgaaaccactatgcagtattactacatatctatcaggatggctaagatgaaaaatagtgacaccaccaaattctgacaaggatgcagagaaactagatcactcatatgatgctggtgagaatgtgaaatggtggtgtttggaagtttcttagaaaagtaaacatgcaactgccatatgacccagcaattgagctcctgggtatttatctcagagaaatgaagacttgtagtcacacaaaagtttgtgcacaaatgtttatagcagctatattcataagagctcaaaactagaagcaatctagatgtccttcaataggtgactgcttagacaaaatatggtacattctatgcgatgttattcaacagtaaaaaggaacaaacttttgataaacacaacaacctagatgaatctccagaggattaggctgagtggggaaaaaagccaatcttggccgggcgcggtggctcacacctgtaatcccagcactttgggaggccgaggcaggcagatcacgaggtcaggagatcgagaccatcctggctaacacagtgaaaccccgtctctactaaaaatacaaaaaaattagctgggcgtggtggcgggtgcctgtagtcccagctactcgggtggctgaggcaggagaatggcgtgaacccgggaggcggagcttgcagtgagccgagatcgcgccactgcactccagcctgggcaacagagcgagactccgtctcaaaaaaaaacaaaaaacaaaaaacaaaaaaaaaagccaatctcaaaaggttgcctatgtatgatttcatttccataacgtttttgaaatgacaaaattctagaaatgaagagttgattagtggttgtcaggagttatggagggggtgggagcaggaagtcacgggttgtggctataaaatggcaagatgagggaactttatggtaacgaaaatgttctgtatcttgacagtatcaatgtctatatcctgattataacattgtgctattatatgctgttaccattggaaaaaaaatgggtaaacggtacacaggatcttgattatttcttacaactacatatgaatctacaattatctcaaaattaaaagttaatttttaaaaacaaattcagggcatacacatacaaaactaaatttatcttttataagttggcagggttctgctgatatagaccaggtggctctgctgaacttagctggcctcactcgtgtgtgctgctgatctaggctgggttcctccaggtcaactggagaatttgattctgtttcatgtatctgtcatcctcagcaggctggcctgggcatgttcttatggccatagctgaggtgcatgagaaaacaagctctagcttgggcgcagtggctcacgcctgtaatctcaacactttgggaggccaaagcaggtggatcacttgacgtcaggagttcgagaccagtctggtcaacttggtgaaaacccatctttactaaaaatacaaaaacttagccaggcgtggtggtgcacggctgtaatcccagctattcgtgaggctgaggcacgagaatcgcttgagcccaggaggcaaatgttgcagtgagccaagatggcaccactggctgggtgcagtggctcacgcctgtgatcccagcactttgggagactgaggctggtggatcacctgaagtcaggagtttgagaccagcctgaccaatatggtgaaaccctatctctactaaaaatacaaaaattagccagacatggtgacgtgcgcctgtagtcccagctacttagaaggctgagacaggagaattgcttgaacccgggaggcagaggttgcagtgagccaagatcgtgccactgcactctagcctgggcaacaaagcaaaactccatctcaaaaaacaaacaaacaaaaaaaaatcacaccactgcactcctgcactccactctgggtaacagagtgagacaagacgagacaagacaggacaggacaggacaggacacgacaggacaggacaggacaggacagggaaaggaaaggaaagaaaaggggaaagggaagaagaaaacaagttctcgtggacaaacctctctacagcccaaatttgagtcacggcttttacacactaatgacaaaagcaagtcacatgattgagcccagaaccaggggacagggcaggtcattcatgcatggtgggagggcactgtgaagttacgtggcaacaggcatgaatatggggcagaggaggtgaaaagctggggtcaaggactctaccaccatccttgaacacctccaggactaaaaatacctattgcggctttctcttcttactgcagtaactcttacccactcccccactctacctgcctcatccaagtgagggggaaatgaaaggaagaagaggaaacagagcattgaaaatgtgtgcctctgtgtgtgtctgtgtgtctgtgtgtgtctgcgtttgtgtctatctgtgtctctctgtgtgtctgtgtctgtgtatgtgtgtctgtgtgtatgtctgtgtatctctgtgtgtctatgtgtgtgcctgtgtgtgcctgcgtgtccgtatatgtatgtgtttgtctctgtgtctgtgtatctgtgtgtctgtgtatcagtgtgtgtgtgtctatcagtgtgtgtgtctgtgtatcagtgtctgtgtgtctgtttgtgtatctgtgtgtctgtgtatctgtgtgtgtctgtgtgtgtgcctgtgtgtgtctgtgtatctgtgtgtctgtgtgtctctgtgtgtggctgtgtgtgtctctgtgtgtgtgtgtacctgtatctgtgtatctgtgtgtgtgtctctgtgtgtgtctgtgtgtgtgcctgtgtgtgtctgtgtatctgtgtgtctgtctctgtgtgtggctgtgtgtgtctctgtgtgtgtgtctgtgtttctgtgtgtgtctgtgtatctgtgtgtatgtctgtgtatgtgtgtgtgtgtctgtgtgtgtctgcatgtgtgcctctgtgtgtgtatctgtatgtctgtgtatgtgtccctgtgtatgtgtctctgtgtatctgtgtgtctctttgtgtgtgtctgtgggtatgttgtggaaatccttggaaatctcctatttgtgggaactgaatccccagcactgccatgtaaatatttttccctctcatgggccactgtggccattgtccattgtttcaaagaccctacaacaggatctgagtttccctttgccaaaagacaggtcacagggaagggaacacagctgacccttgaacaatgtggggttagggatgctgacccccacgtcgtcaaaaatccgcgtataacttttgattcccaaaaaaggagtcaggctgatgtctgcccaatattctactgaacttaactaccaagagcctacagttgactgggaaaccttgctgataacatagtcagttaactcatatttcgtgtatgaattatataatgtattcttacaataaagtaagccaaagaaaagaaaatactattaagaaaatcatgaggaagaaaaatatttcctcttcgttaagtgcaagtggagtttcatgaaggttttcatccttattgtcttcacactgagtagggtgcggaggaggaagcggaggggttattcttgctgtctctgggtggcagaggcagaagaggcggaggaagtaaaagggaaggcaggagaggcagacacactcagtgtagcttgtactggaaaaaacctgtgtataagtgaacctgtgcagttcaaatccgtcttgttcaagggtcaactctctataacgtctacaaatgtcctaccctgcgccaggctgcctctgccccaatctttattccatcttctgccccatctctgactctcttctcacctttacagttttctagagtccttgttcctttcctagcacgcacccagactttatgttatgagaatccctgtccaaagccactgagagcagtctctttgcctccgtatcttcattagtaaaacatgggtatcagcagtgcccacctcacagcgttgatgtgaggatgaagcgacatgactgataatgagtttacactgcccggtatgcggtgattcctcaataaattgcaggatgtgttttttcttttcttttaatatgggggtaggggctgcccagtctcactgcagacagctaaaggaatcgcagcaccaggcgcgatggctcacgcctgtaatcccaacactttgggaggccgaggcgggtgcatcacgaggtcaggagttttgagaccaacctggcaacatggtgaaaacccatctctactaaaaatacaaaaattagccggacctggtggcgagcgcctgtagccccagctactcaggaggctgaagcaagagaatcgcttgaacccgggaggcagaggttgtagtgagccgagaccgcgccaatgcactccagcctgggcgacagagcgagactccatctaaaaaaaaaaaaaaaaaaaaaaaaaggaatcccagcaatccaaggcggaattctagaaatagtttcccgtagaaacaccgttctacactgcagtcttattctatcccactattattactcccaaagattctaaggtcccagtgctttcgcttcatcctagaggctaaatgggctcccctggactcgcctggcagaactaaccacctagaagaacgttattgtaagggggaaatgtgagtgctacataagtttcttataaatgtgcttttgaaatagagtccactcttaagtttgatatttcctaaaatttaatgtgtgaaggaagatgcttgggagacaatccgtttatcaggctgatatatggcagatagtctactgacctccctgagcaagaaccttaggaatgaggccaggtggcagaaacactcagggccaagggtagggagcaaaactgtgatgtaaagagacctagatggacttgggaggaggtggggttcaataggaggccacgactaatgccctggcatgcaaaggctggacaggagtcttgaaagagcctcaattagctgggcgtggtggcgggcgcatgtagtcccagctactcgggaggctgaggcaggagaatggcgtgaacccgagaggcggagcttgcagtgagcctagattgcgccactgcactccaacctgggcgacagagggagacaccatctcaaaaaaaaaaaaaaaaagaaaagaaaagaaaagaagaaacaaagagcctcaaaaatatggaaaaccagatcctaagagcaaaatgccaagggggacacttattagtgaggagtctgcaaaaacagaaaggttttagccagaagcttataggagtagacctggaacccaaattgaaaaggaacagtgcgacccgtaatttgagaaggaaatagaataggcagaagaactacagaaactatagcttcgagtctaagagcctatttacaggggtgtccaatcttttggcttccctgggccacactggaagaagaattgtcttgggccacacataaaacacactaacactaatagctgatgagctaaaaaaaaaaaaaaaaaaaagaaaagaaaagaaaagaaaaaagaatggccgtgcataaatctcataatgttttaagaaagtttacaaatttgtgttgagccacattcaaagccatcctgggcctcatgcagcccgtggaagcttgcataagagagagatttaggaccttttggcggaagtgctcgataaggattgaatagcaccataaactgaagctaaactgaaaggttttagaatttaacttaagacacctcaaatgcttttagatgaaactcaggacttttcactgtagtaaagttcagcgtgaaattgaccttgtaggggcaccagacagcagtgagcagggtgtataagagtgagggaggggttaataaatagagatggtgggaaaaggagctggcttttcgtgagttcagcttcttgcagactagactagcaagagtcaagaatgaacctaagccagactcaggtctactgggcagtgctaggcctgtctcaaccctgtttgcacatcaggtaccccatgcgtctgctgtagtctgtagctacatgggaacctaaaacatcaccgaggtttctagtgatgttgaaactcagctaataaacagggaatcccgagggttcccctctactccactcctgacagtggccatcctgcctctgcttgaataccttaactcgcctctcatgaggcacccatctcctcattaaatgattgtcactgggaagaatccgccccacacagccagatcaaatttaccccctggtaactttcagcccctggtccccattctgctctttagcactaggtagctgaatcgaatctttccatgagagtcaattccattcctcctaaatcttctctcttctaagataaatagtccacattatacaatcttaatacccaattcaatgagcacttcatgatagtctaatatatgcaaagcaccatgcttgtgccaagtgggaccctaaagcgaatattatctccttgctctttaggcaaacagggtgaagacaagaggcataggtgatggacactaaaacaaagaccgtaagtactgtaatagctacacacaacttacaatcatataggcatggggaaagagtagcccagcttaccttggaggatctggaaaggttctaagaagaagtggaattgagttggagttggaaagacttcaacaatcagatgtgagaaggacgtgggtggtgagtgcaaagaaaataggacacggctgaggaccttgttttctttttcttttttgaggtttttttcttcttcctttgtttttcgttttatttttatttttcattaacaagtagtaataatacatgtttatggagtacaatttgatgttttgatataggtttacaatgtggaatgattaaatcaggctaattagtaaatccatcacctcacaaacttaccaattttttgcagtaaaaacatttaagatctacttttagcaattttgaaatatacaatgcattattacttattatagttaccatgctgtgcaattgattagtaaagcttattcctcttgtctaactgaaactgtgtagccttttcccaaccaccgctccacccccagtccctggtaaccaccattgtactctctacttctatgagatcaactttctcagatcctacctatgagtgagatcgtgcaatatttgtctttctgtgcctggcttatttcacttagcgtagtgtcctccagattcatccatgttgtcccaaatcacaggatttcacccctgtttaaggctgagtagtattctattgtgcatatataccacattttctttattcattcatctgttgatggacacctagattgattccatatcttggctatggtaaatcgtgttgcaatgaacatgggagttcaggtgtctcttcaacatactgatttcaatgcctttggataaatacccagaagtgggattgctgtatcaggaccttggtttcttagcttctgtctgaccttgagcatacctaaaataagagccctgaacgagataatttctaaagtttagtgatagagaccaaaaggagtatacgtctgagcattccaacttaggccaaagcctaaaagtgagaagcctgcccatatcaagggagtgaggtgtgtgtttggggcaggggtagtagaagagcaagacggttcatgaattcagtattcttgtttcactgatgcagcacccatcaccattctgatcaggtcccttggggacatggacagtgtccttagaatgacaatgatgatggtaccaccagcaccaccaccaccatttctctagcatgtgggtgagccaaacacctttggaaacaccttacatatttacatttacatcctactgaatcctcataacagccctgtgagatagatagaatttttattattctcattttacaaattagaaagctgaggcacagaaaggttaaataacttgcccaagtccatagggctaatctaatagcagagctgggatttgaaggcaagtagtctcactccctgcttttcttcctcgaaaaacacaagggcagggctgaactcagctcaggggacacaatctataccaggacaaggttacaatggccctataacttcttcttcttcttttttttttttttgagacgaagtttcactcttgttgcccaggctggagtgcaatggcgcaatctcagctcactgcaacctccacctcccgggttcaagcaattctcctgcctcagcctcccgagtagctggggttacaggcatgtgccaccacacccggctaattttgtatttttagtagagatggggtttctccatgttggttaggctggtctcgaacttccaacctcaggtacccgccttggcctcccaaagtgctgggattacaggcgtgagccaccatgcccagccggcaatataacttcttttgcattctcattaactcagcctcagacgacactggcttccttggaagccactgcatactgatgattgaagtggagctgacaatcacctaaaaacccctaaatgcctttgacatgagccactcttaagccaggtctctcccattctgttcacgtgtggctgatcagttcaaactaaatgttgggttttacgttgaaccctatacaattctaggttttagcttatagtttcaccctactataattttgaaacatgatatgttacctaatgttacctctcccggtttagtaataacataaacaaaaacagttgacagttatgggggccctgactttgtgccagacaccctgctacgtatttgtttgtttaatgtaataccttatataatcatttagtctttacacaaagttaaatattattattattctcacttaataggataggaaaccaagtctagtgaagttaagaagcttgctcaaaatccaattaggggctgggcgcagtagctcatgcctgtaatcccagctctttggaaggccaaggcaggtggatcacctgaagtcaggagttcgagaccagccaggccaacatggagaaaccccatatctactaaaaatacaaaaaattagccaggcgtggtggcaggtgcctgtaatcccagttacttgggaggctgaggcaggagaattgcttgaacccaggaggtggaggttgcagtgagccgagatcatgccactgcactccaacctgggcaacagagcaagactccatctcgaaaaaaaaaaaaaataaaatccaattaggaagggactgacccaagagtcatacctaggattatctgactccagggcctgaacttttatctatgttctctgcagcgtcctcacatcttctacacacttgttattatctaagtcaatcatgaaaaatgatgaaacaggccaggcgtgttggctcacacctgtaatcccagcactttgggaggccgaggcgggcagatcatgaggtcaggagatcgagaccagcctggccaacagggtgaaaccccatctctactaaaaatacaaaatgagccaggcgtggtggcatgtgcctgtagtcccagctactcgggaggctgaggcaggagaatcgcttgaacccaggaggcaaaggttgcagtgacctgagatcacaccactggactccagcctgggcgacagagcgagactccatctcaaaaaaaaaaaaaagaataaagaaaaatgatgaaacagaatcagggagagaattcagaggaaaatgacatccctccaggtgtgtatgaaccaattactcatagagtcataaacagttagagaatgaggcatttttcacaaaatattgagggctggagaggttgaacaatttgctcccactcacacatctaggaaagagaggagatggaaaagtaaacaatccagaaaggtcaaggccctcattccatcaatgcacaattcaagtacacatacgtgggaaaccatctgaaaagttttgtaattacaatttcatctagccagcaattctccaactcattcacatgcatctcatgacatcgttgtcagaagccttgctagagtgaacgtgcacttcatcaaacacacccctgatccgtgggagatgggattcgtttgtgctgatctactctccaggaacacaagaaactcaccattctaacggttcataaatcatccatttaataccccagtttcagattttgcaggaattaacatcaatgcacggtttttgagacccgccaacttgctgaaacagtgcaagccacctgcagtcctcggataccactcagtgatggccctaggtctccctactctgggcctgagattcacttacagctgcaaaacacacctgtgcactctcctcataggcagaacgctttcacttctcagtcatttccaactgagactgttttctctggtagagaatacagaagtcaaatggactcagagtggttctgccttgtctctgccttctgttgttgagaataaaccagaaaaatcccttcttctgtcattaacattttcaagaagctccgttcagtccagtgctcttatttcaggcctatcacaccctttcatatttgtgttttcatagccactgacaaagactgtgtccttgaccaaactttagtcaggttcctctgagcccaatcaggccccatccttgggcatgcccccacccccaatgtctgatcaccctcaaaatctgatcaaattcctcatccctcatcatccccgaggcgatgtctgatcaccctgcctggtcttcagcaaaaatcacactaggtcaacttagccagaatcccctgactcccaatgtttccccttagtaattttccacccactgaccccaccttattccttggttacaaatccccatttgcctctgctgcattcagagttgagcccagtttctctccctgaccacaagaccctattgcagtggtccgtccctacaccaactgcgatagtcccggataaaatctgccttacccttttaacaagggtcaagagtaaatttttccttaacatctcctgtgggcactatttgtatacatttaaagtgagagcttatccaagagcttcctttttagcctggcaatcaagtatcctttttgcttctttctcccgatcactccctaaacccctcatctatagtaagaagcagaatcagaatttgactccaagactgtgcctgaggagcctgagccctaaatactgtgctctattgttacctgtgttatctgtaaataactgagccattgattaaaacacagttaataggctgggcacggtggctcacgctcactcgtaatcccagcactttgggaggccaaggtgggcggatcaactgaggtcaggagttcgagaccagcctgaccaacatggtgaaaccccatctctactaaaatacaaaagttagctgggcgtggtggtaggcgcctgtaatcccagctactcaggaggctgaggcaggaaaatcgcttaaacctggaaggcctcggaggttgcagtgagccgagattgcgccactgcactccagcctggacgacaagagcgaaactccatctcaaaacaaaaacaaaacacaatcaataacagaacctagagatctctagctagatgcatctcaatcaattaagcatgcaatcaaagagactgaaggggacctgaggtccagataatttaagtgatttaaccaacgttaaagattatttcttaaggggaaaatcatgactctcacatgatataaaagaacatgtggcaaatattttatttaactaatttaactggagccagcaaaatattaaaaccagctcaaaggagaaaactccaactaccacacatttatagtcagataagaaataccgaaataaatttacaaacaggcaaaactggaaaaactggttaatatctacaggacaataaacaaaggcattccacgggagactatttgcattataatatgcaaggaattatttgcattacgatcagttttctatatgttaacttctttctaaggagttgtaaaatagcataatcaaaagcaaataaataagcatatctctataaaatcagataatccccaaaggctctaacattccattgaaaggatatccagtaatctctttgcccattgcaaatctttccatttttccctacgccaaagtcaaaaagcagtaatagcaactccagaaaagaggtgaagagagccgggctcggtggctcacgcctgtaatcccagcactttgggaggccgaggcgggtggatcacctgaggtcgggagttcgagaccagcctgaccaacatggagaaaccccttctctactaaaaatacaaaattagctgggtgtggtgacacatgcctgtaatcccagctactagggaggctgaggcagaagaattgcttgaacctgggaggcggatgttgcagtgagccgagatcgcaccactgcactccagcctgggcaataagagcaaaactccattaaaaaaaaaaaaaaagaagtgaagaacatcaacaaactgggctgcatctgaaccatgtgaagaagatggtcaggtttagtggttagcgtcatgggccttaaagacagtgcctgggctccctcaaattccagctttgcctcatgtgctcgtgtgaccctgggaaattttacttaagtcttttgtgtgtttgtctttttttttttttttttttgagatggagtctctgttgcccaggctggaggagtacagtggctccatcttggctcactgcaacctccccctcctgtgttcaagcaattcttttgcctcggcctccccgagtagctgggactacaggtgtgtgccaccacgcccagctaaatttttttgtgtttttagtagcgacgaggtttcaccatgttggccaggctgttctccaactcttgacctcaggtgatctgcccgcctcggcctcccaaagtgctgggattacaggcgtgagtcattgtgcccagactcttttttttttcttttttttgagacggagtctctgttgcccaggctagagtgcagtggcatgatgtcggctcactgcaacctccgcttcccgggttcaagcgattctcctgcctcagcctcccgagtagctgggattacagtcatgtgccaccacacttggctaattttgtatatttagtagagacggggtttcagacggggttggccaggctgttctgtaacattctaccacaaaagaagtgaaaatggcctgttcctgccttaactgatgacattgtcttgtgaaattccttctcctggctcatcctggctcaaaagctcccccactgagtaccttgtgacccccactcctgcccgccagagaacccccctttttcctttacctacccaaatcctataaaacagccccaccccatctcccttcactgactctcttttcggactcagcccgcctgcacccaggtgaaataaacagccatgttgctcacacaaagcctgtttggtggtctcttcacaccgacgcgcatgaaatttggtgccatgactcagatgggggacctcccttgggagatcaatcccctgtcctcccactctttgctccgtgagaaagatccacctatgacctcaggttctcagaccaagcagcccaagaaacatctcaccaatttcaaatccagtaagcggcctctttttactctcttctccaacctccctaaccctcagcctctttctcctttcaatcttggcgccacacttcaatctctcccttcttttaatttcagttcctttcattttctggtagagacaaaggagacacgttttatccgtagacccaaaactccggtgccggtcacggactgggaatgcagccttcccttagtgtttaatcattgcaaggacacctctctgattattcccccacgtttcagaggtgtcagaccacacagggacgcctgccttggtccttcacccttagcggcaagtcccgcttttctgggggaggggcaagtaccccaaccccttctctccgtgtctctaccccttctccacctttctggggtgcaagaaacccccaaccccttatccttcacccttagcggcaagtccggcttttctggaggagaggcaagtaccccaacctcatatctctgcaccccaatcccttatttctgcaccctgacctcatatctctgtgccccaatcccttatttctgcaccccaacctcatatctctgctccccgatcccttatttccatgccccaacctcttatatctctgcaccccatcccttatttccatgccccaacctcctatctctgtgcctgaccccttctctgcttttctggagggcaagaaccccctaccccttctccgtgtctctactcttttctctgggcttgcctccttcactataggcaagcttccaccttccattcctccttcttcttccttagcctgtgttcttaagaacttaaaacctcttcaactctcacctgacctaaaatctaagtgtcttattttcttctgcaatgccgcttgaccccaatacaaactccacagtagttccaaatagccagaaaacagcactttcaatttttccatcctacaagatctaaataatgcttgtcgtaaaataggcaaatggtctgagatgcctgatgtccaggcattcttttacacatccgtccctctctagtctctgttcccaatgcaactcatcacaaatcttccttctttccctcccacctgtcccctcagtcccaaccccaagcgtcgccgagtctttctaatcttccttttctacagacccatctgacctctctcctcctcgccaggccgagctaggtcgcaattcttcctcagcctctgctcctccaccctataatccttttatcacctcccctcctcacacccggtccggcttacagtttcgttccatgactagccctccccctcctgcccagcaatttactcttgaaaaggtggctggagctaaattaaagttaatgctcctttttctttatcccaaatcagatagcgtttaggctctttttcatcaaatataaaaaacccagcccagttcatggctcgttcggcagcaaccctgagacactttacagccctagaccctaaaaggtcaaaaggccgtcttattctcaaaatacattttattacccaatctgctcccgacattaaataaaactccaaaaattaaattccggccctcaaaccccacaacaggatttaattaacctcgccttcaaggtgtacaataatagaaaaaagttgcaattccttgccttcactgtgagacaaaccccagccacatctccagcacacaagaacttccaaaggcctaaacctcagcgtccaggcgttcctccagaacctcctccccgaggagcttgctacaagtgccagaaatctgaccaccaggccaaggaatgcctgcagcccaggattcctcctaagccgtgtcccatctgtgcgggaccccactggaaatcagactgttcaactcacctggcagccactcccagagcccctggaactctggccgaaggctctctgactgactccttctcagcttagcggctgaagactgacgctgcccgatagcttcggaagtcccgtagaccatcacagatgccgagctttaggtaactctcacagtggagggtaagcccgtccccttcttaatcaatacggaggctacccactccacattaccttcttttcaagggcctgtttcccttgcctccataactgttgtgggtattgatggccaggcttctaaacctcttaaaactccccaactctagtgccaacttagacaatactcttttaagcactcctttttagttatccccacctgcccagttcccttattagactgagacactttaactaaattatctgcttccctgactattcctgggctacagccacacctaattaccaccttttccctcagttcaaagcctccttcacatcctccccttgtatctccccaccttaacccacaagtataagatacctctactccctccttggcgaccaatcacacaccccttaccatctcattaaaacctaatcacccttactccgctcaatgccaagatcccatcccacagcacgctttaaaaggattaaagcctgttgtcactcgcctgctacagcatggccttttaaagcctataaactctccttacaattcccccatcttacctgtcctagaacaagacaagccttacaagttagttcaggatctatgccttatcaaccaaattgttttgcctatccaccccgtggtgccaaacccatatactctcctatcctcaatacgtccctccacaacccattattctgttctggatctcaaacatgctttctttactattcctttgcacccttcatcctagcctctcttcgctgtcacctggactgaccctgacacccatcaggctcagcaaattacctgggctgtactgccggaaggcttcacagacagcccccattacttcagtcaagcccaaatttcttcctcatctgttacctatctcagcataattctcataaaaacacacgtgctctccctgctgatcgtgtccgattaatctcccaaacctcaatcccttataaaacaacaactcctttccttcctaggcatggttagtgcagtccgaattcttacacaagagccaggaccgcaccctgtaacctttctatgcaaacaacttgaccttactgttttagcctagccctcatgtctccgtgcagtggctgctgccgccctaatacttttagaggccctcaaaatcacaaactatgctcaacttactctctacatttctcataacttccaaaatctattttcttcctcatacctgatgcatatactttctgctccccggctccttcagctgtactcactctttgttaagtcccacaattaccattgttcctggcccggacttcaatctggcctcccacattattcctgataccacacctgacccccatgactgtatctctctgatccacctgacactcaccccatttccccatatttccttctttcctgttcctcaccctgatcacgcttgatttattgatggcggttccaccaggcctaattgccacacaccagcaaaggcaggctatactatagtacaagccactagcccgcctcttagaacctctcatttcctttccatcgtggaaatctatcctcaaggaaataacttctcagtgttccatctgctattctactactcctcagggattattcaggtcccctcccttccctacacatcaagcttgaggatttacccccacccaggactggcaaattaactttactcaacatgccctgagtcagataactaaaatacctcttagtctaggtagacactttcactagataggaagaggcctttcctacagggtctgagaaggccaccgcagtcatttcttcccttcagtcagacataattcctcagtttagccttcccacctctatacagtctgataacagacgagcctttattagtcaaatcagccaagcagtttttcaggctcttagtattcagtgaaacctttatatccattacagtcctcagtcttcaggaaaagtagaacagactaaaggtcttttaaaaacacacctcaccaagctcagccaccaacttaaaaaggactgaacaatacttttaccactttcgcttctcagaattcaggcctgtcctcagaatgctacaaggtacagcccatttgagctcccatatagatgctcctttttattaggccccagtctcattccagacagcagaccaacttagactgtgccccaaaaaacttgtcatccctactatcttctgtctagtcatactcctattcaccattctcaactaatcatacatgccctgctcttgtttacactgccagtttacactgtttctccaagccatcacagctgatatctcctggtgctatccccaaactgccactcttaactcttgaagtaaataaataatctttgctggcaggactatgctgaatctccttaggcactctttaatcagatgtcctaggtcctcccaattcttagaccttttatacctgtttttctccttttcttattccgtttagtttttcaattcatacaaaactatatccaggccatcaccaataattctaaatgacaaatgtttcttctaacagccccacaatatcaccccttaccacaaaatcttccttcagcttaatctctcccactctaggttcccacgccaccccaatcccactcgaagcagccctgagaaacatcgcccattatctctccataccacccccaaaaattttcgctgtcccaacactttaccactatttcgttttatttttcttattaatataagaagacaggaatgtcaggcctctgagcccaagctaagccatcatatccccgtgacctgcacgtacacatccagatggccagttcctgccttaactgatgacattccaccacaaaagacgtgaaaatggcctgttcctgccttaactgatgacattgtcttgtgaaattccttctcctggctcatcctggctcaaaagctcccccactgagtaccttgtgacccccactcgtgcccgccagagaacaaccccccttcttcctttacctacccaaatcctgtaaaaccccatctcccttcgctgactctcttttcagactcagcccgcctgcacccaggtgaaataaacacccatgttgctcacacaaagcctgtttagtagtctcttcacatggacatgcatgaaactgacctcaagtaatccacctgcctcagcctcccaaagtgctgggattacaggcatgagccaccacgtgtggcctgtttgttttttgagacagttctgtcacccaggctggagtgcagtggtttgatcactgcagccttgaactcctgggctcaagtgatcctcccacctcagcctccagagtatgggactacaggcatgcagtaccatacctggctaatttttttgattttttttttctttttttgtagagatggggcctcactatgttacccaggctagtctcaaacacctggcctcatgcaatctgcttcccaaaagcacacccaaaaggtgtgagctaccatatcccacctacttaactcttttgtatctcagtttcttcatatgtaaaatgggcataactgtcgtgcctactacacagctgagttaataattggcatggactcagtaaaataagaactattattgttaggcctctttggagccatggccacaacagcatgcctatctttactctaaaaattttgcccaactaggctcagaattctctctcaaccatctccaattttacagtaaaatgaacattctgtctccaaggttcccattgcttctatgagaccaaccagtgcctctttgtcagccaaatgcaaggatagaacaatgtttatcaccgtggcttcctttgacttaagagatggtattagcagcaagtgtgaaatgacctatgtttatcaggagtcttccatggaagtcatggtagtcagatctcctatcacgattacctcctgccttggtgcagggcgtgatctctgtactaagaacgtctttctccatctcatctctggccaggccagttatagcaacacagcactatcacttcaatccttctattattttgtcttcactcaaaccacagataagaggatcttcctacaggtataggggagaagaaaatttatttttcctctaccctcctaggttttttggctggggccctgcaaattagactgacgaaagatagattaacaaaagaaaaacagacagaagtttattattaacacatgcatacacacaggatcgctcaatgatgagtgactcaaaggagtggtcagaaattgggcttatagagcaccttttaaaaaaatataaatttgtaaaaaagtgacaagacaggccgggtgcagtgagtggctcacgcatataatctcagcactttgggaggccgaggcaggcggatcacttgaagtcaggagtttgagaccagcctggccagcatggagaaaccctgtctctactaaaaacacaaaaattagctgggcatgatggcgtgcacctgtaatctaagtgactctggagactgaggcaggagaatcgcttgaaccggggaggcggaggttgcagtgagcagagattgcaccactgcactccaggctgggcgacagagtgagactccatctcaaaaaaaaaaaaaaagaagaagaagtgacaagacaaagggaaagagctttaggcttctggaggtggcaaactgtgggaaggtaagtagatgggaaaagtaatggaagataaagattgccttagtgaggttggttatgtaggttcctccagcgccatctctgggctgcttaagagtccagagttgtctccagcgactgagaatcttcctgtcctccctggtagggagacatggggagcagagagtttctctttgtttctatttttttttttttttgaggcgaagtctcgctctgttgcccaggctggagtgcagtggcacaatcttggctcactgcaacctctgccacccaggttcaagcgttctcctgcctcagcctcctgagtagctgagattacaggcacccaccaccatgcccagctaatttttgtatttttagtagagatggggtttcgccatgatgaccaggctggtcttgaactcctgacctcagatgatccacccacctcggcctcccaaagtgttggaattacaggcgtgagccaccgcacctggccgagagtttttcttgtgtctgcttcatcttcattgccttcagctcaaaatgatcttaaggttaaagtgttgtactttggggagtggcatgttgaccccttcacagatgttcttcataatgaatagtgcttctcctctgctccgtttcccaaatctttcatttcaaccagtcacagccttttattgctccattccaactctgatcctatttcattgagtttcatcattgatatcaaaacaaggataaatgtcaaaccccagagtaatctggtgtccactctaaaatctgctcatctggcctttcaagtcttctttggttactcagtgatgggcaaaaaccccaacgttttcctgaggatgggctttttatctatattattcaaactcttaggcatttttatctaagatatatttccagtgatgatataaatcaattccagaatcatagattaaagtgaattcaaagcatatataacaatttcaaaaatattcatacccaataattccactctcaggcatcatttctcaggaaacaatagaaaatgtgagcaaagatgaaaagctctaccctgcagcattatttgtaacagtaagcacttgaagacaaacaaaacattattattattattttttttttttttttttgagacagagtctcgctctgtcgcccaggctggagtggcgcaatctcggctcactgcaagctccgcctcccgggttcacgccattctcctgcctcagcctcctgagtagctgggactacaggcgcccaccaccatgtctagctaattttttgtatttttagtagagacggggtttcgctgtgttagccaggatggtctcgatctcctgacctcgtgatctacctgccttggcctcccaaagtgctgggattacaagcatgagccaccgcacctggtgacaaacaaaacatttaaaaatagttggctggctgattatttgatttgatttgatttttattttgatttttttggagactgagtctcgctctgtcacccaggctggagtgcagtggtgtgatcccagctcactgcaacctctgcctcctgggttcaagtgattctcctctggatgaatatttttagtgctatcattcactggaatgatgtcgccactaaaaaattttatttacaaaataagtttattagaagttatgatggctggacgtggtggctcacacctgtaatcccagcacttttgggaggctgaggcagacaaatatcttgagctcaggagttggagaccagtctggccaacatagtgaaaccccgtctttattaaaaatacaaaaatgagccaggcgtggtggcacatgcctgtaattgcaactactctggagactgaggtgggagaatagcttgaacccgggaggcagaggttgcagtgagccgagatcgtgccactgcactccagcctggggaacagagtgagactctgtctgaagaaaaaaaaagaatcatcctgactttccttatagagagggggagggcagagagtttgtcctgtgtctcctttttctcaaagaaaagaagggacgtccaccaaatttttagcagcatttcccactgaatgactgcattatggcaatccttattatgaccctgttttacgagttttctacaacagcatgtctatgtttacaatcgggagaaaagtggtttttgcttttgctgtttaatatctaacatgtgttgtgacctgtccctggccaacttgttaggcgtggagataacatagttgaatgagaggtggacagttgctctcctcagcttccgtgtggggtttgccccttccctgtgttaatagttgctttaccaaaacctttcaggactttttttttttgagacagggtctggctctgtcacccaggctgagtgcagtggtgccatcatggctcattgcagcctcaagcccccggccccctgccaggctcaagcaatcctcccgcctcagtctcctgagtagctgagactacaggtgtgctccaccacgcccagctaactttttatttttttgtagtgatggggttatcaccatgttgcccaggctggtttcaaactccaggacacagtctgtcctcctgcctcagcctcccaaagcgctgggattgcaggtatgagccactgtgcatgaccaagactcttcaggatcctaaatggtttcagcaacaaacattgtttagttatgtaactcagaactccagtatggacatactatgtgatgtgattttattattgcttatatgcttttgtggttttattgtttgtttttctgtttgtttgttttgagacagggtttttgtttttgttttgagacagggtcttactctgtcacccaggctaaactacaatagcatgatcctagcttgctgcccccttgaactcctaggctcaagcaatctttctgtctcagactaccaagtagctaggactacaggcatgtgccaccatgctatgttgtctggctggtgttgaatacctggtctccagtgatcctcccacctcagccccctgagtagctagcactacatgcgtgagtcatgcctggctaattaaaaaaaaaaaaattaagagatggggtcttactatcacagcgtgaatcccaaaattggggttcagtctgggaggccacatgggttcttggcttcccacaagaaggaattcaagagtgagccaacaaagtaaaatgaaagcaaggttattaagcaagttaaggaataaaaggggggctactccataggcagagcagtggcatgggctgtttgattgagtatacgggtattccttgatcatatgctaaacaaaaagtgaattattcgtgagttttctgggaaaaaggtggggagttcccagaactgagggttttcccatttcagacaatatagggtaacttccagacattgccataacatttgtaaactgacatggggctggtaggagcgagtgtcttttagcacaacagtgcattatcattggcatataatgagctgtgaggacgaccggaggttgctttcatcgcatcttggttttgatagatttgggctgctgctttactacatgtcattttatcagtggtgtctttgtgacctgtaccttgcaaaccagtcctgaagaactcttgtctcatcactgtgttgtccaggctggtcttcaagtgatcctcctggcttcagagtgatcctctcacctcagcatcccaaaatgctgggcttgcaggcttgagacactgagccagaccctgtttattcttgaattgtttccagtgaatatatctcatcgtctccccccaaaaaaaggttgcaagtttttggccaggcgcggtggctcacgcctgtaatcccagcactttgggaggtggaggcgggcagatcgggaggtcaggagatcgaggccatcctggctaacacggtgaaaccccgtctctactaaaaatacaaaaaaaaaaaaaaattatccaggcttggtggcgggcgcctgtagtcccagctacttgggaggctgaggcaggagaatggcgtgaacccaggaggtggagcttgcagtgagccaagatcgcaccactgcactccagcctgggcgacagagcaagactccgtctcaaaaaaaaaaaaaaaaaggtggcaagtttttataaaaagagaaaaatcattcttagtatttctttaataccctctacattgacctcactggtgcaaaaaatattagtttgctggtgaaaattcacctcgagttactaaatatctaactttcccataactaccatctgtttgtctcttgtggatctgtttgcctaatatttaaatgacccattcttccccacttttacgaaaatagcattaattcccctttcactattcacacttccttcatcgtcacagtttgaccagcggtccagggtttatgatctcaagcatggccatatatatctatttcacttaagactctggaaagagcataaaatcagatgtaactgtttcctatttcatataatagggaattccatctctaaagttatgacatttggcctttcagtgggtttttgtggtttttactatggctgtgcttagattcctttttgaacacttttccagtggttccacttgaacacaatctttgagtcacataggagaggtgacatgatagagtgtaaagccagaaagagcacgatttggatctcagctcaactgatagggatccgtagcaagatacttcacctctctgagcctcagtttcctcatctgtgcaatgggaatcgtaacgcctgcctctcaatgttgttaagattaaatatgttggccgggcgcagtggcttacgcctgtaatcccagcactttgggaggccgaggagggcagaccacctgaggccaggagttcgagaccaacatggtgaaacccctgtctctactaaaaatacaaaaattagccaggcgtgctggtgcaagcctgtaatcccagaaactcaggaggctgagatatgagaatcgcttgaacccaggaggcggaggttgcagtgcgccaagatcgcaccactgcactccagcctgggcaacagagtgaaactctgtctcaaaaaaaaaaaaaagattaaatatgtgtacagtacctgtaccatgttaggcggtcagtaaacatttgtttaactaacaactgataaggatagtaaagaagtatcagaacacccacctagttatcccaaagggcaggaagagtgctaggtaatggatatagaattccttttagagtcaaattacacgggcaaagatcagcccctccttcaattaaaaagccaggggcagggcgtaataaggaagtggttctccttctttaagcctcttttcaggctgagtcctaaacctgaagaaagtttagagcctggggctctaaactacctgagtctttccaaacgacaagccaagaagacctgttgaaagtttcctcttaagtttcgtggagagagactcaggtatagaaatatccttactgccacctgacctgaagcagaagaaatcacagacagcttccagaccaggtaacaccaggaggcaccagtcttcatcctcagcctttgcaggaggacacagcctggtctttagctgtttgccaaatgaggcagtctaattcagggagctctttactgggtttattacaaagttcttatcatgtaagtctcaggacacaaaatgacattgagaatctagtttagcggggtttccaggaaagacgaagaaaggttatttaggtttctctttcatttctcttttgctacaaagggtttgggacattcagttaagaacacattactggttgaggtatgtgacgttactcagtcttctctgcttatgtatctggggaggtatgcaatgacatgacagccattccgtggccagggacaccactgcccaagctggagaccacgaggattcagggactgaagccagcatgggaattcctggtttgagatcagagtcctgagtacctcgtgggaacttgggcactcatccgcaggaggtctagacccccagagaattccttgagtctaaggcacaggtaaatggaagacccttctctctcctctctcccctctagaaagctccctcctccctgagctccctgtccccttctttccacaatcagagcctcggaccttctgtttggtgaatatgacctgaggctctgtctagcattcagcttctattgtgggaagttaaggcactttctctcattcctcatttcacctttagtattaaagaacagtccaggcagaaggcacgaagagcctgagaggtctgaagtgagggggagaggagaggggcagaaggggaggctccggacaacagaaccaagctgagcttaggatgtgctgtgggaggctccgtggggatgagtgtcagtgcccacgagatccactcaggcctcaactgtgtgtcctgagcacatgaagtcagctcttctgctgggacagccaccaagggattctccacacccctcaccgctgggacaggcagaggcacagcgaaccaggtgtccagcgtaactggggcactgggtggtggccgcctctgtgtgtggaaacacgaggtgcttgctgcagtttcctctgtgtgcttatccgttagctgccacccaccgggagggaagtgaaatctcacctcaacaagtgagtccgcagagcgagaaccgtgcgacagtgcgtctgccaatacctggaatgtaggtgttcgttgcagtgtggccttcccagccggcctctcagcacacccggccaggcagccagtgttcccagaggacacgctggggccagacgtggaggaccccggccacctcggggagggaaagagaccaagaaaagaacctctgtagccttgcttctgagagtgcaggtttgttacaggtaaggatcaggaaggtaaacatagggcagtgaagcagggttgtgtcctctgcggccctgaattagaataagcctcacaggtctcacccaggaacggaaatctcccctccaggttctgaaccagcattcagaggccccacccagggcttctgtcaacataagcataaaacttatggtttacctttccataaaccccaaagttgggcttcttgtatagagtacaatttctgtaggaagagctgaaagcagaagggatctaacctgtgataatactcgatcgctgctgcttgaaagtaagacttagctatacactgaacaatcaagtaatttataacaaggattagaggaaacaaaaactctgtgtttgtgtgggtgggtttttttttttctttatttttgtttcttaagagagtgtctccctctgccacccaggctggagtgcactggcgcgatcatagctcactgcagcctccaactcccaggctcaagcgattctcccccctcagcctcccaagtggctgggactgcaggtgcacaccaccacgcccagctaatttttttcattttttgtagagacggagccaaggctggtcttgaactcctgggcttaagcgatcctgctccctgggcctcccaaagtgctgggattacaggcgtgagccactgggtccggcatctacatttgttaaatacattaaaaccctcttaatcctttgtctccgtttgttctcttttgctccctgctctccaggctcttgtggcggaggcccccgctccctccgctgtagggtagcctccttctggggctggctcctgagcactgttctttctcctctctctcatcctctctcattcttagctttgcctgtcgactgggccaagtcacagcctttctggcctgtaagacaacaaaaatctcacattttactaaatggaaggactaagtactctgtcttgacttcagtggtttccccgatttctgatgttgctgctgaaatagcattagcaagcttgtttcttaaagaagccctctctccagtgacaatactccccccgccacacacacacacatgcacacgcacacacaaacatgcatgcacgcgcacacacacacacaattttaaagccctcgtgttatattaaaaaggtctggatgtttttaacatacatggaaatttcttcagcagcacagtgttactggtctgacgagggcgcacagcctcctacccaaggacacagttcctgaaggaccagggtgcacatctggcctgcagtgccctgagccactctgtccaaaaggaagccttgaatcaaaagcctcatgaatcctctcctgagaaattccatgtctggtctcttgctagactcagccttttccccaccaagtctgccgcacctaattctgacctcaccctgcttggtggcccgctttgcctgcttgcacgcacctcaggtctcagtgtgtctcagcaacagcttcccctcctagggtggccagagttagcaagcaagaatgcaagacagccagttatgtttgaatttcagataaataacaaatataagtgtcttttagcatataatattttatttgggacatatactaatatttattatatattagtctcatgatatttgggacatatactaaaaaattatttgccctttatctgaacttcaaatgtgaccaaatgtgtcctgtattctgaatgtgtctggcagtcctataatcattcattcagtcagtcatcagatatttgagcacctaccatgtatcaagcactattctagagagcccggatagctcagtcagtagagcatcaagcgctactctaggtgctggggaagccagccaaagtcccgccttcatatcttacagtatgtctactttgtttttatatacatgtacactatatatacttgaagatatgtacctttttctttttttctttttattatttttttttgagacagagtctgactctattactcagtgcagtggcaccatctcagctcactgcaacttctacctcctgggttcaagtgattctccagcctcagcctcccaagtagctaggattacaggcatgtgccaccatacctggctaatttttgtatttttagtagagacaaagtttcaccatgttggccaggcttgtcttgaactcctgacctcaagtgatctgcccacctcggcctcccaaagtgctaggattacaggcgtgagccaccgcgcccagcccagatatgtactttttaatggcaatgttaccacatttaatgagattatctttttaaaaaatgttttaatttttaaattttaaaaaatagggatgggatcttactttgttgcctagactggtctccaaatccaggtctcaagtgatcctcccaccttggcctcctaaggtggtgggattacaggtgtgagccacggtgccagccaagatgatcaatacttccttaatatcatctaaaacatacactgtactgtgtttagttctctatcatctcaaagatatctacatctttatacagtatgtttgaattacgatttaataaagatccactcatgacatctaattgatgtctctttttttttaatatgtttcttttttttctttttatttatttatttatttttgagacagagtctccgtgtgtcacccaggctggagtgcaatggcgcgatccccgctcactgcaacctttgcctcccaggttcaagtgattctcctgttgcagtctcccaactcactggaattacaggcacctgccatcatgcccagctaatttttgtattttttttagagacagggtttcaccacgttggccaggctgctcttgaactcctgcctcccaaagtgctgggattacaggcgtgaacgattgtgccctgcctgatatgtttctattctttctttctttctttctttcttttttttttgagacggagtttcgctgttgttgcccaggctggatgcaatggcgtgatctcggctcactgcaacctccgcctcctgggttcaagtgattctcctgcctcagcctcccgagtagctgggattgcaggcatgtgccaccatgcctggctaattttgtatttttagtagagacggggtttctccatgttggtcaggctggtctcaaactcccgacctctggtgaactacccgccttggcctcccaaagtgctaggattacaggcgtgagccatcgtcccctgccggatatgtttcttatgtctcttttaagctgtagcagttctctgtcttcacctttttttggcgccatttatttgttgaagaaaccggccatttgtcttgcagaacttaccagatactgaatttggatagctgccttcttgtggtcattagtttatttctctgtcccctgtatttcctgtaaactgatcattagatccagaggcttgatcagattcggatccaatgtttttggatcaggagacacataatggttgtctcacctttagtgagaccaagattggtcattgggaacagggaagtggagctggggtgagtatagggtcaccagatgtccagtacaagcagaatggacagggctgtgctgcaggatggatgaggggagggtgggatgcccggaaaatgcatgggggagggtgggatgcccggaaaatgcatgggggagggtgggatgcccggaaaatgcatgggggagggtgggatgcccggaaaatgcatgggggagggtgggattggatggaattggggagcgggaaggggtaagtggaaaagcagtaaggaacatgaccttcgaggagacactgacgtgactccttacagagcaaacgatttgcatgtaagtgaaatgcatgtaagtgaatgtgaaattggagcagtggcgggaagaaagattgtccaagccctggaataagacaggaatgtgaagaaacagcagaggaggaggaaggattgcagtcatgacccccacttcatgccatactcctcaagcatttgcttacatccagttatgtgagggaggtttgcggggcttggaagttgtataattgtatctgtgtagttggtctggtgggttttgcaacttgccctttgctgcactgggagggccatttttgtcccctccagcatcacctgatgttgcagcatagcccgctgcatccctcccaggctcacttccatcagaacgcacctagccagggacccttgctttcctggggcctggccaaggagcagttcctcagatcaacagcttcgctatcagccaatgtgagcctcttctaagtaaaggagaggagacagtgatggaaaaaggcagcatccagcaggccctcaggggagatatttcagctcctacacctccttccaatagcagaaccagggggaaaagttagagaatatccttattctatctaacaacttggacaccgaggaacaaaaaggtggcgtgacttgcccaaggatgttgcaggttagaagctgagccagccgtggctatccatccttcagacacccaggccaacttgtctgtaccacctcacattgcctcaaaccctgtctgcagttactgtcccatttctttatcatttggtcctggtatgacaaggtacagtggaaagaaaaagaggaacatgccagccagtccccttaatattactgcagcttctttatcatcacagcagcttacatgccgaaagaccgtcttaaattaggaccagaaagggaagggaacattattaagagccatattaagacagagcctgaggccgggcatggtagctcatggctgtaatctcagcactttgggaggctgaggcaggtggatcacttgagcccaggagtttcgcaccagactgggcaacatagcgagaccttgtctctaaaagacaaaacaaaaaaattagccaggtgtggtggcatgtgcctgtgttcccagctacttgaggggctgaggtgagagaatcccttgagccggggaggttgaggctgtggtgagctatgatctgcactccagcctgggcaacagagcaaaactgagtctcaaaaaaaaaaaaaaaaagagagcctggggcctaggacaacagctgaactagaaaaaaaacatagctaccacttttgaaccaggttctgtgcaggaacttctcttgtgtatcttacacccttacaatatccctgcaagatgactattattatttacaatttgcctgcaggaagttcatgtttggagagatggagtaacctgccacaggtcacaaaactagtcactggcatggccacaatctgaatttgggactgttagactgagaagcccaagctaattcttgatacgctcactgcctgggacatttcacacggtagatctgagctttctcgcatctgagactaaaaggaaaatgtagtccttaacagacagcagaaggaaacagattattagcaaaaagaactgctttcctagcaggaaaccagagaaggagttatttcatgtaagctcaagcaaaggaaattgaacaaaatcagttctttatctatcctgttattcgtatggaaataaagaagaaatgcttgcatcctgttgttttagtgcttgtactgatctttttcaaacatgcctgtgatcacatcactctctactcaaaactttgaacagctctccattgcctccatcagtgtgtttcaaattcgtaaaaagtaaaataaaataacaggatgcttttttcagatgaaatcttacatggcataccaaatatagcaagaaaaaagaaagagagagagagaggagagagaagccgggacaagctaaagcagagggtagagggagaaggaaccgaggaagggaagggtcaggtcccaggcatttctcttccctgaattggcctccctcttttgccacctccccagcaagacctttaactccacagtccacagctcattttgaaatgtactgatcaacgtgagaaaatgcgaagcttcagcctgatagtcaaagaccaccataatctggacccaagtgctagttcacttattttccctccactattttcaagccctggctatttgcaaactgcatacgtatgctgtcccagttctctcaccactcttcaaacacattctgaattcacctataatctcccctctgcccgccctgttgtagccccaatatccacccacctgtctaactccttctagctttccaaaagctttcacttgcctctttctttgaagctcacctatccctgccttctaacctggctatctgcatctctgttagacctcttacttagttcattagttcattctctctctgttgttttttgttttttgagacggagtctcactctgtcgccaggctggagtgcagtggcgcaatctcagctcactacaacccccgactcctgggttcaagcgattcttctgccgcagcctcccaagtagccgggtctacaggcgtgcgccaccatgcctggctaatttttgtatctttagtagagacgggctttcactgtataggccaggctggtcttgaactcctgacctcatgatctgcccgccttggcctcccaaagttttgggattacaggcgtgagccaccgcacccggcagttcattttctttatgtggagttatctatggccatgtctctcttcccaccctagtaagactgtggcttttccctctctaccctccagcacaaacacaatagatgttcaataaatgtttcctgagttttcacccctgtctctcctaacctgcaaagggtaagtggccctgcatagaagggcacagtgtggactttgttgttacaggcccaacatgtgtagcaccagtgggtgtgacctggaagaaatccccctagatgatgatgacctaaacaccatagaattcaaaatcctcgcctactacaccagacatcatgtcttcaagagcacccctgctctcttctcaccaaagctgctgagaacaagaagtttgtcccagaggggcctggggaattgttcagcaaatgagtcatggacagaggtgtcatggccttgcagaaattcccaatccagtgagaaggccataaaccttggcaagaaaaagtcttcttggaaagcattctttggagtagtggagaaggaagattcgcagagcacgcctgccaaggtctctgctcagggtcaaaggacgttggaataccaagattcgcacagccagcagtggtccaggtgtctttctaacgtggagcagtgcttggagcatgaaggtaggcatctgggatttctttctctcccgcttcctggtttttcccttctttgtgtccagagtggtacatctcttctcatgttgtaaagtggctttagagaaggcatgcgttgtgcctcagctttccaacttattagtgttcaatcataattgccctgcttttctcaagactaaaaggagttgctgcctgggcgcggtggctcacgcctgtaatcccagcactctgggaggccaaggcgggtggatcatgaggtcaggagattgagaccatcctggctaacacggtaaaaccccgtctccactaaaaaatacaaaaaattagccgggcgtgttggcgggtgcctgtagtcccagctactcgggaggctgaggcaggagaatggcgtgaacccagcaggcggagcttgcagtgagccaagatggcatcactgcactccagcttgggtgacagagtgagactccgtcaaaaaaaaaaaaatgactaaaaggaaatgatggaagttaagggtgctgggactggttttctttctccactgtctataaataagcttgtttcccaaattcctagtcctctgtaccagacaccaatataaaagaaggaggctaggcgcagtggctcatgcctgtaattccagcactttggaaggttgaggtgggcagatcataaggtcaggagttcaagactagcctggccaacatagtgaaaacccgtctctactaaagatacaaaaaattagccgggcatggtggcgcatgcttgtattcccagctactcgggaggctggggcaagagaatcgcttgaacctgggaggcggaggttgcagtgagccgagattgcatcactgcactccagcctgagctacagggtaagactttgtctcaaaaaaaaaaaaaaaaaagaacgagccctaaccaggggcttgcttgggctgcctgggccgctgctcttcctaagtcaactcattcgctcagggcctctgtgtttccatctgtacattgggtaccccactctctccacctcgtatggttgatgggaagatcagagagcaagagtaaaaggactcttgacaaagtacaaaccatcctacaaaaacaactgagaagcatttagacaaaatcttccctcagttggacaaaattaattgtacttaatgaaacattttcaccaggcactgaggctcatacctgtaatcccagcactttgggaggccaaggtgggtggatcggttgagctcaggagttcaagaccagccttagcaacatggcaaaaccctgtctctaccaaaaaatacaaaaaaattagtcagacatggtggtgcacgcctgtggtcctggctactcgggaggctgaggtgggaggatggcttgagcctgggaagtagaggttgcagtgagccaagatgatgccactgcactccagcctgggtgacagagtgagagcccatcacgtcgatactctcagcactgtgggaaaccaaggcaggaggatcacttgacaccaagagtttgagatcagcctggcatcatagcaagaccctgtctccattaaaaaattaaaataaaaaaattagcgaggcatggtggcacatgcctgttgtcccagctactatggaggctgaggtggaaggatcacttgagctcaggaggtcaaggctgcagtgagcgaagatcacatcactgcaccccagctctgggtgacataatgagactctgtctccaaaaaaaaaaaaaaaaagacagttgcccttcatgcgcacaccttggcataagcatcttcttccccttcaacaaagcccagtgcccaaagcccagattttttttttttttttaaggtgttttagatggagtcttgctctgtcgcccaggctggagtgctgtggtgtaatctcggctcactgcaagctccgcctcccaggttcaagcaattctcctgcctcagcctcctgagtagctgggatcacaggcgcgcaccaccaggcctggctaatttttgtatttttagtagagacagcgtttcaccatgttggtcaggctggcctcgaactcctgacctcgtgatctgcccaccttgggctcccgaagtgctgggattacaagtgtgagccactgcacccagccgcaaagccagattttaaaagaaaggccccctcctgctgagtttcattggcctgggtaacttgtcaataattagtcaagaggtggcagtaatgtctcagtttttaaatgtgacagtcctggcttgcttggagaatcagcccactcatagacagctttagatcactcactatgatcaaggaaactcccttttcccattagagtttcagatgtttagaacagtgggagttatggtcaggatcatctgagggaacctcatggcacagacaggatgaggaaatgggagtcccacaaaaagggcttaccaaggaaacatccaggaagtagcagagcctggactcaccagaagtccaggcctctccctagacttgtttcatttttacagcaaggcatctgctctctgaactctgcccagctagggcaggtctagggcaagagggagcggccccctgtggtccttccctccacatctgcctccccacccctcagctgccctcacccagccatggcttcttctgccgggggtggcatctgggctctggggcaaagaacagtttggaggcacctaaataggcttttctacttggcctgtactgtggactttgccagcagacagagaaagcttttacagaccttagtcttctggtttttcctgagataaattgcattctgtatttcagtatttactggagtgtcatttgacattttttttattttctaaaatttcaagagaagcttttatttcttttttcagtagggaaagaaaacttttatgtgagattgagaattaaagattacattcaaaaacacttaggtgatgtgttaatgtgctgaatagctgaatagtacctatggctgaataatattctccataaaaaatgaaaaatgattacctcctaagaaggctttaaacacatatttacagcttatcttcccttatcacctttctcctcacgcttgcatttagtcagttaattgtgtgttttttacttgtgttacttgtgtcggttttacattgagcgtgatccaagagagcctcacattctatttctattttgccacatacaaatcaggccttgcaaatttggtttctcctgggttcttttttgtttgtttgtttgttgtttttgagacagagtcttgctctgtcacccaggctggagtgcagtggcctgatctcggctcactgcaacctctgcctcctgggttcacaccattctcctgcctcagcctcccgagtagctgggactacgggcgcccaccaccacgcccggctaattttttgtatttttagtagagacagggtttcatcgtgttagccaggatggtctcgatctcctggcctcgtgatctgtccgcctcagcctcccaaagtgctgggattacaggcgtgagccaccgtgcctggcctcacctgggttattttaactgtaagtcactatgtagccttgtacagccactgccaggcctcagtaccgggcttacatgggaactgtgagattatgtcccaagaccaaactctgttaggaagaggcctcaggatgcagagaaatggacaataacaccagttttaaagactaccaacccaggctctttcacttgtgaatcttttgtttctccatagctacgatttgctcacgtggaatgttatagttaaggtgaggttcagcgatatacagtggaacactcaaatacccatggcttaaataatatacaggtttgcttttctctcctttaaaagaggacaaaagtttggcagctcaggcatgatatgacagctccacaaagttattaagaatttctgggaatggccaggcagggtggctcatgcctataatcccagccctttgggagtctgaggtgggcagatcacttgagccaaagagtttgagaccagcctgagcaacatgacaaaaccccgtctctattaaaaaaaatacaaaaattagccaggcgccatggtgcgcgcctgcagtctcagctactcgagaggctgaaggaggagaatcacttgagcctgggaggcgcaggttgcactgagctgagatcacaccattgcactccagcttggatgacggggtgaaaaaaagaattcctgggaattctgccatccctcagctcgtggcttccacctcaaagtcaccttatattctaaaggtggctgttggggcttcacccatcatgtctacatctcaggcaagaataaaaaggaagcaaaggaagggcaaagggtgccttctttctaggtaattcagctcccttttattttattattattttttaatcttttgtaaagatggggtctgtgttacccaggctggtctcgaactcctggcctaaaatgatggcctcgccttggcctcccaaaatgctgggattacgggcgtgagccaccgcacccagccttagctcccttttcgagagctttcttgaaactgcccccagcttctgacatctcattggcccttccctactgcaagggagcccagggaatatagtttgttcagctgggttcattgctgcccctcacattttagaggtctgttactaaggaagaagaagaaagtggatactgagtgggaaagagcagtccataaggaagtcacaccccaaccccctgccctttctctttaaaacaaatgcctcagaccacaggcgaaatgggaccttccgaccctgttggcctgctcttcctggcgccacgatgacccccaaaacagactccaaggaacagacagcctttctgtcttctccccaccccatccagtgttccctcgcctatcagacaggaccaagtctgacaaggatataatcttttctttttcatgttttaaaattaaaatatccaagatgggaattttaactagagctagtgcatctgtgggaacatgtttgcttatagtttctcctggacatgtctcactccatgtccacaaacccacagaaatcaataccctgctgtaaccccagcactttgggaggctgaggcaggaggatcacctgaggtcaagagttcaagaccagcctggccaacatggcaaaaccctgtctctactgaaaatatacaaaaattagctggacgtagtggcgggagccactacgtcctgtaatcccagctacacaggaggctgaggcagagagaatggcttgaacccagaaggtggaggttgcagcgagccgagatcgtgccattgcactccagcctgggcaacagagcgagactccgtctcaaaaaaaaaaaaaaaaaaaaagtcaataccctgtacacagttagccagattgagtaattttgtacctgttggtgatcttgtggccaccctgccttatgagaggaggaggggacagagcctttgggacccttcatggagcttcttaatgtgcaagatgggcacagggtgctttctggtggtagaaccgcatgctgattaccctagatgagctgcacaaggttgaaaaggcagcagaggcctgctttcctttctcatctcctgaggacatggccagggaagtttcccttggctttggaagatagcctcttgccatttctttctttgccaggggccatgggtggccagagttccagcggaggccggctgggctgcaataaggggattacaaagtggaaagtctgtttcgcttggttcttaaaaaacgaggaggaaagacattgatccttttcttcttgatctttcttctctccgtcattcgcttcttattggtttttgaaccctgtggactaaccatggaaaagatggctttatgagtcagatgtccaccagaggatggcatcatggacagagcagtatcttctgtggcctttccgtgaatggctggagggctgaagggaggacactgaagccttcagcttggaggaatccagggagagggatcaggagccaccttggcagctgcatatgatgtcaaaacctgtttctcttgtggctcagtccctcccaggccccctacttgcctctcttacctccagtgctgtacaaagcccagaagtgccctaggagtttgagcacaccaaccttctgtccaaaacgccactccattactgtcttcaagtcctgtgaattacctaatgttagtcttcaaatgttacatggtaaaacccagctgctccacacggcatccaagacagcttgtacaagcttttaaaagtttaggatttaggttgggtgtggtggtggctcatccttgtaatcctagcactttgggaggctgatgtgggaggattgcttgcgcttaggagttcaagaacaacctgggcaacatagggagaccttatctctagaaaaagaattttaataaattagccaggcgtggtgatgcacacctgtcatcccagctactcaggaggctgaggtgggacaatcgcttgagcctgagagatccaagctgcagtgagctgtgatcacaccactgcactccagcctgggtgacagagtgagactctgtctggaaaaaagtaaataaacaaataaaaggttagaacttagtgacaaatcaacagtgaaaattttaccacccagcaactcagccatgccatctgcccaccccacctcccctcttccccactcaggggcaaaggcgactggtctcttataggctacaacactcactgggccaatgccatttcaccgtcctatctcaaagtgctttattctacaattctgtatgcaaatacatgacgtaactcttttctcagcttgtaaattcttgaaggccgtaagttgtgctgactgcatccttgtttacctataagcattcattgaatgttttccagtagacatggagaggagagaagaggcagaactgtaccagcaacgggagttaggtgttcacttgataatggacttggatgatgaatctcattgccctgagagcagggatatttctttcttcagtgaccaaccccgaaatgcttgtcaaattatcgaatgtcctcctatgcatgtaggggctggctcttagaggtataaagcatgtcgagaaaaaagaataaaaataaaagcataatgagcattccttcaagtaaagagctaagcactcctttttgtgtctcttcccttgcaaaggggaaaggagaccctaattttgcaagacttcaaaaagagtgtgcagaaggccaattgtttcaaggtgacaatcattcctgcatgcacccctcccacatcccggcctctgccaggcaactttcagtcctttctgaagaatgaccctcccccagcacacatactcccaggcagtttccttctattctggcctggtcttttcattccaggcaactttgcataccaatgagccagatgaagttctgggaagggcctctcagcaccattttgtcttgtttcagctgtggaccccaaagtcatttccattgccaaccgagtagctgaaattgtttactcctggccaccaccacaagcgacccaggcaggaggcttcaagtccaaagagatttttgtaactgagggtctctccttccagctccaaggccacgtgcctgtagcttcaagttctaagaaaggtaagctttccttccctgggtggagtgtttgccaggcaggggcgcaggagcatttgtgtatttatccatcccagggctcggcaacttgacagtctccgctgcctggactgagggcttgacagccacaggctgtgggcaatgagctccagcttgagacaccagcccaaggcaagggggctgccccagcaggttgaaaaaacattcccagctctctgctaagtaagaaaggaaagtctcctacagagggagaggaggaaacacaaagcccgcattcagccttgtctgtggcggaaaatgcaatgttagatctgatcatgttaccagtgaccctgggccaatttgcatcaggtacagttggagcgtcaagccagggatttatattataacattgctttagggctttgtgaaaaagcaggggttgtcaggcaccagctatggtgcaagacatggagcagaactgagaagtagtgacaaggctgggtcagttgtcacccaaaccatagcaatagctgagactgtagatcccatcaggctggtggtaactcaaggcactgaggggagagtcaaggggagcaaagccaagtgccactggaagagaagctctgcccggcattcccccaccacagttcttgctcctggctccctccacaaactacagtggaggttgtgatgacgcagcctcattgtctgggataaatacgtgaggttcgttgtctcatgccaagggaatcgaggacatggacacacacaagaagtgagtttagcggcagaggtttaataggcaaaacaaagagaaaggagaacagctctctctcctgcgacagagaggggaacccaaatgtgacttctggcctgcgacagagtgcaccggattttatagacaggtttgaggaggtggtgtctgatttacataggatccaaagatcagttgaaccaggtgtgacgtttacatagcatgggggaagctggccaccccaccctcatcttattacgcaagtgggctttccacttgcccagcgccatgttgtctgctccctagggcacacgtggttggaaaggaaaagggaaaatgcggccgccatgttggacatgcctagtcccaggtggccttttcctattggcacagctgccaacattcactgtgcaagcttttagcttgcttgtctatgtctgcagctcaattttacaggctactctttgttagaaaagaaaatgatttggggctgcttttcattaaaaggaaaaccttcccgagaacttccttaccctcactatctgcctaaatcatttctttttaactcctctaacagtgaggccaaggtggatcttgggtttgcacctccctaaagaacaaggtgaaggttctccctccaaaggtatccgtgtctcccaaccccgatgcagagcggtagccacactaaaggggccacagctgccacagaggctcaggggaccgtgtgaagagctggaggagaggaggaggcctctgagtctgctaaaaaaaaacagtgtgacattttattactatcccacatgggcttgggagatggaatgccacccctaaaccaagctaaagctaagatgacctcatcctctgtgcacaggagaaatacaggcagctgtgccagcaactttccctaagagagtgttaacccaatatatcgagacagatcttactcagtgtagaacttttattttggccgggagcggtggctcgtgcctgtaatcccagcactttgggaggccaaggcaggtggatcgcctgaggtcaggcgttcaagaccagcctggccaacatggtgaaaccccttctctactaaaaatacaaaaaaattagccaggcatagtggcaggtgcctatgatcccaactactggggaggctgaggcaggagaatcgcttcaactggggaggctgaggttgcagtgagccaagattacgccattgcactccagcctgggtgacaagagtgaaactccatctcaataaaaaaaaaaaaaagtagaagaagaaggtttattttgccaagcctgggcacggtggcttacgtctgtaatcccagcacttcgagaggccgaggcggacggatctcttgaggccagaagttcaagaccagcctggccaacatagcaaaaccctatctctactaaaaatacaaaaaaattagccgggtgtggtggcacacacctgtagtcccagctactcgggaggctgaggcaggagaatcacttgaacctgggaggtggaggttgcagtgagccaagatcgtgccactgcactccagcctgggtgacagagcaagactcacatactccactgcaccctgtccccccaacacacaccatacaccaaccgtggccacgttcctatccatctgcccttttagccttggccataggggaatttattaattttacttatttatatcccaccttattgtcaagacccagcatacaaagaataaattttagtcagataaaatccatcaatctgaaagatatctttgtaaaaagaaaacaaaaacaggaaaataagacggatttgggaattaggttaatttccaaaatgtaggccagcaagactatccactctcttagatatgggccacaaatttggctctatactttctagcaactaacccaaagagtgaaatataatcaaatatgagatttatggtgtccataagataaaagcaccatctgctgaggaaaaatccaaaaaccagaagaatattccccctaaatatcttcatagacagaatcctgtgctgtgaaaccgatgtcttcaacaacaagcttaaggtaactacagcgatgaatttcacagtgagagctgggggactgagcaaaggaagaaggggaaagaaggaaaggaaggggctgtaggagaaatccctagtatggtttgtgtctgggcagaagaggcgaggtaagatttacttgataagaatgaacatgcttcttgccaggcacagtggctcatgcctgtaattccagcactttgggaggccgaagtgggtggaccacctgaggtcaggagtttgagaccagcctggctaacatggtgaaacctgggtttctagtaaaaatacaaaaaaattagccaggcgtggtggcacacgcctgtaatcccagctacttgggagactgaggcatgagaatctcttgaacctgggaggcagaggttgcagtgaggcaagatcgcaccattgcactacagcttgggcaacaagagcaaaactctgtctaaaaaataaaaaataaaaaaaaaaaaaagaattagcatgcctcttcctccagcccttaccaagccacaagcattcattgtccctggaaaaatgtaagattattttttgcttctcttaaaagaaataactggaattttccccgacagatgaagaagaacaaatactagccaaaattgttgagctgctgaaatattcaggagatcagttggaaagaaaggtatggaacaccttgaactgatgcgattgatttctgtgcccatgcactagtacacgagaatggaattgtattccaggttgcaaccttattccctttctaagtcctggtttctacttagtcctaaattttatttcccttggagtcaaaattcttcatgctggtagaatctcaaaaatgagtcactttggaaaacataagtaaaccttctggagcctccttggaatttttggaaactaaaaaagaaacttgttattgcaagaaaagacaccagtaaattaaaatttgctggatggaattattaatctcattccccatgtaactgatcctcattgaagtttagactcgcatttgctttgcagcctggatatctgtgtcccacagttgctccaaagctggaatactttctggaatctttttcccctgtagttgctggactgttgcctgtttaagggctctcttagcagttcagccagggaggtgcgctagtgttactgggagaatgtatggatttcctgccatttggaagttgagacccatctttccaatcaggaacgggtgagagttgccttcaggtaaacagttggtgagcaaaccttcaacagagtcaaaagggcttctctatgcctcctgggtccataacccacagacgactgagtagtctctagaatctgtcaatcaggggctggcttgcagacatagacccttgtttttccagaatctgtggggagggagtcagaccctgggggtggggatgggaggttctgcaggaagacaaacagctcctgtctatagctttgtcaaaagtgtgcccagaggctggtgacccagagggcgaagcacctgggagatgggacagaatgagaaacagcgagaaaaccagggatattaggttaaagaaaagagaacggggtgtgtgagctttgggaccacaagtagagggtggagaggggtgcagaggaagcaagagatggaacaggatcatgatttaagggcacccctgcatttctccagagctagtgtcatggatacacaaattatgcctagtatggggtgattgatttctccttatggtaagaatgaacctccattcctggagaataggcattccaggctgcccatgagagtcaacgggtgccttgtgagagaatgatcttcctgtcacgggaagaattgcaagtaggtgccaataccagttagcatttcagcacagaactccgaggggtcctttagacaacctcaagggctctttacaactcagagtttctgtggctctcacggcaacctccttcccagcttccctaagcagggacttgtggtcattggtcagggaggtgggaaaggcggagtgggggtgctggaggtgggacgaaggccaccgatctcaggttatgaagagcgatggtttcattttcacccccacaaattaccactttcaaaaacctcactttgcctggtgctctctcttaaggagtttggacattttacattgcttatggcaaagccttggttgttatttcctttacatgcttccccagtagggagctctgctagagacacatggtaggtgtgaccttgtgctgggcgggtgccaagctcccactgcagagtgccgtgtgtgtggctgcaggggatctgcagagccgctggtcccaagagcacacacagcccgaaggcccatcctacacctccaggagaggccaaagagccaggtgcacccgagagggacaggcaggggaggggtgaggaggtgccagtggaagccctgtctttgtggcgtttgattcttttactgttctggcacagtccccacttggctgcctgctagggttttgagcctggcctcctccattgggaaactgatgaagaggagtctgttccctgttatggaggaggctggccatgcctcctgcagagtcacaacccagacggggcctggacggtgggggtgggcgtggttcagggaaaagacaggtctgccaaaatctcccaatcgcatctgactcatcccccagatatcccttttagaaacaatatttgttgaaaacccgcttggcttatcattcctctaggacagaactagaggattttcaaataaatattttgtccctgctcactcagaaatttccgttttcacatgacaaccagcatattaacagacattgcaagaatgctttaaatgaagatgatatatagctttttgatatgagccctgatttttcaaaagcagaagaggcagcattgattttgttttaaaggcgtggtagttcaaaggaggtaaagcagagagataccaggttcaagggaaggccgggaggtaaaatcaatagggtagaataatgggaaagaaatcaatgaattggagtttttttaagtgaacattgcatgcaagggagtcttccctgacctccatgctcccgtagcatcctgaaaaatgactcgcatttccaaagcacctcttctatgtccagcactataaagtgttcaactaccctatagtatagggccaagcacagtggctcacacttgtaatcccagctcctggggaggccgaggtgggaggatcgcttgaggccaggagtttgagaccagcctgggcaatatagtaagccttgtccctaaaaaacaataataataaaagtttcttaagaaaatgaaggctgggtacgggcacagtggcccacacctgtaatcccagcactttgggaggccgaggcaggtggatcacctaaggttaggagttcaagaccagccttaccaacatgatgaaaccctgtctctactaaaaatacaaaaattagccgggtgtggtggtgtgtgccagtaatcccagctacttgggaggctgagacaggagagttgcttgaacctgggaggcggaggttgcagtgagctgagatcgcgcctctgcactccagtctgggcaagagagtgagactccatctcagaaaaaaaaaaaagaaagaaagaaaagaaaagaaaatgaagactgggtgcagggactcatgcctgtaatcccaacactttggggaggctgaggtgggtggatcgcttaagcccaggagtgggcaacatggcgaaactctatctctacaaaaaaatagaaaaaaattagccaggtgtggtggcatgcacctgtagtcccatctacttgggaggctgaggcaagagaatcacttgagcccaggaggcagaggttgcagtgagctgagaccacaccactgcactccagcctgggcaatgggagtgaaaccctgtcttaaaaaaaaaaaaaagaaagaaaacaattaccctatagtatcaatactatcaccatcctagtttagagatgacaaactgaatctgagaggttaatttccccaagattgcatagctaagtaagaggtggacccaggggtttgagccaagacagtgattcctaagcttcagatcctgtcccttacactacttctagcaaaggacatcacatttttctgcaattcccactagactgtgagccctttgagtgaggacccgcatctcagtcatccatactacctgcccattataagtgctcaggaaatatttgttaaatgtcaaatgaactgactgttccattttatacatgtatttgtgctgatgaaatgaattcaccgagcagtacatgcccattctggttctgcaggacactgccttcatccccattcccttggttgacaccagcatccagggttttccacaggatggtttgatggcctgcatttgagctaaagaatgaacttctgtctgcctcgtggagccaagctactgtactgagtgcttattcttttgtacacagctgaagaaagataaggctttgatgggccacttccaggatgggctgtcctactctgttttcaagaccatcacagaccaggtcctaatgggtgtggaccccaggggagaatcagaggtcaaagctcagggctttaaggctgcccttgtaatagacgtcacggccaagctcacagctattgacaaccacccgatgaacagggtcctgggctttggcaccaagtacctgaaagagaacttctcgccatggatccagcagcacggtggatgggtaagcgtatcctatttaaaaacaaattttctcagaactcagaagagatgggatggattttttttttttttttaaatgaagggaacacatctatgaagcagttctcatgagtttaggacacttgagtggccagagatagatcccattgatgggaacatatttttagtgattatcttcatcatcaataaatatttactgagctctccaagggtatgcagggtatgtgtggatggaaagggactggtcagatggaacaggaaatgaggagatgctgagataagaaatgtttagatagacgtaatttctgttttcacaaattttgcaggcaacggaagtctggcagggagacaagggcaggcagacagttcctcacacttgcagatacttagaggtcacggagactaagcctcatgcagagactcagggttcatggcattttgtcattgctgctttgacccagccattttgagggtgacattttgataccaaataaaaagccaacagttaaactttcatctattttcaattacctggtatcagtcaaaacagacctctttcccttttgcctcaaaccctctcccatccctcatccccagttcctcaggtctccttaagactgccatgttcaaacagctacataaggtccaccgtgtcaaaatgtactaccccacaactttaactctcaacaggcctaggcattcctaggcggacagaccttcatcccacattatccttagttctctttccactagaatggtccaggggccagcaggaggattgagtcggctctaggcatggctggagtgaccctgggacctccacacagccttggtctctttgctgatggaaggaaagtgcagctgatcttgcccaagggtctgaagtgcccgccatggtcttcagtggctgccacggtcttcagtttctgtacattgagttcctttctattttccacttttgcaccaagtttgataaccctaagtggctgatctgaacaaccaaggccattcttaagtattctaaacttaagctgccttagcttattctaaaaggaggacaggttcctcaacattattttagttctacctattcttctttccaggattccttcaccccaacaacccccttgagccctcatctgccccaaagcctctcctgacccttccagctcaaaggctgcacagtctctaatctccagcacttcatgtttgcaccataataatatacaaaagatgatcaaattcccaattgactatgtttcaagcattcattttaaaaatcattgttagtcctcttaatatattttctcagagaaattataattatcaattgggttcacaggctagctctcaaaaatctgtttaacccactaatgtagctaaaataccataaatatgctattaaaaagcagtggttctacaccaaaagcacaagcaacaaaagaaagaatagatacattggattttgttttgtgcttccaagaacaccaccaccaagaatgtgaaaaaaaaaaaaaaacaacccacagaatggggaaaaatacttgcaaataaaatctctaataaaagacatatctaaatacataatgaactattataattgaacaataaaatgtcaaataacccaattttcaaatgagcaatggatttgaatagacatttctccaaagaatatatataaatggctaaaagcacatgaaaagacgcttgtttgacatcttcatttcaacagtaggaaaatgcaaatcaaagcaacattgagctctatccactacagtggctaaaatgaaaaagaaaagcattgacgtcggtgaggatgtggagaaattggaaccttttatgttgctggttggattgtaaaatggtgcagtccctttggaaaaccacttgggagttcccaaaaatgttaactatgaagttaccaattccaggggccgggcgcagtggctcacgcctgtaatcccagcactttgggaggccgaggcgggtggatcacgaggtcaggagatcgagaccatcctggctaacacggtgaaaccccgtctctactaaaaatacaaaaaaattagccgggcatggtggcaggtgcctgtagtcccagctactcaggggggctgaggtaggagaatggtgtaaacctgggaggcggagcttgcagtgagccaagatcgcgccactgcactccagcctgggagagagagcgagactctgtctcaaaaaataaaaaaaattaaaaaaaataaagttaccagttccactcctggatatatacccaagaaagttgaagacatattttcatacaaaaatttgtacatgaatgttcatagcttccattagccaaaaagtggaagcaacccaaatgtccatcaactgatgaatgatgaatggataaggaaaatgtagtatagccacacaatggaatgttattccactataaaaataaagcaagtattgatacatggatgaaccttaaaaacattatgctaagtgagagaaagtcaggcaaaaaggccatatactgtatgattccatgtatatgaagtgtccagaataggcaaatgtatagatacagaaagtagactcgttgctaggagctgagggtgagagaatgggaataattgctaagggatgtgaagtttatttttggagtgatgataatgtcctaaaatcagaggcgatgtttgcataactctgtgaatatactaaaagtgaatatacgaattcactgaattagtgaattttatagcataattatatttcaatcaatctttataaaactagcagttctaattctagtaatcaaaaagaggaaagagaaatgaatgcaattatttttttaatttggctgctggtactggagaaaaaaaacagttccaattagaaaaaaaaaaagatgaattattcagtaggaatactaaagtggatttccaaaggctttagaaattgatggcactagttctttaacatctgtagtttcaattcaaaatgtatttcttatccaagttatcataaaccttaatcttaactcttggccacagttaagtttaatttggagcatgtcagtggaaattaggagaggggagacaaagaatgtgagagggatgactaatttttccaaagggtagaaaaaaataaaggaggatgataaagaatatttatgagctgatatgagctatggaagtgtgaaggacatgtggattggggcgtgtgctcagagtcccttaacgggaaaaaaagaagacaatgggaagtaagcctcctgggacttccattggcaccaagtgtctcgatggctctctctgctgtccttgtagtagtgtgggaggagagaaatctagtcccatgcacaagctttccagaagctcagggttcctatctcagtattccacatttcatatgagtacatctcatcttcccaactaaactgcaaatctgtaagggtgagatcatgtttttatgatggctcctttaatctcccatagctcccattcctctacataacaccatagatgttcagccagtacttgtagaacggtgaatgaatcgatcaaatgaatgaatagcaactctatctacaaggcatgccaaacaagctaccacgagattctgatttactccttggctctttgtgctctctgtggagcaccattcacatagttaccctgcagtcctgcaacctcacccattctgtagcactttgaaaggagagagttgtaaccttcatagtcattgacctttcagtacccacttttattacattttaaatacacccttgaagccctcccatcttcaaggaaagatccagcctgttagctctgggtgtgtaacgtaagaccttagctgatgtcttccttgcaggcataccaagaatgccagtcacctctccaaaccctcccccaaactaacatggtctcctgagcctcgggtcacgcctgggatagagcagagttagcagccatatgttttcacttcaacagtaaatctaacttggaattttaagaacctatttttcccctctaggaaaaaatacttgggatatcacatgaagaagtagactgaaatatcagatttgtcatcaggaatactctttgtctactgtggtcctgtgcacgttggcctcagatggactacaggagattacaacgtacaaggcagatggagcattgacgttttcaaaaccattattcctgtgactggagaggcatcaggagaggtctcgttcgtctccagctcataaaatgtagcagcatcatccttgacagtgatgtttttcaggccctccattgagaacctgaggaaatctgtaaagataagtggtgatgttgtttcaaacgttcagaacagataccatcatcctgcctttgttagctgctgtagggaaagtgcgttacagatgtctgctgacctcacaagagtgaaaagataaactgtgcatgtgtttccacttccgtttctagtactatttatttttaaactacacttggggtggcctaatacctaggaagatgttgctattcacgttagtaaacagcctaaagaaactcttaggtttactgctacatccatttgtttggagaggtaactgttgtctgtgcctttttgaaaaacttccatttggtacaaaatttttactccaacaccccctcaacccttttctcagggaccacacctcttcttcccaaggtccctgggacttcctcattctttgtggtagtacaatgattggtagcaggtaaaataaatacatagaaagactactgtcaaaagagtgtcttctgattagtaagtaataagtcttctgattatcaaatgagttaatttacataaaatgctcagaacacttcttggtacttaatgttaagtcttcacttatggtccctaatgtgtgctgccctcagctaagctgccaatttcctctcctgtcaacgcagtcactgattgctttcctgagattgcggctgttcggtataaggttttttagaaacatgctcaatagtaagtgtttaagacacaaaacaatttaaaaaatactatcaaattataaggtcttacaaatttctggatatgtagtacccagcatatggcctgatgtaaaactggtgcttaataaaactttgaagaacaaacaagtcagtaagtcagacatactctcaggttcaagggaaaactggatctatctattatcaaatgcttcactagcctacccatctcaataaaatgagttattctcttttgttttcttctcccacatgaaagtcatcactgttagggatagaggagtctccattttttgtttgtttgtttgttttgttttgttttgagacagactctcgctctgtcacccaggctgcagtgcagtggcgtgatctcggctcactgcaacctccgcctcctgggttcaagcaattctcctgtctcagcctcccaggtagctgagattacaggcacccgccaccatgcccggctaatttttttttttgtatttttagtagagacggggtttcaccatgttagccaggatggtctagatctcctgacctcgtgatctgcccgccttggcctcccaaagtgctgggattacaggcgtgagccaccacacccagccaggagtctccttttagacatggagacactgaagaccacctcttcctccatccactctgatctcgccattccaaactttttgcagttccccaaaggtattatgcaacctggcacctctgagccttcataacagtatcctctctacttggagtgttcttgcatgatggcttcctttccccctgtttccactaaaacaactaactctagctcatctttccaaatttcctcagtttcctccaggactcatttgctaaccctcccttggccatcatgtggctatatttggatgccttttctcataagatgctccaaatcaccctgcatgtagacattatgcttaatatattgcaccgtaagatttggtttacccagtctttctcagtggattgtaaagtcgtttgcaaacaggtactatgcctaatttaactttatatatctagtgcctggcatagttttggcacacagttgcagaaccataccctcgtctgactgatacagcttgtaaatcagtatgactggaatatgccctaagatatgtgtacttacaacaagctctccatgtgtttccaatatcatctatggcttgtggtcaagatgaagtaactaacgagatttaatctcctgcttgaaacaactaaaaaaaaaaaaagacactatagatgagaatgattttcaaggcattggacattaggtaatttttttttttttttgtatttttagtagagacggggtttcactgtgttagccaggatggtctcgatctcctgacctcgtgatctgcctgcctcagcctcccaaagtgctgggattacaggcgtgagccaccgcgtctggctaggagtctccttttagagaactggtccctgagagatgagactctaagtgagccctatgtttgccctagagtactgcatgcaaagagtttctaggtcatgctggagagaggggaacccacgcagagttcaccagctccctgagtagagaggatagagctaggagtccagaaagatcagagcagctgaagtttgcaagtctgataaaggatgaaagagagaggcacacaaagctccagagacctgcagatatttccccttaggtattcagatgaatactgatcaaaacatgtgcatgaagaaattacccaaggcatggggaagaaccacctgaaaatattaaagggaacgctctccaaagcctacacaaggccatgaatactgcctattttggcaataggtagaatccacaaaacaattttgtctcagaagtggcaaaaattagccctagactaagcactctctggttctgcacaacctaaagattaagagcaaaaacttaaaggattaaactgttaccaaataactgagctgtgttctagaacaaacgcaaggatatctatagaataatcaaaatatccagcatccaacaaggtaatattcacaatgtctagcttctgataaaaaattataaggcatgcaaaaaagcagcaaaatgcaatccatcatgagaagaaaaatcaggaaagctagaatgttacagatgatagaattgttagacattagaactattataactgtattccacatgttcaataagccagaagaaatataacatgcaaagtacacatagaacttataagtatgactcaaaccaaagttctagagatgaaatctataacatctgagatgaaaaacatgctggattggattaatagcagattagacatcatagaagaatggataggtaaacttgaagacatagcaatagatccaaaataaaaaacagaaaaataagattgagggaaaaaacagcaatagcgaattgtggaatgacttctaatgaatggcctatatatataggtataattgaagtgaagattttccaaatttgatgaaaactataaacccacagaaccaagaaattctacaaatgccaagcaccaaaaacagggacagggagaaaactatgccaaggcacaccataaattgctcaaaaccagtgataaagaaaaaaaaaagtcttccaagcaagcagagaaaaaggcatattatatgcagagaaagaaaaattaaaatgacagcaaacttcttggggactaacacaaaagaaacagtaacctctctaaagtatcaagacacacacacacacacacacacacacacacacacacacactataaatgcagaattctatacccagccaaaagatgattttaaaatgtagggaaaatagagattttttgagatgtataaaacctaaaagaattccttatcagcagacctgaactataataaatattaaagaaattccttcagtagaagccaaattattccaaatagaaatctgtatctgaaaaaaaagcactagaaatgataaaatgtgggtaaatataaagaatttttaattaaaagataatatactatttaaaagaaaaaataataatgtgttatggggtttataatgtaaatcaaaatgtataagaataatagtatggagggtgggagacagaaatggaagtgtaattgtacagatccacattatatgtgaagtgtacaatttcacttgaaagtagactgggccaggtgcagtggctcacacctgtaatgcagcacttccagaggcagaggcaggtggatcacctgaggtcaggagttcgagaccagcctggccaacctggtgaaaccccatctctactaaaaatacaaaaattagccaggaatggtggtgcacacctgcaatcccagctgctcaggaggctgaggtgggaagatcgcttgaacctgggaggtgaagtttgcagtgagcaaagattgcgccactgcactccagcctgggtgacagagtgagactctgtctcaaaaaaaaaaagagagagactgtggtaagttaaaaatgtatactctaaacccagaatcaactcctaaaacacacacacacacacacaaactcatacaaaatgtatagctaataagccaacaatggaggtaaaatggaatcacgaaaaataatccataacaaggcagaaaaggacagatgagacagaaagaaaacagcaagtggtctattaaactcaaccatatcaataatcacaataaatgcaatgatatagatattccaattaaatggcagagattatcaaattggattagaaagaccaactttatacacatcttccaaaaaaaaaactttaaatacaaagacatgaacagtcttaggcaaaaggatggatgctttgggaggccaaggtggatggactgcttgtgtccaggagttcaagaccagcctaggcaacttgacaaaacctcatctctacaaaaacacacaaaaattgtgtggtggcgcatgcctgtagtcccagcttcttgggaggctgaggagggaggctcactggagcccaggaggtcgaggctgcagtgaaccacgttcatgtcactgcactccagcctgggtgactgggtgacagagggagaccctgccaaaagaaaaaaaaaaaaaaagtcaaaggatggaaagatgtaccataacacccgtcaaaggaaaatggagtggctacgttaatatcaatccaagtagattcaaagcaaataacgttaccaggtgatatagtttggatgtttgtcccctccaaatcacatgttgaaatatgattcccaattttggagatgggccttgtgggagttgttttggtcataggggcagatccctcatgaatgggagggatccctgaagtaatgcattcacacaagatctggttgttaaagagtctggaattttccccttctctcttgttccctctttcatgtgacatgcctactcccccttccccttctgccatgattgtaaacttcctgagaccctcactggaagcagatgccagcactgtgcttcttgtacagtctgcagaactgtgagtcaaaataaacctctttctttataaatcacctagtcccaggtattcctttacagtaatgcaaaatggactaatacagcagggataaagtcatttaataatagtaaaggagtcaattcatcaaaggacataacaatcctaatgttatgcatctagtaacagcctcaaaatacataaagcaaaaactaatagaattgcagggagcaatatacaaaaatgtttcacaattatagctggagatttcaacatctctcaatgattgataaaaccagtagacagaaaatcagtaaggatagtacagatttgaaaacttggagcattaaaaccaacaacagcagaaaaaaacattcttttcaggtgcacatggacatttaaaacactgaactatcttctggaccataaatctcaataaatttaaaaggattaaagtaatttaaagaatgtttgttgaccacactgtaaataaatttgaaatcaataacaaagatatctggaaaattcctcaaatgtttggaaacaaaacctgtctaaattacccatgggtcaaagcacaaatcaaaagggaaattagaagtatttttaacttaaaaatgaaagcacagcatactagtaattctgagaggcactaaggtagtacttagtgcttcactttagcaaaggaaactttaaagcactaaatagctacattagaaaagaatggtcactaactgatgacttcagcgtataccttaaactagaaaaggcaaatccagagtaggcatgagaaagggaattcaagaaatagaaaacaagaaatagtgaaaaaaatctacaaacccaaaagctggtttgttgagcatatcaataaaaccgctagcttgactgatcagaaaaaaggagaaaatatgaagatattttcagaatgttttcaaaattttgaaaagtagaatgtgtcatgagcagaccaagagtagaagacataccaaaggaaactctcagcctgaaggaaaattatagcagatggaaagtcagatctctacaaaggaataaggagcatcaaacataataaatatgcagataaataaaagtatttttctttacatttaaaagacaattgtttaaagcaaaataataatagtatattatggcatttacaacatgcagaagtaaaacttatgacaataaaaacacaaatgaggccaggttgtggtggctcttgcctgtaatcccccaactttgggaggctgaagcaggtggatcacctgacgtcaggagttcgagaccagcctggccaacatggtgaaaccccgtcactactaaaaatacaaaaattagccatgcatggtggtgcatgcctgtaatcctagctacataggaggctgaggcaagagaatggcttgaacctgcgaggcagaggttgcagtgagccaagattgtgccaccgcactccagcccaggcaacagagcaagactccagcccgggtgacagagtgagactccatctcccaataaataaataaatacacaaatgataggaaaggattctgggaagatggtggagtaggaaacactagaaatctgtctcccacctagacaacaataactcaaacagaatcaatctgaaataactattttggaactctgaagtctattaaaggtttgcaacttccaggcaaaagcttcgacaggtaaactacagttaatttaatcaatttcagctcttagcacaataccagctacctatcccccaactccagtcccatggcaagcaatggtgcacctgttcctggagcagtttgcacacagcttgtggtaagcagagtgcaaaaaaagaaccctgttctccaaatatcagggatctgtgcactgattgctgactcctgctctgatcaaagaggtgcaggtaaagaggtggcagccattgtttgtcagtctgacccattacacctctccccatgactacaagcccctcctcctccagctgaagtgactcccaggaaacttaaaaggcctctgccctctttttctccttttcatttttctccttttcccatttggggagccagaaaatgagactaggattttcaaaagcaactgtatttgggggaaaaatatgaaattgaccttgcatatccaaagagaggcacagactcagaaaagacctcagaagacttaagtttatacctcagggtgatccttggtacagagacagtgtacaacaattaaaaatcaaaaccacacaaacccaaaccacaaaatagcaagccctggggaaggggattaatctgatttccacagttaccatattattagattcaaatgtctatgttttcaacaacaacaaaaaatcaaagcatacaaagaaataggaaagtatgacccaaaggaaaaaaatcaacagaaactctctgaaaaagatctggtggcaaatctactagagaaaggctttcaaacaactgtcttaaagattctcaaaaaagaacaaaaggaacatgtggagaaagtaaaaaaataatgtaaatagcatatggacaaaatagaaatatcaataaagagacaagcaacttaaaagaaaacaaaaagaaattttgaaagctgaaagtacaattaccgaaataaaaaattcactaaacaaatttaaagacagatttgagaaagcagaagaaagaatcaggaaacttggctgggcagggtggctcacgcctgtaatcccagcactttgggaggctgaggcgggcagatcacaaggtcaggagatcaagaccatcctggctaacacggtgaaacaccgtctctactaaaaatacaaaaaattagccaggcgaggtggcgggcgcctgtagtcccagctactcgggaggctgaggcaagagaatggcgtgaaccccggggggtggagcctgcagtgagccaagatcgtgccactgcactccagcctgggtgacagagcgagactccatctcaaaaaaaaaaaaaaaaaaaaagaatcaggaaacttgaacataatgacgcaggatttttcttggcccctttgctgggcttgcagcaggggcacccaacacctcggcctgctgtgctcagcccctggtaggagggagcacatgggcaagcgagtgcagggcttggctggttgctccaagtgccaacacaagagcaagctctatgcaggccccacggccagaccaggtatgttgccctaaggggatcgcaacagtgcccaagcaggggtgccccatgaccccaaatccccagaaggggtgttagtgtgctaattagctcttttagttccactgtccacagcctgatggacggcagcacgttaacagctcagtcagattcttgcccctccctgacccagggctccagaactggcgtggctctgggaccagcttggccccgccactgcttctatcatgtggggaagctgccctccaccgttgagggcagagggccagtgttacagcctttctggccacccacattcagtgagtcccaagctcttgtcctgcatccaagaagaatgaggtcacactgacaattaaagggtggtaaagacagataattttattgagtgaagaaacagctgtcagtggaaagagggtgggaaggtcggattgtctctcctgaagtcagattgtctctctcagtgtggctgaatctgggatttttataggcacaggataagggagtgcatgcttcctggtttgtgagtatgcaagaaaggttaaaatcaaggcaccagtgaaaggtgggcacagtgtaaaaacaattagggaagggtaggtatatgtaaaataggttaagggtagggatcaatcaaaggaaagcacaccaaaccggaagacagtactcaatccaaactgtgaatttgacttgtagcttggcctcaggctttaaactttctttggcttgaatgtggggtttcactggggacctgcccatctgcctaggatttctctgtctcctgcctctatcaataagacagtggaaattatcaagtctgaggaacagaaagaaaaagtctgaagaaaagtgaacagagcctaagggagttgtgagacatcatcaagctgcccaacacaagcattatgggagttccagaggaaaggagagagagagacaaagaggcacagagaatacatgaagaaataatggctgcaaacattacaaatttgaggaaagatatgaatgtaaatatccaagaacctcaatgaattccaagcacaatgaactgaaagagacctaccccgaggcacattataatcaaatgcctgaaagacaatgacagataatcctgaaagtaggatgagggaattgactcatcacatacaaggaacccttagatcatcagcagatttttcatcaaaaactttggatgccaaaggcaataagccaatatattcaaaatgctaaaagaaaacaaaaaaaaaacaaaaaaaaaacaaaaaaatgtgtcaaccaagaatcctatattcagcaaaactattgtattagcttgttctcactctgctataaggacatacccaagactgggtaatttataaaggaaagaggtttaattgactcacagttcagtatggctggggaggcctcaggaaacttataatcatggcataaggggaaacaaacatgtcctccttcacatggcagcaggagaaaaatgagagccaagcaaaggggaaagccccttataaaaccatcagatctcgtgagaacttactatcacgggaatagcatgggggaaactgctcctgtgattcaattacctcccaccaggtccctctcatgacaggtggggattatgggaactacaattcaagatgagatttgtgggggggacacagccaaaccatatcaattatctttcaaaatgagggggaaattaattcccagataaacaaaagttgattgagtttgttagactaggtcacctctgcagggtgaaattaaaggacccttgacagtaactaaagtcatttgaagaaataaagatctcaatgaaggtaaatacataggccactaccgaagctagtattattattatttttttgagacagagtcttgccctgttgtccaggctggagtacagtggcacgatctcagctcactgcaacctctgtctcctggaggggtcaagcaattcttatgcctcagcttcccaagtaactgggattacaggtatgcaccaccatgcctggctaatttttgtatttttagtagagacagggtttcaccatgttggccagcctggtcgcaaacaggtgatctgcctgccttggcctctcaaagtgctaggattacaggcatgagccaccatgcctcaaccaaagctagtattatttggacaagggtttgtaactctactttttgttttctacactttttttttttttttgagacagtcactctgtcgtccaggctggagtgcaatggcgcaatcttggctcactgcaacctctgcctcccaggtttaagcgactctcctgcctcaacctcccgagtagctgggactacagacacatgccaccacacctggctaattttttgtatttttagtagagacggagtttcactgtgttacccaggatggtctcaatctcctaacctcatgatctgcctgcctcggcctcccaaaagtgctggaatttccgacgtgagcccccgcgcccagctcttttttttttcttttgacagagtctcactctgtcgcccaggctggagtgcagtggcatgatctcggctcactgcaacctccacctcctgggttcaagcgattctcctgcctcagcctcctgagtagctgggattacaggcgtgcgccatcacgcccagctaatttttgtatttttagtacagatggagtttcaccatgttggtcaggctggtctcaaactcctgaccttgggtgatccgcccacctcagcctcccaaagtgctggaattacaggcatgagccaccgcgcccggcctccacattgttttctacataatttaaaattctttttttttttttttttttttttttttttgagacagagtctcactctgtcgcccaggctggactgcggactgcagtggcgcaatctcggctcactgcaagctccgcttcccgggttcacgccattctcctgcctcagcctccccagtagctgggactacaggcgcccgccaccgcgcccggctaatttttttgtatttttagtagagacggggtttcaccttgttagccaggatggtctcgatctcctgacctcatgatccacccgcctcggcctcccaaagtgctgggattacaggcgtgagccaccgcgcccggcccataatttaaaattctaatgtgtttaaaataattattagtttatgtttcggggaacatggataaagatataactttgttacaaacaaccaaatggggtggggatggagctataaataagtagattttttggccaggcatagtagctcacacctgtaatcccagcactttgggaggctgaggtgggcagactgcttgagcccaggagttcaagaccagcctaggcaacatggtaaaacctcatctccccactggctgctctgaaaagccatctttgcattgtgcctcgtcagcctccttgctcgccgcagccgcctccgccgcgcgcctcctccgccgccgcggactccggcagctttatcgccagagtccctgaactctcgctttcttttttatcccctgcatcgcgtcaccggcgtgccccaccatgtcagacgcagccgtagacaccagctccgaaatcaccaccgaggacttaaaggagaagaaggaagttgtggaagaggcggaaaatggaagagacgcccctgctaacaggaatgctaatgaggaaaatggggagccggaggctgacaacgaggtagatgaagaagaggaagaaggtggggaggaagaggaggaggaagaaggtgatggtgaggaagaggacggagatgaagatgagggagctgagtcagctacgggcaagcgggcagctgaagatgatgaggatgacgatgtcgatacccagaagcagaagaccgacgaggatgaccagacagcaaaaaaggaaaagttaaactaaaaaaaaaaggccgccgtgacctattcgccctccacttcccgtctcagaatctaaacgtggtcaccttcgagtagaggggcccgcccgcccaccgtgggcagtgccacccgcagatgacacgcgctctccaccacccaacccaaaccatgagaatttgcaacaggggagggaaaaagaaccaaaacttccaaggccctgctttttttttcttaaaagtactttaaaaaggaaacttgtattttttatttacattttatatttttgtacatattgttagggtcggccatttttaatgatctcggatgaccaaaccagccttcggagcgttctctgtcctacttctcactttacttgtggtgtggccatgttcattataatctcaaaggagaaaaaaaaacttgtaaaaaatgcaaaaatgacaacagaaaaaccatcttattccgagcattccagtaacttttttgtgtatgtacttagctgtactataagtagttggtttgtatgagatggttaaaaaggccaaagataaaaggtttcttttttttccttgtctgtgaagttgctgtttatttttttttggcctgtttgatgtatgtgtgaaacaatgttgtccaacaataaacaggaattttattttgctgagctgttctaaaacaaacaaaaacaaaaaaaacctcatctctaaaaaaacaacaaaaaaattagctgcatgtggtagtgtgtgcctgtagtctcagctactcgggaggctgaagtgggaggatcacctgagcctggaaggtggaggttgcagtgagccaagatcgcgtcactgcactccagcctggatgacagagcaagagcctgtctccacaaaaaaaaaaaaaaaaagagaaagaaagaaaagaaaagaaaagaaaaaaagagggagaaagacaaaaccatcaaatttatttaatatgttttatatggtacaggagtcttcatattgaaatgaagacccaaagaaacagataagtgttagtgtgttttgtagtaggtttgatgaagagtagacagttgtggagaaatatgataggacataaagggtatgatctcataataactgggggaaacttagcaagacctaagtttagatttctttgtgacttttttttttttttttttgagacggagtcttgctctgtcacccaggcttgagtgcagtggcgcgatctcagctcactgcaacctcctcctcccaggttcatgccattctcgtgcctcagcctcctgagtagctgggactacaggcgccctccaccacggctggctaatttttgtatttttagtagagacagtttcaccatgttagccaggctggtctcaaactcctgacctcaggtgatccacccgcctcagcctcccaaagtcctgggattacaggcgtgagccactgcacccagccaacactttgtctttagagataagaatgttctcttccaggtgtagagagggcacctctcacacgagagacctgcttaagggaaagatcagaaaacttatcccaggtttataaactgcttcaggtgagaatgatgaaggaatcctgcttccatgatttttctccaattccttcagctcaaaatagtattccgaggtgtcatattttaggtactacgttttgagtcccagtagagaagacacaaattaccaatgtctgaaacaaaaacagacattaaaaggatagagaacgtattttatgtcagtaaatcaacaacttagatgaaatggacaaattccttgaaagacacaagtaactaaagctgacctaagaagagaaaatatgaataacctagattagagaaactgaggtattaaaatttttcctgttacatatgtatctgcagttaggaatcatagcactgcatacttgtggaccctaaccctttccttcccatggaatccccaagaaggaacttcaattactggacaaaagacgagaatcttcaagcctgttcaattgagtaatggtagtgggggagcttttggtaggatgatcagaagtcaaaagacctcaagataatcacttcttgtctgccatgcagcttgtgatgtaagatgggcatcgggctgtctcctttttgacagttattttctttggaaagtgaagcaagggcttagggggaaggaagcatcgaataggtatctccatggaataggataccacataggcgtttgggcttcaatggactctaccttgtaatacaattcattgcctcaaatgcattatgtataagtacctctctagaacaggtattggaattgactaattaaagagtcaagtggtagccagtcgtggtagctcacgcctgtaatcccagcactttgggaggccgaggtgggcggatcacaaagtcagatcgagaccatcctggccaacatggcgaaaccctgtctctactaaaaatacaaacaattagctgggtgtggtggcacatgcctgtaatcccagctactcgggaggctgaggcaggagaatcgcttgaaccacagagtcagaggttgcagtgagctgagatagcaccactgcactccagcctagcgacagagctagattcagtcttaaaaaaaaagaaaaaaaagtcaaccggctcattaaagagttaaggttctgaaaactctacattagggactaataccaagaaatactgagagataaatgagtccagacatgccttgacaattaattacagtggaataaagattaaaatctagacctcaatccatatccttttccctctacccaaagacaacccgtttttctttttcttttttttttttgagacggagtttcgctcttgttgcccaggctggttggagtgccaaggcctcatctcggctcactgcaacttctgcctcctgggttctagagattctgctgcctcagcccctcgagtagctggtattacaggtgcctaccacaatgcccagctaatttttgcatttttagtagggatgaggtttcaccaagtccgtcaggctggtctcgaactcctggcctcaagcaacccgctcgcctcggcctcccaaagtgctgcggctggcgacaacccatttctaatcaaaattttgcagtggaacttttcatactcaaattgggcatttcctgtcaagcctggtcattcatcactttattattctctttattctacaggtaggggtttctctattgaccaggttagtctcaaactcctgacctcaaaagatcttcccgtctcagcttcccgagtagcttacaggctcaagctacgacagctggcaatctttgattattttaagtcggagggcaggaggcgaggaaaggcagcacagtgcctggtacacagtaaatgcaggctagaatgttaataaaattatccttcattttaacttccatattggagaagactggttttgtatgttgactaaatatgaatttgcaaatgcaaatctcaagcagattttctgtgggaggggggactgtgcagattacataatgatataaatggatggaaccagagatctgaggacagtaattcgtcatttgaattaaatttatagaaacaatgcaatcatacacaaggcaacgaattaaaatgaaaactacttaattatttacttagctgaaaacctatctggggaaaaaaggacccaaaacagtttgcagtgtttccccattcgtgagattgcctttccatcaggcaaaccaatcttctgccttttctttctttcatttaactgggaatggcacaacgtgtttctgttttccttctaggaaaaagaatgggaggagtcagcaaagaccaaggtaagttcacttatttgagggcattggctaagggaaaacattttaaaacttggtttccctttaattggtatttgggctcaaatactgcaaaataaaaaagcagctttcctcccttcctatcaaactagtaagctcagtatcaagcagagacctggtatttcactggattttactatgtcctaccctcacagaaaaagaatcatcacatcacactgggctcttcaccaggaaagcaatgtgcattttataagctaatttaagatcctggaaaagagggaagtgctcagagtccatactagaactccttccagtttactgaaaacaagagcagttttgaagcacaggctatttcttattcttgttcccaaacacaaatgctgccagcactgaactaagcaacagcccttcgcaaatctctcttgcagagactgattggctgattgactgatttagagacagggtttcactctgtagcccaaggctgccgtgcaagtggcgcaatcacgagtcttattgcagcctcaacctccccagcttaagtgatcctcccacttcagtcttccaagtagctgggactataggtgtactggcagagtattatttaaaatgcaaacaataaagctgggttttgtgtctgaaacagcgaaggacaaccagctactgtcttaatttcttgctgaaaagaaaggacagacacttttacttttccactgttttattacaaaaatcaaatttcatttgttacaattcagcttatttattgtaataatcaaaaaaggggtttatacaaggtatttttatacagtttataattaaagcacttattttacaaaaggagggaagtgaataagtggacaagggctgaccaaatgttggccattataacataaatacatccttgcaaagcaccatcgtaccaaagtcaatgaacaagaaacaccagttgactttaagacaatgacgaagattaaagcttaagggaaaaaaataaaagataaacatctgaaagcagcaccagatccttcacttgcaaataaggctagtccagtttaatcttcttggtatcctctctactttttaacatttttccttactaatccatatatttaatttcatgtcatattggatttaatcagactttaaaaattttccctttaatacccatatttaggcattagatatatagaatatgtatctatatataaatatatctctatcgcccatcctgcttatatttgactgaaaaacacaaccaccaaaatggacagttcagcaaaagcgcgttgtctgtaattctctggtgttgcttctgggcaaaccctaagtgatggtggagaatctaacagttcgttaggtctgtactctgcttctaaatacaagacatcatttagtttgtaattctatctgtaaagtcatggagatttttttcagcaataaactcaacaatttgagaatgctttatgaaaaagaaaaacagcaaagtttacctcaattgaaagagggtgagggtagagtcagtaactgattaacctaagactccaccttccactccactcaggtacaggctttatgagacgtagatcaagtcagacaatagcctgagagtgtgaattcacaatacttataatttaaattttaaaaaaattataaacgtataattttatacttgaggtccaaagtcttctaccataaaatgttgagaatttcaaaagctaaattttgaaactattataaaatggtgccatcccaaaagtcagaagccacacatgcactacaagtactttctaaaatcatctttcactacaagtactttctaaaatcatctttctcttggttcattttaggcttaagaaataccaaataaaattaaattccttgggtttaagaattctgataatgttttaaacaacacctgactataagcttctttaggactcagtccacacttagtgcatagtctcatctgtagatgcccaaatatttgtccacctactgataactggtcaacacactcatatccatactctaaatcaactatggatgccatatgtagacttaagcaccacacatttattaagagctgacatatttcggatgtgaaaagtccaagatttttgtttctgaatcttgttagatacgtaatgataaccaatatgtaattcctatggcatgcaaatgaatgaagtgggacaaagcttcccctacaagaaataaaacaattcaaaatatgacatttctaagaatctaatctaggcagctgcagcctgtttactgcatagaagtaggcgtgcttaacgcatacctcttcagtctctattatgactactggtatcaagtcacataaataaacacacttcattaacacactaggtaagctacagctattaactctactggaagtattcttcattaatagggctttatagcaaaagaaaaagatgatcctccaaaactgctacctaatacagatgatggctatttttaataccttcaataatgaatgagtttccttcatataaattactgactttaggatatttttaaatgataaagaaatacaaccctcaaaatcatcttaaaattgtactgctcaaagccccttcccccaattactggcctatattagattaaaatgtactttaaagtcttcatttctaagtacctatcatctctgtagaataggtgttctcaaacttactaaagaatcagagatctcttggtaatgtatcacaagctacttttatattaaaattaaagtaactacataatcttctgctaaacagatatcttgtgatatgctgtaagagtggcagaaagtgccaaaggcataataaaatttcatggaagaaaaattaatagtcagaaaattctatccaccaactctctttgtttccctgtgaatgtgctattatctgacttaagcaaacaaaactccttaagtcactattcagaagaccacgactctgttggagcaaagtccaggccttagttataaaagaccacttcaatgcagaatagcttactgtggtgcacacaaagtatgttatgctcaagtttatttcttggacaattttaatcacatcagttagtgcatatattttaggacacatgttcaaaataaatacttttgcatataaggaatctaatgaaacattattcattttcccccttggacaatgaatttaatacaccaaatttaaaaatcccttttcttttttccccctaatttgtgatctcatgcttttcctctcaacttttccaattacagcttgtgtttgataatcaatatacagtttacttaagcttaactgtccatgtaacctaaggctcaataaatctttccaaatttgacaattctctcattaaaaagtactcccagaaatattaagaatccatctcatctaccccagaaagagaacactgagattaggctgaactgccttcaaataattttaaacaaattggcacacaaattagtattttgaagaagaggccattgccatcgcagtgcaagcacgtggactgagatccaacaaggcaatattcttcttagttaattagagtgcaagtctccacatgggaagcccaccagatcaagatgcacatttaaatatgtaaacatatagaattctcaaattctaactgacacccaggtattgctaacctttccatcttcatttaagcatcaagtgccctgtgtatcacagaatccaagttcaatgtccattttgtctgacactgtgggcacttagttccagcaatgggaagagttcatgcttgtctgttttaggattctgatagatttaccatttgcttatatgcaaaatcaagtgcacctgattcttacagtctccaacaatcagcattattctgaaaccacaattttatcttcaaaaactttacttaggtatttttaacttgcatgaacagttacttcacccttgcccaaattctgaatcctttcttccactgttttctcttgggccctgaaacccagagaggccttggcaagacagaattaaaaaagaaaaaaaaaaaattcaataattaactgaccaacacctcttaagctaaaaatacattagtttaaaaccattcaattttagcagagaagtgctacacatgtgtaaaaagcaggaaacgaacttctggcaaggtggcagagcaagtgctagaatcattccacaggtcagccctgatagctcaagatgtagcagccccagtaccatacatgacagcaggtcaggcagatcacaaaagaggcttccattattcccttccacccaaattctgacagctgagaagttaacagtttgccttctcatttaatcctcattgttaaatttgttaaactatcttaatccataatgggtaagagaggacccacataaaaatattgggtgattacaagaataatttgtggataatttgaaaacagcctaacattcacagtgggtaacagaaagatattaaattcatgtcacacattagaagaggtatgtatgtagacattattctgagaaaaaccggtctaaagaacatgaaaacatcacaaactgttaatatagggaaaatcctaataagaaaaaaatctttttaaatagattgtctctaaccagaacatatttaaatgttttactcagaaaacaaacaaacaaacaaaatatatatatatatatatatatatatatatatatatatatatatatatatataaatgatttcgtactgtgatatatgctgaaagtagtgcaaggatatgagatttacaacaaaaacataatggttaaatttttaattcttaaacattgtctatatgtgttgtaaaaagacattttaatgagcattaaaacaatcttggaagaagagaaataatatgtctaacttttgatcattatgcaaaaacagcagtcaaattgaagagctaagcctactggggaatggagctagaagaaatattaaaatcaagtttaatttagaaaattccatttagtcaatgcttcagcttaaaaaaatcatggtatcttagcaaaatgacttaccaagttgctggaggaggcagcaaggtaaacatacctagagaaaaaaattcattttgacagaggtatggattctaaaggtagggacagagacttgcacacacacacagcttcatggcatcttaccagagggctgatctctcctacaacagcaacacccagaatgggtttttagaaatatctactttcctcactagcactgttggattcctagagaaaacaaagcccttcgtccaaggttagtattaattgcatttttttcctttcatcatttcttacttgttggccctcaaatgttagttaactgaaggctatctggctacatccatgtatctatggtttgctgctctgagatggacttaatttttcttcttcctcttttttatttttggtatcaataaagcccagatattcctggtcagtgatgcctttattattcctgtttcctttgtactcagttgcttcactgggtttaaggcatgctttgtgtatttagtttgcaaaaataaaacttttagtacaaattttttttatacaaacttttatggcacaagcagcaaatctgctgttttaagaaaatatataaatatccttttcttctgtacaaatatctccagtattccctaccccattttataattttaactgtacatggtctgcctcatccttctctaatagctccctccccccctccagatctcaaccaaatttatatttacatttttacgttggaggcagtcagaggaggagggcccctcctcaggaggagtctgtacagggagagggtggcggtgggtagaggtgatgagaatagctcctctctgtgtatggagaaggtgggcagctttcatagttctcctctgctgacaagtattggcttcggggtgtgggaggtgggggcacaggttctgaatcatagttcaagtcactggtatagcccttggctgttgccactgaggtcattctccgactaggagcatagtcactgtcacaaacatctgtgctgcagggtgtggtggggggtgcaaagtgccggtagctatatggcctgtagctggtatagggagaaaataaagagaagcagttagttttacaaaaaaaaatgatttcccctctcagaatagaggtattagatgtcaactaccctatgaaaacaataagctactgcaatttaaatttacacagaccaagaggcaattttcaatggcagattcgctgaggaaaatagcaggtactttcttatttgcaaataagaaagtggcaagtgaaaatgaacaggatgggaatgcagaggtgaattcaatctagcctctggttgtgctcttacatcttcaagttaaactgtatcacagaataaaaaatgactattcaaatttgttctgcagtttcatagcccatgggaagaatgggtttttacatattttacactactcaaacatgtcagcattccctcaacattctttactccaaaattaacctgatgaataattaatttaatgacatctgaagtcttcatttctttcttctgtacaattctgtacaatttctgtacagtccaggctggattttggtagacagcctcaggggcataactattccattgttgttatcttagcaaagggaaattgctgtgattgggggaaacggttttcattccctgtgtataggtaagtacctctcataagagcagctttaaacatcaaaatgataaaatttaaatgcccataaagggtcagtgaattttctaatgtatatttcagaggcctagtttatttcttacacttgtttatctttacaagtgacatacagttgttaggtttgtagcactgctaactaaagaaaaaggcattggaaagagagaaacatactagtgaaaataagatctgacctaagttctggcttttctgtcattcctacttctatttttaacttcttatacctgtttattctaaatatggtaaagctgatcttaaatttatcccaaagattttttcataagctttctcatcaaagtgactacaagagaaggggaaaaccaagttaaaaactgatacaacgattcataaaacacctagtgatacagagcaccaccaggtaatatatcccaggaacccaggatacaaaccatttgatatcacttggcttgcttcaaaagaaatggctgccagattgttcacagtcacagatcaaattccttgttctactctgtctccccttcttactactgcatttgattagtctttaaaaaagaaagaaagaaagaaaccagcctgggcaccatagcaagaccccgtctctacaaaaaataaaaaaaagctagccaggcgtggtgacacacacctgtagtcccagctacttgggtggctgaagcaggaggactgcttgagcccgggaggtggagactgcagtaagctgtgattgtgcccctgcactccagcctgggtgacagagcaagaccctgtctcaaaaaaaataaaaataaaaataaaaagggtgcaaggctgccagagaccaaaagttatatgacccactgagtgagttctcaaaggcttttactatcaatactgacatgatgtcacagtttgttttgtttaactctttgtccaatcaggtgtcaatccttggtgaaatttctaaggtcaacatttaaaagtccaaatacttctattttcatgaaaaaaaaaaaagaaaacaaactgaattaataaaattttttcatgtcccagtttaaaccaaaatctcaacaaatgatgtaagttttgactcagaggaaacagaaattgggcttatacggaaaatagttaagcaagaatagttttttatgcaatcgtgtttattctgatgagtgccttagtcaatttgaattaaggacattacttttaaaaaataaaattttgtatctttctcctttctcaattttcaggcttctgctttttctgttttggcttcctagaagaagaaacttgtggcagggaaagcaacattacaacatatcattaaaacaatcagttcacagccaaggctatttcagtcttatctaagctgaaatgagaattctgagtgagatactttaagtggtttccacttcatttctacacatgggtgaggtcgtatcaggccaatttgactgaaatgctaggaaagataatagaagattatctagagaggatagaagatagaaaagattatctagaagataacaggcacttgagggatgcccatgaaccctgggcacttcagtgtgtagatagaaactctcaagctactgatggtctgttggcctttcaaggaacatagaagtggaagctgacacaacagtacttgacctgctcaacacactttatagactcataaattagcaaaaaggaataattttctcttttttggcttacaaatacactttatttatttcaatctttctttattccatgcaactacatgagaaatctttcactccaaattgtaatagcatatgcaagcaatggctgaacttacatttctctcaacttttctaaaattctgtgctctgagtatgttgctgttttaaactctcaattctatgaaccaatcttatcccaatatttcattcttagaatatcaaactattttgaaaccagtcactttggtgggtaattcctccttagaatactgccaaagcctgaggctgtattttattattataaaagccagcatttgtgactctcttaaaaaaaaaaaaaagtataggccaggtgtggtggctcacacctgtaatcccagcactttgggaggccaaggcaggcggatcacctgagatcaggagttcgagaccagcctggccaacatggtgaaaccacgtttctactaaaaatacaaaattagctgggcgtggtagcgcaggtctgtaatcccagctatttgagaggctgaggcaggagaatcgcttgaacctgggaggcggaggttgcagtgagctgagatcatgccattacactccagcctgggcaacaagagcgaaatccatctcaaaaaattaaaaaaaaagtataacgtcctgaaaggaaaggatttgtggtagaggcaatgtcagtactatcaagataagatgactagtctctctctggtgaccatcgtctactcatttggggctatatcaggtccacaactgaaacactttcaataaatactgcaccttattttagagaaggatgtgtattacctgtatgacctatgagtggaaggactgtttgaagaatatccaaattccatagtgtaatgtgatcgctctgtggctggggatggtggagggttcaaaatctaaaagaaaaaaataattaaaatattaaaataacaacatagaaactatcagactttctttcaacttttcttccttcatctctattagtgtttctttacaatacactattagcacaattcttcttttccaaagaattgacctcaaacagtactttgggactatggcttcctcattccctaagacctcatcatggctaaaaagtgcaaagtgacaaaaacgaaaatctgtaacctaaaaatcattggtcagtacatttaggtcctggttatttaaaatagtaagtatttagagaaaaattattgatttaggagaaattccaggtgtgcttcctcttttgggaagtcataaaatgaaggccctaatccctcaataggtaccattcagtagttctacttttacttgaaatgtgaaattaatgcccagtgctttcaagtattctggttactacacagtaacttaaaagatttataagcatggatggtggtgtgtggtaagtcctttgagccttttatgcctaaattttacattcaaaaactacttttacattactatcactgatcacccacatttaaatgagttaaaaaatctaagatcttatgtatgtcgcattcaaaggaaaacagactacttactgcagggaagtaagtgcctttggtgcttgaagaactacttgatgatgctcctgtaacatgggctcggtcataggggggtccactgcttccccccatgatactgagggagctgatcattgatttacctcgagacattcctaaaataaaaggaggttaaaaactgaagatgagtatgatatataaaaatgtatcaagcaatttcattcaacagtaggattacaaatatcaacagtgaagtagtctgattttaaaataacttacactcttttcctataattgaaaacatttaatggagaaaggaaatgaacgttttctagaagtcaatgcttccattgaaagagctggcctagaacaaggccaagaatagctcccaccttctccctcccctggtagaagcagagctatttaaaataagggcttttcaacctcttggaggatttgaaaggattgtaaagggtagaggttgtgaggcagggcatattaaataccagacttgctcaaaagaaaacaaaaaaacatttttagggcacaaacaacatatgaaagaatattttttcatctaatgaatataaatgttgctagaatcaaaactaccagtgctaaagaaaaaattctattttttccaagaagcttcccaaattccactaactgaaaataggtatggcaacaaagcaacactaccattaacagtttaaaaaccatgtttgtctacttaagagttacacccatagtaagttcctattttcagagggtttttgcaaggcaccgccttctccatattcattaaaaggaaggcgtcttttaactaagggcaccagaaaacattaaaaagaaggccagttccctagagcaacacggcctacccaagcttaaaacttctggctactcagctatgcctaaactagccctttgtcccttattagcacatgaagtcaggagaaaacttaagacatattctcccttctatcatccagctatttacaaatctttgttggctgaagggaatcttatataatttttggcctccttttattcatgggctccatagtactagagttccctggtggtgaacttaacctgtggtttacaactctttcactaaatgactggctgattcaccttccgtagcatgcatccagaattgcagtcagagaggcttagagcttgcatatgtatttgctttatatgctttgacaatttctaccaaaccatatctaaggccttctgtgtaaagagaaggtgctaatagtaaaaaagaacgtttgtccttataattgtttaaactcagagtaatatggtttcagacagactctaggtagtattcttttccacaatggaaactggcagtcttgcaggaccaaagacttgattctcaatggatccatcctgactcacctggaagagatcctgacaaagaacttgggtgtggcacataaccaagaggcacagaagctggtccatgaactacatagtcattagtcatagtttccccatctcccttcatacgtggacacaacatcctctggcagataaagtatacagttccagacacaaaaatggtgacaattacgccaataacagaaccaactgtattggtggcctgtggtgctggttcttcagtcggatctacaatgaagaatgcagtatggttatttaatagaaaaacaactgtatattcaaaatagtaatcaaaagagggcttgctaataggatgtgaagctataagcctaatgaagataattcataaacacttttcttttttatgagtacatacataccacgccctgaagacatatgaaataaatgtcatcattaggaatcaaaatgaactacccttaaatgaagacagaaataaaacaataggttggaaagtgtaattgtaaacagatagaaacaaagatggtaaatgaagtacagatttaaacaccattaagaagctttaaataaataaacagataaaatccattctacttcattctatataccatacaaatgaacaacggtattccaagatttcgggaaaaaatttatgaccagaagggataaacctagaaaagtcatcaaatgttttacctggaatggtgaagaagccaaaatcagctctgagcacatgttagattttagatttgaatagtgacatttaggcctgatgaatgaaaactggaagctaaagataagcctcagctctcaaatcccctatgctgctggccttcaggctgtctagttgcctgagaccaaggaacataaggtctttaatacctgattactggaggactcacaaagaaaggccacattgccagaagaggacaccaccccagggattcaccttccctggatccctgagctacccgtttaagaagcagagggcatcaatatcagaggtagagggaaagtgagcttattgaaattagagcattactgtctctattcagagggaaaattcttccattctgaacagttaaattttatctcacagttgcagatcctttaaaaaacttcctcctgcttcatcttacctcaaatctcccatccatatagctaaactcatcctctgacagattatatgaaagaaatgcgtgaaaatgacatctctaagttacataatatgtagggattatcatttacaaatttagtctgtggaatctgaagcatagactcttcttagtccttgagaacaaccgtctcatcttttcattcctttttagtcccctaacattcctttgcaatgccaagcttcaggaaagaaaagtttacattcactaccctcaatccctagcctctgggtcacaccataaactccctgaaatcagacttccaccctcaccactgcactgaaacttttctgtcaacagtcaaagttctactatttgccatattcaatatattcatttcactaacctctttacacaatactgctggctcctgtcttctctttaaaaaaaagtctgatcaatattcttccaagataccactctcttaattttactatttctgattattctttctctgcttcctttgttggcttcattctcttctgcctgcatcttaagtgcaggtgcttcccagagagatttctatctatcacctactattttcctcctcttcttactgtcctgggagattctatctactgtcacagctttcattattatcaataaactaatgagcaccaaatctctcttctgagccacagttccttataatcaacttcctgaagagcttcagtgggatattccatgagtacctctcaggcaacatatcacaaactgaactcactgtcaccatgatcagtcatttctcctagattccaggggtaaagacaccataaataaagtcatctagtataagataataaaaagtgatggggcttgtggcaaagtacacgcctgcctaaaggcatttaatgtaaattaaacatcacatcaatcaaacattacatctgcagccaagatgtggtatggtactttggttttcagttcctgctatatatcccatttaatgactccagtcactcagtgaggtacctgtgggtcaacttaaacttatcaactatagctaagtggttaccaattcctctttattctacttctgaaacaactccgaaatctgttctctccctgccacccccactcctcctcctcatgatttagatctttatcatcttctgcctaaactctaatcgcttcctttttaaattacaggctgcaagtcattcgtaaatggtgagaatgatttagtgggttacaaccagctttgaaaaaataaaacagaaaatgtcagaaagtgttctatataacatgggtaaatatttaagtgttgtgtgacacctttttaaatgcatgagctcacatctctgtattcctcttgatgcgatcagaagtttgaaagcaatcaatctaacagatttccctgcctataagcttatcacctccaacccactggctttacaacttctgtattgcttgaccatgctagtctttttcttgaaattttcagtgactctccactccccattgttaatattgtctaggctctttagaagaaaagcatagtcctccatgattgtacctttacctatgttatctcttgctgacacccctcaacagagcctgtattttggcagtcccattacatggagtttcccagaggtgcctgtttcactcttttctgcttttgaacagtatattccctctgcccaaaatgaaatttctccaattatctacatgatgaacactattcattgatcaacacccagtcttttttttctttttttttgagatggagtctcgccctgtcgcccaggttggagtacaatggcacgatctcggctcactgcaacctccacctcccgggttcaaacgattctcttgcctcagcctcctgagtagctgggattacaggtgcccgccaccacgcccagctaatttttgtatttttagtagagacggggtttcacatgttggccaggctggtctcgaactcctgacctcgtgatctgcccacattggcctcccaaagtgctgggattacaggtgtgagccagcgcactggcacaacacccaatcttaaataccatttttctaagatgccttccttgatcaagtccatctttgtccctaataagctgactactctctcatttctactgccacctgtgtagatttctattacagcacttatactccataatcaatgtatctactatgaaccaggctatgtgttttttaggctaaatgatatatatgttaaatcatttaattttcttataggcatcaggttaagcatcattctcttcattttgaagatgaagacctgtaattccagcactttgtgaggccaaagtgggtggattgcttaagttctgaattgaattcagaccaattgaattcttttctttttttttttttttgagacggagtcttgctctgtcgcctaggctagagtgcaatggtgtgatctcggctcaatgcaacctccgcctcctgggttcaaatgattgtcctgcttcagcctcccagtagctgggattacaggcatgcaccaccacgcctggctaatttttgtatttttagtacagctagggtttcaccatgttggccaggctggtctcgaactcctgacctcaagtgatccgcccaccttggcctcccaaagtgctgggattacaggtgtgagccaccacgcccggctgatttctatgtatctaaatgatttgagaattttgtaactttggttatagtaaaataatatttactcttttctagtgctttactaaatgtttctgtgaagatttctgtgcataagaaaactgctatgtttaaagaattactgaaagcaaaacataaaaaaaccttcacacaaataattagcttaatattaatacttattacttagaaaggaaatctcgataagtaaacctcacacataagaaaaaaaattgtttaaattctctgttaagagtaatttatagatctcagtcctacttacaacaatccagttcatctgacttgtcactgcaatccacattatgatcacacttcttgtgctttccaatgcactgaccattggcacagcggaactgatcaattaaacaaagcactggaaaaaaaacataaatagtttccttatttttaatatcatgtaaagtcaaactctggcaagaatcaaaaggtgccttctgaacacaaatgaaaaacaaattagacttttagctataacttaaatattattctctggagttccattggttgagagagagaaaaaagagtaggagaaaaaaatccagcaggaaatttcctaacattttttttttttttttttttttttttttgagacggagtcttgctctgtcgcccaggctggagtgcagtggcgcgatattggctcactgcaagctctgcttcccaggttcacgccattctcctgcctcagcctcccaagtagctgggactacaggcgtctgccaccaggcccggctaatttttttgtatttttagtagagatggggtttcaccgtgttagccaggatggtctctatctcctgacctcgtgatccgcccgcctcggcctcccaaagtgctgggattacaggcgtgagccaccacgcccggcttattctttacattaaattccctctttcactaaagaattctagagaacttggctgggttgtttttaccatgggaaaagttagtaagggaaagtgaagaatataaaatatgttagagcgtaattaataaatccactaattcagagctcattggaaacagggactatttttatatactgaaggcctaatatattttagtttcatttctcaattttcaaagcttattaatttgtataaatcttatgcatatggagtgaattaaaacaataatatggaacatggcactatgatcagaagtgatacagtcatatgtacttgaaaaaccccaactgacactaagccaagtaatactgaagtttaaacaactgaatgggaaaaaaggattgcatgctgaggcactgaagaattctggataccttcacagttcttctcatctgatttgtcctggcagtttgcatctccattgcatcggagggcaccatcaatacactgcccactggcacactggaactgggactctgagcatacaggacaattgagttcatcactgtggtcttcacattcagtaaacccatcgcaccgccaagccacagggatacagtcaatttcccccgtgaaacaagtaaactgctgaggagaacatgttggaggttcttcaaatgaacaaggagaaggggagtgacaaaaacacaatcatggtcacacagaagtacaaacacatacctgagtgaagctcatttaataattaacatacacaaaatactttataataaatatgatttataactatctcatctattcaaagaagaaataaaggttttcacattacttcctttacattcactataaacttttgcccgcaaaactataaggcaaaagttttttcatatcttgtaatccaaaacaggattgtaatatttgcaatccgttacagtctcacacaaaacctaggaataatcagtataattaccaaagactttaaagttagcctagcactcaaaagttttctagctctaagcttctcaaaggatagtccatgaacccttaggcgttcctgagacctctttcaggggacccactaggtaaaaactatttttataataacattaagatgtcattgcttttttttggctatctttgcactgatgctgcaaaagaaatagtgaataaaacttggtaccttagcagactcaggcaaatgacaacaaactttattagtaatcactgtactatacacagccacatgtgcacagtttaaacaaacacacaaaaagaccaatttcacttaagaatgttattgatgaatcaataaaaaattatattaaaatcaacccaagtgtatgcctctttaatagtctgatcaatcaaatggcaattatgcataaagctcatgttgcaaacctaagtgtggtagtttctaatgggaaagcatttgttttgagttgtaaatccaactcaaaatggaatgtcatttttacttgaaagaatgactgacaggtaaattatacagtagttatttacacttgtctgttagtgaattatctagagaacccataaccttatgatgtgaccataggtcagaaaaccctgtaactttacaacagagaatattgcagattacaggtgaacattttacatggggaattttagggattatttaataagagcctattatgtattcagcactatactatctatattgtatggagaattaaagtagataaaatatatccacgtccttaaagcagtttgaatttggttggggatagaaagaaactaataaacataaaacaaaggacactactttgaactgcatgtcatgcaaaccgtgtgatatagtttggatatttgtccctccaaatctcatgttgaaatgtaatccccaatgttggaagtgaggcctggtgggaagtgtttggatcatggggggtagatccctcatgccttggtgctatcctcctgatagtaaatgaattcttgggagagctggttgtttaaaagtgtgtggcactccctctagcctactctctctctcttgctccctcttttgccatgtgacctgcctgctcactcttcacccccgccatcaaagtttcctgaggcctatccagaagctgaacaatacagccggcagaaccatgagccaattaaactttttctttataagttacccagcctcaggtatttctttatagcaatgcaagaatggcctaatacacagttgtatacatctgtcaaaactcgttttaatacatacattaaaaataattgctaaatgtgcaagcaagaaaaaaggccctttaaaagatattttcaaactggaagatgagatccttgactcagttttatccatgttatcattaacataaagagaaatttttctaggatttgcctcaaagtaacactccagcaccctgatagggaaacacatgctattttttgggggggggggggggggagggtaaagtaaccataaaattgaccaatttaaccactttaaagtgcatagctcaatgacattaagtacattcacattattgtgcaatccctatttttaaaaatttcaagtaccagagcttaactctttgtacatatctgatttccctgactacgctgtatgctatctcaaagatcttcaaatcccctacggtccaagcacagtgcccatagctgctactgaatacatgcattatttattttttaaaaaacttatagttcgacgaataaaatttacttgtaatcccacccacccgatcaacaatttttatatgttgaatacatattctctttcaatatttgtttacagaaatatatattttatgtacttgtcattttggcaacatttttacatcaacttcatgattataacatttaatagctgtataaactcagttattttacttaataattttcacaccattagaaattcatttaaaaatttctgccactgtagataatagtatgatgtagtctttttccttcagttgaattaacttagaattatccccaaaaggaggatatctgaattaagggtatgaatactattgtggtgcctgataccatcatactataatttaacaatggaatgtatctatttgttaaacctgctaagtgattaaaccaattttactacaacagtatcactatactcagtgatatcttttaaaaaatcattttttactagataaagaagcaacaggaatttgctgatggatttgaacaaaagaatattctttccatcagacacattcccaacaatgacacataaacttagagaatctacaatttagtggagagagattacaggaggtagaattaattcatttttttaccttttgggagaggggggaggctactttaatattaggaagcatactcattcacaggctgaaaagtgtggtaatatatacgcagtgaaatactattcagtcaaaaaaagtaggaaatcctgtcatttgcaacaacacagatgaacctggaagtcatcctgttaagtgaaataagctaggcatagaaacacaaatactacatgatctcacacgtggagtgtaaaaaagtcaaagaaacagagtaaaatgatgattatgaggctgggcagggtggcagagaagaataacagaaaagcctagtacaatacaaatgaatggaacacacgcaaccaattaagttagtagacagagcaacttcaatgcctagtcatagaagtctaggcttaagatatggaatatgtttgcatttagggttgcacaagaaaattacaacatatttacctccacatgatagctcatcttgaagtagaaccaggtgcatggggcaagaacaccttgtagtaccatccccctttacaagacaaatatgtgaacagccaccattatcctgagcacaagggtgctgtcctgcaaagagaagaggtgaggatggggagaggagggggagtggagggggagagaagtgggagagaagagaaaaagggacaaccctgtcaaaactatttatgaaaatcaaatgtataatcagcttggactctttttttttacttttattattattattatggactttttttacttttatcattattattattattattattattattattttgagacagagtcttgctctgtagctcaggctggagtacagtggtgtgatcttggctcactgcaaactctgcttcccaggttcaagtgcttctcctgcctcagcctcccgagtagctgggattgcaggtgactgccgccatgcctggccaatttttccgtttttagtaaagatggaattttaccatggtggtcaggttggtccagcttggacttttatttccacacaatatgattcttcactcaatctctacacaacctacaagaaactacttctatctaaccactgtccttatatatttatatataaaatattttaagataatggtaaagctcatcttaatttttgtgaatatgaagaaatgtttactgaaactaaaaaattgctagggagaggccgggtgcggtggctcacgcctgtaatcctagcactttgggaggctgcggcaggtggattgcctgaactcaggagttcaagaccagcctgggcaacacagtgaaatcccgtctctactaaaatacaaaagaaattagctgggtgtggtggcatgcacctgtaatcccagctactcgggaggctgaggcataagaattgcttgaacctgggaggcggaggttacagtgagccaagatagtgccactgcactccagcctgggcggcagagcaagactccatctctacaaaaaacaacaacaaaaaattgctagggagaatgctgaaacttgagtattattctatttaaaatataagaattctcctatattaagatttttaactcagaaaatccgtatatctgaaagacaacttcagtcaaaaagtgtatcttaatgaggaatccattgagaattaaagagttattagaagaaaaaaacttaaaaggcacatgtaacagaacaattcagaaacaaaattatttggtcaactgcaaaaggtaacttgtaatactataaatgtctaacttcctcatacatgggctaagtaaagaaaccactaggcaacttttcaaagtctgtttcacaagttgtatttttaaagaatcattgtttggaattttctgtttagcctgtattaaaagcaacttgacatctgtcgtcacaaaatatgaacatctaatataagccaccatttattatttgactctcttccacaataacattggttctgcttcagtttgtgttgagactgagggagtcagctatctacaaatgagcatactgtccaaaacagacatcacacattatatagaatatacagtctatgtagcagtgtttctcaacctttaattccatgacatttttgataaaaatcccattctctttaatattagaaatttgaaaaaatgatttacctaatatacaatcatatttaaatagttattaaataaaacctctcccttgaaattctgaaaatcttgagattttctgtaataaaatattcatgtatcgactaaataaataacttaggtatgatatcattatcatatttctattaaatgttcagcctgagctacaagtcataccataaaatgacaacaatttttaactttctaattctcaattacttgtaactttacttctaaattcatgaactgtaccaacataatgaacacttgtacagggctactcctgtttcttcattctcctttcatgcttaaattcaatttaaaagcactgagctgagaagttacagaatttcaataattgtctctctcatactcaatttaacattggcatccccggtaccatcatgtatgatcaacagtagtgactgctaggaaggcactttttaaaaaacgttttgcatatataaactcatttattcctctctatgattagggtaattttgatgacagatatgaattaagaactaggccaagatgactagccattttcaaaaaaaaataagaaaatatttctggctacttttcttttttcctggggctcatggagatggctatttttctaagctgggaattgaaatatttatcccaaagggggggaaaaaaaccaagcacctactaattaaacagagtcttctctatgtttacacactaatttttagtttgttttgcctaagaataagattaacccattataactatattcatcattatataatttttactttttttcaagctatggggggaagtatagagagggaagaaaagaaatagatgctttatgttatcagtattcccaaaggaactgaaggagagaaaaacaaggcatgataagcagtcattgttgtaccaggaaatattcttttttaacaggcaagacccatgcctttcccccatttctggtttatgagattatgtttaatttggaaaagctcccgggtaaggttgacataaggctttaaaagcatgaagaggctgggtgtggtggatcacacctgtaatcccagcactttgggaggccaaggtgggcagatcacttcaagtcagaagttcgagatcagcctggacaacatggtgaaaccctgcttctactaaaaattaaaaaaaaaaaaaattagcgaggcatggtggcatgcacctgtaatcccagctactctggaggctgaggcatgagaatcacttgaacccgggaggcagaggctgcagtgagccaagatcgtgacactgcactccagcctgggcgacagagtgagactccgtctccaaaaaaaaaaaagcatggagagttcaaaaaaatggcaaaactaaaagtgcatgaaagtcttcaaggaaacagagtttaaaaatccacaaaagtacatattaatttattataacacatgattcctccaattagctttatcccattaacacttactgtattcttgaaggttcagctcctttactgcatgaatgtcactaagctgggcaattcgagcttggactttggttctaccctctcgacctgtcatgtcaattttttcaatcatttgctgctgtttatcaatccaatagagccagttttcaaacacagtaagtcccacaggctgcaagatattggagtcttctaatactatccggttagcaccttggaaaaggagaaaattcaacagaaatgactcatgtgggtcaagttatacttttggtaattatttactgactaccagttagattctacaggtagagaaaagaaaaaaaaaacaagatctctaccacaaaacttaaaaatcatggtaagacatacactagaaaacagccaataaactagatattaatatgcaatcaagagcaagtaagtgcccaatgtgcagtaaatattctagttcatagaaatgtagaaaagaacttagaacagtagtttgaaaaaccctaacttatatatacaacagataaaaatggcacttctctggaggagcagtggtggtggacccagagttctgagtatacctgaggcatttatgaagaacagcttcactctcaccccacctggcttctcagaacacaattagaaaaaatgactgactcaccccaaggtaagaattatttctaatcatctcagacatagagtcatccagactctgaggaggcaacttctgctattgttgcacagtgagaaagttcttttatacagtgggctaaaatctgtgttcataccccccaccctgctttattcagtttctccctcactcaaaaagaaaaaatatactcattccttctttttcataacagtccttcaaatatttatagaaagttcacggttcctaagtcatgagttcagtcaaacaaagacattagctgatattttggaagtatcaaggaaagtttcaggaaagaggcaagcaaaatgccaactttttaataaatgaagaaaagtggggagatattccagatgggaaggcattgcctgagtcaacattcagatggtaggctaagcacaagtttacttatatattctctcctaaaactctactaatatggtgattgaaaaaattttaggccgggtgcagtggcacacacctgtaatctcagtaatctgggaggctgaggcaggaggatcacgtgagcctaggagttcgacatcagcctgggcaacatggcaaaatgccatctctacaaaaaatataaaaattagccaggcatggtggcatgcgcctgtagtccaggtactcaggaggctgagatgggagaattccttgagccagggaggtcaaggctgtagtgagccaagttcacactgcactgcagcctgggtgacagagtgagaccctgtctcaggaaaaaaaaaagaaagaaagaaaaagaaaataattttgaaggtataaacccataaggacaaagaaggcagaagaacagaagagagcaggaaagtgatataaattttggaagctggagaatagatagaccagggataatgacacagtagcccagagaaagctaaaggcctacagccagtgaagctaacaatgaaattaattagctcagaaagtggaagcaccaggtattttagaatggaacaaaggtaggagttatgtggctggggctgaaagaggagtactaattgaaaatatgtgtaagaaattacacagcaatgttctcagtatttttaagcctcatactaaatacaaacagctaaggatcaccaaatatttaaagaaaacctctatctttaaatttgaagcccaagacaaacacaacaaaggaacttggagaaaaagacacaaaagcagaagaaaacaaataaataccaattaaaaaaaaaacaaaaaacctaaagaataggctgtcttcagaggggcagagcatttggagaacaaaaaagagcccttggaaattaaaaacatgatatccaaaaatttcaaagaaaaatgcaacaagagggttgggagacaaatttgagaagctctcctcagaaagtataacaaaaacacaaagagatggataataggtgagaaaaatacagctacagtcaagaaggttcagcataaaaataaaaagctccaaaataggaaaatgaaaaataaattatcaaagaaacaacacaagaaaacattccagaatttaaggtgtagacttctagacagaaaggatcaacctagtaaccagttcaatgagaaggaagggaaggggaagggaaagcacgagcatagattttaaaaatcttttttttttttttttgagacggagttttgctctttcgcccaggctagagtgcagtggctcaatctcgcctcactgcaaccttcaccttccggtttcacgtgattctcctgcctcagactcctgagtagctgggattactcgcacccgtcaccatgccaggctaatttttgtatttttagtagatatggggtttcaccatggtggccaggctggccttgaactcctgacctcatgatctgcccgcctcagcctccaaaagtgctgggattacaggcgtgagccactgcacctggccaattaaaaaaataaatcttaaaacaaaacattagcatatcaaatccagcaataaataaaaagaatgtaccatgctaaattttatttattccagcaaactgagaaaagaagttaaattccttaatttgacaaaggttatctacagaaaaaccttagcaaagaatacttaatcacaaagtattgaatgcttcccccaagctcaaggggaaaaggactagaaaggaagaagaagggaaagaaggggaaggagaaggggaaaagaagggaatgatgagaaaggggaagaggaaagggctgggggagggagagtggagagaaagaaaaaaggaaagaagggaggaatcaaacaaaggcacagtatcaaattctaggacattgaggggaaagaacatgttaaaagcttctggaggaaaaaggaaaaggacagcatacaaagactgaaatcacagtcacatcaaacttcccaatgacacaagatgctcaaagacaatggagttctattttcgaaattctgagagaaaacagctataaaacatgaaagcaaattatcaaccaagtgtgaggaggaaaaaaaattcaaacaagatcaagaattttaaccttttatgatgagcccctttcaagaagctgctagaaaatggtctctcttaagaaaaccagaagaaatggagtccaggaaatagcaggttcagcatctgtatactcccaggacaatggagaaatgaagttagcctagaaaccaagcaaatccagactgcagcaagatgatgaagaaacccagagatgtgattttaattatgaagacaaatagatggactgcttgatgcatatccatttattgaaacaatatttacattacacaagtattaactctgcagggaggaaaaaagttttagaaagaaatgtacctaacagtaatatgttcatagccataaataataagtaattaagtctagacttaaaaaaattatggcactagtcacaggtgggtcctttctatctgcaaacttgtgcctcgaattctggaaagttcataactatgctggggaggatggaaagaaaattcacacgtgtattttggcgacatatggtttaagatagcaaaatctttatcttccaaaggaagtcaatgtttaacgtctaaaagagaaaaatcaagaaatagcatttttaagcaagtttattttaaaataagtgaaaatagttgtgaatgcttctaagcatgggaactgagagcagcagagtagagcagtaggcttgttttttgttacaagccaggtagaacagtttgatatccataatatttacatgtattactttaatgaaaattaaaattaaacaataaagaagaatgatttttaaagattagctggcggtaatgaaaggatggtctgaggtagacaactgggtaaaaaaggaagtcaatagtgtcactgcaggcccccagatatggtaaggacctgatctactttgatgctggtgaaaaataagtaagctactggaaccaacaaggaaaagatatgcttatttattcaacaaactaagcatgcactggatgcaattcgctataaaaggctatgtgggtggctacaaatacgaaatagaaaaaggtcccaggatgaaagcataattatctgtgaatacgtaagaaaaaaaaaatcaacttgacagtaacctttttcagagaatagaaaaagaacaaacatttctttttatgtggccaacaaagccttgatggcaaaacaccaacaaatacctgacaagaaaagaaaattataaggtaatccttctcatgagcgtagattaaaaaaaatctcaaaacattagcaaatcaaatccagcaataaaaaaaagaataatatatcatgctagattttatttatcccagtaaactggggaaagtaagtaaattccttaatttgacaaaggttatctacagaaaaaccttagcaaagaatacttaatcacaaaagtactgaatgcttctccaagacctagaaaacaacaacaacaaaaaaggattctattatcatcctattcaacactgtactgggggaccccagccagtataaggaaagaaaaaaacacaactctcattatttgaagaaacatgattctataacataaaaaatcctaaagataagtatacttagcatggtcctgtggtacaagctaatatgctagaaggagaaaaaaagaaattgtatttccatattccaggcacaattagaaaataaaacattaagtttagaatagtctttaccactagcgtttaaaagcaccaaataagaaggaataacaactctaatgaaagataggcaagacctctatgctgaaaattataaaacattaagagaaattaaagatctaaataaacagggagatttaccatgatcatggtttagaagattaatattataaagataataattctctctaaactatcaatttaatgcaaacccaatgaacatcttagtatgtgattttttttggaaggggaaactcacaagctgattctacaatgtacatggaaattgcggtagttaacaatagccaaggtaatcctgaaaaaatactgaagacacagatgaatctattgcagttataataattgacagtataatataagtaaaggcaaagtgaccaagggaacatcagagtctagaaacaaacacacacaaatacagtcacctcatttatgaccaaggtgatactacagagtagtagggaaaggacagtctttccagtaaatgatgctgaatccaacagtaatgtggaaaaaaatgcattttaacccctgcctcacactacacaccaaaatcaattccagatggattacagatcccaataagaaaagttaaatgaagaaatttcagggaaaaaactaaagtatctttttgtacctttgcagaagacaaacatttctttcttttttcttattgctatacatttatgtggtacaagtttttttaacatggatatatactatgtatctatgatgtgtacaagtgtgaagtgtgagcttttagtgtaaaaccatagtgtacgttgtacgcattaagtaatttctcatccctcaactcccatgaagatttcttaaacaacataaaagatgttaaccgtaaaaagaaaattaataaactgtactacattaaaattaggacctttcttttcatctaaagatactactgggagaataaaaaaggtaaatcacaaactgggagatttatgcagtatatatcttgacaaaggattcatatctagaatgtacaaagaattcctatacaacaataaactttcaagttaccagttttgggttattttttgagacagggtctcggctttattggccaggctggagtgcagtggtgcaatcatgatcatggctcattgcagcagtgggacaaaattaattgtaatgaatgaaacattttcatgaagagctttatcacagacctgcctgccaggcatggtggctcatgcctgtaatcccagaactttgggaggccaaggcagggggatcacttgagcccaggagtttgagactagcctcagcaacacagcaagacccccatctctacaaaaataaaattagccgggtgtggtggtgtgtgcccatagtcctagctactcaggaagctgaggcaggaggactgtttgagctagggagtttgaggctgcagcaagctataatcacaccactgtactctagcctgggtgacagggcaaaaccctttctcaaacaaaaataaaaacaaaagatagtttaaaatattgacataagtaactaatgtacaaatgagaggtgatatccatggaatactatgcaaccataaaaaaggataagttcatgtcctttgcagagacatggatgaagctggaaaccatcattctcagcaaactatcacaaggacagaaaaccaaacaccacatgttctcactcacaggtgggaattaaacaatgagatcacttggacacagggtggggaacatcacacactggggcctgtcggggggtggggggctaggggagggatagcattaggagaaatacctaatgtaaattactagttaatgggtgcagcaaaccaacagggcacatgtatacctatgtatcaaacctgcacattgtgcacatgtatcctaaaacttataattaaaaaaaaaactgcaattacttttgcaccaacctaatacattcagattgcaacagaaggtgaattttggaaaaaacaattattcaaaagacataaatgcattaggtacccagaaaaaaaaattagaggtgatataagagacagaggagatcagatgagggaaagaatatactataccaggcgtgtaactatacatgcgtaagtgtgtgcctaactgtctggaatcagagaatacataatggaagggaggcatttgaacctgaagacattaaaaaaaatgtgaaaaaaagattaaaataattataaatgtattcaaacatacaaaaatgtacatgatacaggagtaagcagtctcaacattttagtatgctaatgctccagacttgagatatatttgcttatttcttgaggaaaatactgacatgtatgtctgtttcttttcccctctcctctctcccctccctccctccctccctcccccttctctctttccctctctctctttgttgaagaacctgagatctgaagatctgagatctgagatcccacatttcttttttctttttctttttttttttttttttttttgagacagtctcgttctcgttccataacccaggctggagtgcagtggcgccgtcttgactcactgcaaccaccgcctcccatgttcaagcgattctcctgcctcagcctgccgagtagctgagattacaggtgcccaccaccatgcttggctattttctgtatttttagtagagacagcattttgccatgttggccaggctggtctcaaactcctgacctcaggtgatccaccctcttcggcctctcaaagtgctgagattacaagcatgagccaccacacctggcctgagttcccacatttcttaacggtatatatacatacactgtgtatacacagtgtatatactatacggtttcaaattttaaacaaaactagatcttaagaatttttctgaaatttaatttttaaaaatcattcatgttagtgcacacagatctaccttattcttttgaatgactgtaatattccatacactgatagaatgtatttctccatgaaggactatcacaaataatgctcagcaaatacccttatacacttacatcggtctttctctaagacagctatctacaaaggaaatcaccagatcaaagggaatgcatattttaaattttgattattactggcaaattgtcctctaaaaaggctctatcaatttccacttccaccaaagcacatgagggcatgtaattttctaccatactggccaatgctaggcaataatcaacgttaacatatttttgccatgctgacagacacaaatagtatattttaatttcatttacctgatcactagggaggccaacacagactatatggacatcagaaattggggacagaggaggtaattataattacagacataagattgcagagaaatgtgaaagtaaaagtatatcttaagacgaacaaataatttaatttggttaaaataccagaaaggtaaacgccacgatgaggttgtgaaaggtgaatactaacttataccaacttaagagtacaactagacttttttcctacaggttatgaaactaccctgaagattttttaagtaaagcagtgacattaaaaccatgcttcagaaaatttaggagccatgtgtaaactttcatggagaaaaactggcagggagatcaaccagaggctaggatttggccacagatgacaagaacataaactagagcagaagagttaggaaaggatgcattagaaatgtattatttacgccgggcgcggtggcttacgcctgtaatcccagcactttgggaggccgaggcgggtggatcacaaggtcaggagatcgagaccatcctggctaacacggtgaaaccctgtctctactaaaaatagaaaaaattagctgggcgcagtggcaggtgcctgtagtcccagatactcaggaggctgaggcaggagaatggcgtgaacccgggaactgcattccagcctgggcgataaagcaagactccgtctcaaaaaaaaagaaatatattatttacagaaccaagatcaagaaaactggcaggtagttaagtaacagaggagtaatcatgttgacagttgaagaaaaagctcttcaccaaccaacctgatgctgactacatttaatgaataaaactgccaagaaatgtgccaaaaacaatacgatgcaagaaaaacacaatagatgaatcatcttaaaaactcaaattaaaataaggaaacatatttcttgggtacctgagagatcactgctttcaattcgccggagatctgaatcagcccaaaagagcttgcccagcctgctatcaagggctaaagcaattggtttacttaagccactgaaaaagaggacctcccgttctgtcccatccaaagcagcccgttcaattttaggagacctttcctgaagattggtaaaatacatatacctagagggaaaggaggaaaaaaataagttactggagtaagaaaccacataaaatgaggatattcttattaagacaaatggaggtagagtatttttaagtattgtttttaaaagttttaaaatacgtattttttgaccaggcacagtggctcatgcctgtaatctcagcactttgggagactgaggcgggggtattgcttaagcttatgagtgagagaccagcttgggcaacacagcaaaaccccatttctacaaaaaataccccaaaaattagccaggcatggtggcgtgtgcctgtagtcccagctacttggaaggctgaggtgggaggatcacttgagcccaggaggcagaggttgcagtgagctgagattgtgtcactgcactctagcctgggtgatcgagccaaaccttgtatccaaatatatatatatatatcctcttttatataaatatatatgtgtatatatatataaatcctcttttatataaataaatgtgtatagataaaaatccttttataaatatatacatatctatttatatatttacatttttaaaaggtcatgggacacttttactacttttaatagtagcaacaaaggtacacagaagttattagggagctttcatagattaacagaatagtgttagacataggcacacatatgttttcagaataatacgacaaattaaagatcagtgactagagagaccttaacacaaaattttaaattctttctaattaatctatttaataactaaaaagaagttacatataaatcacttcttatatttaacgtctagatttcatccttttcctctcttttgaagtaagctactttacttgctgaataccttatcattgactcagatacaactgattattgagtatttattaaatgcaaagctctttattaaatgaaagaaagcatactagttctcatcataaagaaaactgatgtctagtggtaaatacaagactaaaaaataattaaaagtaacgtaaattggaaaggactaagtataacttagagaggcacagatacagagtactgagtattcaggagggggcaaaaatcacatctggctgggatgaggtagatcgaggaaaacttcctggaggacgtggcagttgaaatggtcctggaggtgtggttaagacttagaattaaagcactagtggcccaggaaagaaagtctgggcagtgaaatcagagaaagtgtaagacaactgttaagataatgcagaaacaaactgatagagaatattgaattgtttgctggagcacaggacacttaaaggtaaataaataacaggctgaaaaagaagggtgaggagagtctcagaagccacagtatctgaacgccactttagtaacataccctttctctgggtttaccacaacggctcgaggtctgtcctgctcgcctttcagcaccactccaactgatctcccatctaatcttgtcacattaatgacattggtagcctcacaagtccagtagatgtagcggctgtaaatatcaatgctgaggtcatagggttgtatttccaggttctgactcggaactgagctcacaaccacagtaaagccctagggaaaaaaagaaatacagagaaaattaaactccaggggcagataaccctgaggcaatcagtcacaatgcttacacctacatgggcacacagctgagaaggctctctcaagtcttaaggagtatttcttactgatacctttttttatgggtaatgtgcttctttgttaatacacatctcaaatgttccttgggttatcctgctgctgaaaaaaagagctgaggtcagattagttgctccaagaacctgataatgccttgattaagagatgggagtgagaaggtggcaactatcttctctaaactggagacaactgtggctaaaaccacaccctagaaatatctctaaagcagcggattgcaactagaggcaatattgccccgccatgggcatttggcaatgtatgaagacattttttactgtcacgactgtgggaatacaactggtaactagcaggcagagaccagggatgctgttaaacatcctacaatattccgagcagccccccacaacaaacaattaatccagcccaaaacgaccacagtgcttgagaaaccctgctctagagataacagcaactagtaaaggctacaaatcaagtcatctccttttctgatcctcaagtctacacatgcaatttttttacaataaagtcaagcaaaaagagaggctttgtccatttgtgccatctgaactgtatcttactggtatctctgaagtaacatattccttaatttctatctattagttatcagcccatcagtcctggcctatatggtggaaagtgtgtctggaatacacagctattactataccctaaatgatctctcagcagccctaaatatattacctccttggtctttattttaagatgagacatagtgaaaaacggtactctaacttccctaaattttaatacattcaagatacaacttacgatcactgctatgaggatgacaacaagtaattatttatagtattataatcccagtctgacagggctcggccacagaaagcaagcaaagaagtatcgatagtgatgtgtaaatccataattggcatgtaaatgggtaagatttattgataatatcctcattcccatcccacagtcaccatataattatgaccaaaaaaacccactggattaataacatgttagatgtttttaaccctactgagattgtgttatatgtttcatatcctctgaaccttttaaataatagttaattagtaatgtaaccgttatttattgagttcctgttacataacacataagagctatgtgctttgcattcttttcagctaaaaaagttcctaagaatcctaagtgagggatagagctggaatcagaaccaaggcctatttcaaggcttctaatactccatacaatagaaatgtaaggaaaaagacttcataaagaaacgtagggggcagtcacaaagccattaccaacacaacagcttaagtacgcctaacaattttcatcataatatcatcatcaaacaattgcttactcaaaatatcgtcagaaggaaaaaataagctaccaggtccagaatttcagtttcatacacacatacacacacacttaagcagagtcaagacttaagtgaaacagagtggttggtgagtccagttattagtcaggagaaatgaattttgaaccaagctctcaattacctggctgccatcttcttgtgcctttcggatcatgttttgtcgtgagtcaatccaatagagttgcttgtccagtgggtcatagtcaatggcccggacattccgaaggctgtggatgggaaggatgatgtcggggctctgttgttcatcaatcaccatgcggttgatggcactcttttgactgaagagcaggaaagtcgtaggagcttaaaaggaagaaaagagaaaatctgaaatctagttaccctacatcctctatcatccaatgatttgatcagcctgttgtatgtatttcatacaaaacagacatagatgttgaagagctaaggctgaggacaaaattctttggcatgccctcaaaaactctcttcagagtaacactaatcagctctctggttaccaaatcagttatgaatttacctaatgacatagccacctaccctgtttttctccatcttgtccacagagataccacagaaaacttcatttccatcaggtatttgatatacaaaattctcctggtctaccaagtgaataacccttaacctattctgtctggtgggtggcaggaagcctgggcttttataaattaaagcagaaacttctagactgattttacacttgacagggcaagacccatctaaggaaaaaaaaaaaaaaaagaaggctgatttttagtctcagccttctcatttgatcttaagtcactgagcctctctaggccaaagtttactcagcggtaaaataaaagtcatagtcatcttgtccctctcactgagttgctacaagaattttacaacgtatatgaaaatactttagaaactgtaaggcactatataaatgtaaatttttaatgtttttaataacttaaaaattatttataaaaaattaatagagatggggtctcgccatgttgcccaagctggtctcgaactcctgggctcaagcaatcctcccaccttggcctcccaaactgctgggaatacaggcagagccactgtgcccacccataaatttaaaataattatttattaccagtagtggcagtaataaacttggtattaacaggcactgaaaccttaatggattgcagatactattttgttgtttatgtgaggacggcatggaaagagagcaggtaaaaattacaaaaataataatagatgctttatgatatggtttggctgtgtccccacccaaatctcaatttgaattgtactcccacaattctcatgtgttgtgggagggacccaggggcgggtaattgaatcatgggggccggtcttccccgtgctgttcccataatagtgaataagtctcatgagatctgaaggggttcccacttttgcttctttctcatttgtctcttgccaccgccaggaaagaagtcccttttgcctcccaccacaattctgaggcctccccagccatgtggaactgtaaattaaacctctttttgttcccagtttccaatatgtctttatcaaccgcatgaaaatgaactaatgcagtggtgcgatctcggctcactgcagcctccacctcccaggttcaagcgattctcctgcctcagcctcccaagtagctgggattacaggtgcccaccaccatgcccagctaatttttttaattttagtagagacagggtttcaccatgctggtcaggctggtctcgaactcctgacctcgtgatccacccacctcagcctcccaaagtgctgggtttgcagatgtgagccaccatgcctggccaagaatgacttctgggagactaccaacaacttcaaagtctaaggccattttttaaatcttcattaaaatatctgtatacatttcataattatactctattttcttagtgcttagacatcacctaaatacaggagaattttgtccttctcaggaatataaaacataaatagccaagccacgactccttgctttatttcctcctattccccattcttcacagctccattatttgtggtctctcagcttattttacatttacactcaaatgaatactggcttaaatcccaaaggaaatcagtactcacaaagaaacttgttatctacaaaactgcaattctgctttaagttcttcattagttaaaaacccacactcagcttggaagatttagaaagttatcccaatgatcctactacaaatctccatttctggagtccatcatactaatacattgatttaacaacttttagcaatttttgtggagtccatacttcgagtagtaaaaacacatcacacagaatagctaaaaagtctcccactatcatttttattttaaaagaattatattttggcagtactactttcttagtaaagcaagaaaaaaatttttaaaggttctaaattggctgggcacagtggttcatgcctgtaatactagccctttgggaggctgaggcagtaggatcacttgaggctgggagttcaagaccagcctgaacaacccagcaagacccccttctgtttaaaagacttagaagaaagatcccagagttttagttcccatattttcttgcctgggaagcaattaatcaaatatatatttggctcctaggatattttgctgggtactctcttttccaagcaaaattttaaccttcaataagattccacaattagttgtggatcttgttgttctagaaatgcagattaagagaaagccatatgtggctccaaataaatacctgctccaaaaagtctactcaaatatattaaaaattacaaattaactggttatttctaaaaggcagctaatattttgacctattttcaagtcagtgtttaaaatgacaaagaatatgccattttaaaagcctaaatccaccctatcaaatttattaaactctaaccacctctctcacatttccttcagaatggtgctttaacaacgacctcatctggttgtcttgagtctcgcattcccacaatggagacatcagagaagctggaggatgagatgtacgtaggagggagcttttcagttctcttctgaaggcatatgtgttcactggtagcttagacaaaggtgttgctcttgtttaagaatagaataaactataaggccaagaccatcatgtatgactgtaccatttgtgctctgtgccaggggcattgagtaggaactgaaatccagtccacacttccttagccacgccatacacctgtagggctaaatctgctcagaggaaacatctttttccaatttgcacaaagatgccacagaggccacttcagtactgaataaaggattacacaatctggcttcccatttcctctctgatctaatttctttattcacttcattccagcaacactagcttcctaggtgttcctctaacatgtcggacatgttcccccaagaccttttgcatttactatccccttttgcttgataggccttctcccagtatccgcatagctcatttcctcacttccttcagttcttgacataaatgtcattttttcagtaagaacttccctaatcaccccagttaacactgcagtccctgtcaccatcaccctttcttgctctttatatttcttcattatacttattgccacctaacccctgacataatttatttagtttattatctgttccactgaatttcattcactgctatgttttccaacggctgaagtaatgcgcagcatgtaataggtgcttgataaataaacactcattacaataatatatgaagaaacaaagaaacaagcaatagagcctagcgcagtggcatgtgctcgtagttccagcaactcggaagattgaggtgggaggactgcttgagcccaggagttcaagtctaacctgggcaacacagtaagacctgatctcttaaaaagagggaaaaaagccagaaagaagcactgagtgacaaggagagccttgtagctatgattttgaaagtaagaaaataaaatttgagacgaggaaaggaaaagaaaaatttatttaggacctccaatatattacatatcatactaaatgttatttaatccacaaaattatctctattttataggcgagtgcgctgaggatctgaaaggttaggccaggcgtagtggctcatgcctgtaatcccagcatcttgggaggccaaggctggtggatcacctgaggtcaggagttcaagaccagcctggccaacatggtgaaatcccgtctccactaaaaacacaaaaattagccaggcaccgtgatgcacgcctgtaaactcagctactcaggaggctaagacaggagaatcacttgaacctgggaggcggatgttgcagtgagccaagatcacgccactttactccagcctgggtgacagtgtgagactctgtctcaaacaaacaaacaaacaaacaaaaagtctttcagccagaactgccatcttccagtaatttgccaaaatgatgaacacaaagggaaagaggagaggcacccgatacgtgttctctaggccttttagaaagcatggagttgttcctttggccacctatatgcaaatctgtaagaaaggtgatattgtagacatcaagggaatgggtactgttcaaaaggaatgccccacaagtgttaccactgcaaaactggaagggtctacaatgttacccagcatgctgttggcattgttgtaaacaaaaaagttaagggcaagattcttgccaacagaattaatatgcatattcagcacgttaagcacgctaagagccgagatagcttcctaaaggaagctatcagaaaatggaaagttatcagaaaaagaaggaaaatgatcagaaaaagaaagaagccaaagagaaaggtacctgggttcaactgaagcgccagcctgctccacccagagaagcatattttgtgagaaccagtgggaaggagcctgagctgctggaacctattccctatgaattcatggcataataggtgttaaaaaaataaaagacttctggactgttaaaaaaaaaaaaaaggttaaataattttcccaaggtcacaaagctgttgggtaaaacagcgtatgtgtttttccaagccttgccttgtttcttcattcatttatttaacaataatttcttgagtatctaccacagactaagtgttattctaaggcacataagatatgtcaatgaagaaaacagaaaaaaaattgttgcttcatggagtttatattccaacagacaataagcaacaaatataataaagaaggaagtgacataaatagtagagtatataaattacataatacataaagaggtgaaagtgctatgggaaaaagaaaagaaaaagtacagataaggggcactggcacgttggatagaatggcagcataattttaattttaaatagcatagaccaggtgtcactatgaaggaaacaattaagcaaagacttggacgtgaagggtatccacgcaaatatatgcaataacactccaagcagagtaaacaagcagttcaacagtcatgaagcgggagtacccggcctagctgaaaccagcaacgaggccagtgtggctgtaatgaagaaagcaagagagacaagagtaaaagctgaggttagagaagaaaactgagtggtggggagtgagagtgaagaaggggttatgaaatgtggggtataggtcatgtaggacccagtaggccattataagaactaggtttttattctgtgtgaaatgagaagccaaacttctcaaaagagatgtctatatatgtcactatcgtttccttttttccattcacgttttaatgtactgcattctgcatttcaccattacttccctgaaattactctcttcagggttaataaccactttacccaaaaatccagtgtatgctattttagacctccccttactcattcaacagagttcatttttgaaacaacctaatctctgtcttcgtgcctctattctctcccgcttttcctcttacctctctggttgctacttctcagtgttctctgtgaacttctcttcctcaaccagagttgcatagtttaccaagtgccttcttttctctccatcagagttagcccactgatgggggttatggcccacaagttaaatctggcctgctgcctgtttctgtaataaagttttactggaattcagccacttccatttttaaaatgtattgcctgaggctgctctcacactgccatggcgagagctgggcagagttcagcaggtgtgagacagcctaaacacccacaaagcctatgagagaaagctgctggctcttgaactataccttctctttaggtaacctcattcattttaaatacatcctggtaatcccaaaatttgtatcttcaacctcatgtctcttctccgatgatagtccatcatctatgacacataatctagaggtcatccttgcttcctccctttctttcccacacagaactcattaacaacttctgcttgctctagcttccacatacatctcgaatccatcaacctctcttcaacacacacgctgctgccaccaccattgtccaggtctacctgcattaccacactggtctaactgacttccctgctactggttctccccagaaatcagaccatgtattatctttaatcttcataacaaccctatacagcaattactattattattccaattttacaaatgagaaaaaataaaggcttaaagaatttattacttgtgtaaagcaaaaaagctaatgtgtggcagagattccaaagtataacctcttaatcattccactacatgcttgtgtcctttctctttcacaactgaagttggcatcagaacagaccaaatttttcctatgggaattctgacacattctctcaagcacaaaagaaagtcatgtcaatagttaattacctctaatatccttagcagtttgttactttccatcatattgacccaaaccctacacccctcccataatctactctttctgatttaatctacttatttcttaatcgtatctaccaatttgttcttgtctatccaccaagaaatgggccttcatatatatttaagttataagccaggtttcccctagccaacaatgttttgttacacactttgttgttagtgttatgtgtgtacttgccggtatttaaaaatcaggagatgagggagtcacacacacaaaaaaatctagattcaggaccaaatgaaaagatctggtaacatcagcttcagttaaactgcaactgcctactatgttcattgcatgttctctttagtttctcatcaactgttactttatactgggttacatgttctcatacgcgttttctgtatggcctgttaaacatttaaattttttatgactgtcctactctttgcacttcaaaggacaagtaagttgtgttttgcgattcactgttttactgtttgtaatgttcttcccttcctttacaataaatatgatgcatgaaactatgcaacttttacacttaatatttaatgtccaagggtaaaagacttaatttttcctttttttttgaagaaagaatctctctgtgtcacccaggctggaatgcagtggtgccaccatagctcactgcagcctcaatctcctggggccaagtgatcatcctacttcaccctcctgagtaggtgggactacaaatgcacaccattactctggctaatttttttattttttgtagaggcaaggtctcgctatattgcctaggctggtcttgaactcctgagctgaagcattcctcccacctcagcttcccaaagtgctgggttacggacataagacaatggaccagcataagacttaatttttctataacatcaaattgctatcatcaaacaagtaataagtaacaaacacttgcattcccctaccctttaaccaaacaaataaccccctctggatttccacactatttaactttagaaaaaacacacactaaagtactttgaaaatgctgctttctctcattctagcttgctttggagggaaatgcagcttaccactacaagtcctgttgtcagcattaagagagtagtgggcagggcatccacaaacaaaacccccaactggcacagccaagcagaggtgggagcagtgcccattgctggaagcacattcattccaccctgactgtcgagatgagtgaaagacgaggatgtccatcacataatccaaatggccctgaatgatggtgcggttttggccactggttttgttggcacgctcaatgctgcgtcggctccagtccgtccagtagatataatcttggtactgagttaagccaaaaggatgaggcaagtcatctgctataacttcacggttgagccctattttcagaaaggcagtagacaggggagaagcagagtgatgaaatatgtgagaatacaagtgtcttgctggcaaaaagaaaaaaaaaagccctaacatataaaacattacattgtaagcaatttaaaatagaaaaattcatttaaaagcaattctaaaacgagaccaattctctgaaatcaatctatcttctgaccccatgcttcaaacttatattcctgctacaaatcactcagtttcctaaaattcttgcaaatggtctactttaaatgtggttttattttctctatataagggtctacagttcactttttcttcttgaactatagaaggaaaagatggaaatatatatattttactggtacaaaagtcatttcaggagtatctagggagttataaatttcattacaagtccaataataatgaaactttcacataataaaaagatgaatccaagtacctggatcactattaataacaaacaggatacaattccagaacagaagaagaatggacacattcatatgaagttgtattaaaagtatctaaccaatgataaatagcagccactgatatttgcatggaaagaatatactgtttgagtaaaaagtagtaaagcttaccaagcatatttgaagattctattaagttggtgtccaggtctgtccaataaagcctccttttagcataatcaatagttaggccgtttgcccgccccacatttggaactaaggtagtacgttcacttccatccattgcagctctgtctatcttaggttttccaccccattcagtccaatacataaatctaaattcaaaataataaatatttaacatttcaattttttattatctgggggaaagagtcatattcatgcaaagtaactaaataaatttaaagaaaacatacagcaaatcaaggaaatgggttaaacaaaatcacggctacaatgctttcaattattttggcaccctaaactaaatatttttttccatatcccaaaaaggaagtgagtcagctttccttagtctttccaatacatttgttccatccaaacctaggaattggaaataaaccaacagtttattgcagtactggcatttgtaaaattaacattcaagaaaacagcaaaggtttaaagctctggtctcagaatctggttcacttctgagtaaaatatttttatatacttttgaatattaactaatttgagtttttaatatgctgaacttactttttgacttgtgtaatcaactcttcctcaaaataagttgcagaagtacatgaaaggtaattataaatactaagcctttaactgaagtcaaaagcaaagcttgaaaatgtatttggtcatatggtccaagggagcatactatatggtaagaacaacgactcaccccttgatgtgtccactgggcaatgaacactacactacgctacaacaatctctgtgaaattttagaataattactttgctgttattttccatttttgagttttgcactttaatcttacagtaatcctacagtataggctttttatagatgaagagcccaaaacactacaagaaatgtgaacaacttatctaatgtcttcaagccagttagatgacagagctagaactagaacctaatccttggccaaatgccctttcaagtaaactagtgaggtgctagtttttgagactcttgaatactggaactaaaaaagcacatcacatgccagctctcacgaaatacctgaggacatatattcactcatcagcctgtcagctgatagctgacttggtagcaatgtatgaacatgcttttctgaaaactgaaggtgtcctgcctttatatgcatttgcacttgtcatttgacaggcatgtgcacaccacaagagccaaagagaaacaactgtgagagaaatttcatacttgccagcagcaaccaattagtcccaactattaaatttatctgtctggcagctaatgtttagagcaaagatcaccacaatatgtcagtgctgactagatgaattactagctaatcatggaatcaatgtcacttcagggaaattattttaagtagcaaatacagtaaacatatttatatgttcacactgtttacttctttttttttttccaagatggagtcttgctctgttgcccagggtggagtgcagtggcacgatctcggctcactgcaacctccacctcccagattcaaacaattttcctgctttagcctccagagtagctgggactacagacacatgccaccatgcctggctaatttttttttatctttagtagttacggggtttcaccatgttggccaggctggtctcgaactcctgaccttgtgatctgcccacgcctcggcctcccaaagttgctgggattacaagcgtgagccaccacgcccggcctgttgacttcttttataagtggaatttttctttagatttcagatttcttagctgccggctttaaaaaatttgctgactcttgtaaaaaggaacactcgcccttgaaaaacatcatgttgtgaacagtttattctatcttgtaataacaaagctactgccagtttataataatgatcaaaccaaactatccattttgaattaataaatactccaaaataaagctttttaaatgtagttttttcttagctcacaacattgtttcggtgggtttacttcaataggcttggaatctagtataactgggaaggagtgcaagcaactacagatggataatacctcttggtatatatacttaacatatcagtatactcatcagtaacatttattaacccattcccctctttcttcacctaaagttaattacgacaagagtaaaattagctaataattattcattcaaatcagcaaaatatcaatagtgtttttaaaagttcatctatcatttagttctcagattcctaatacgtattatttaaaacattaagaatatcatctgtaactatgccatgttccccgaaatgtacactgcagttgcaaagaatgcacatgtaaagctgtttacccttcggcagggtccaacgcgagagctctgggactatctaggtctttccacaccaaaacttgtcggtgctgcccatccaactttgacacctcaattcgattcgttcctgtgtctgcccagtacaagttcttcccaagccagtctactgccatgccttctggataatctaagccgaattctaccacatgttccagtgcactgccattcataaaggctctgctgatggtctgcaaaagaacattaacaactaagtcatatggcataagtctaaaccctatccagaaagaaggtttggtttggtttttgtcaggggcaagaggatccagaagtgccaagaggcatactatttcctattaaaattcacataacttgcaagcacagaaaaatttgatgtcaatctctaataaatgcaacttcaagttttactgccaattcaggggagaaattttaaaactctaatgcaccaaaaatttattctactaacagcagaatgactttacttttaaaatttatcagtaatcaagtggaaaagctgtgaccacaatgctacagatcttaattagtggtcaattttctaaaggtgcttaagattatggcaagtcatcatgcctaccatataaatgaatgtaaccattatactaccattatagcactgagtcccataacacttttaaaaatcataattcaaactaataatagatacatcttatcaagtattatcctaagtacgttttgtccgtagattttgtcacttaatacaacagtcctgcaagtatggcatcacccctattttatgtttttgagacagagtctcactctgtcacccaggctggagtgcagtggcatgatctcggctcactgcaacttctgcctcccaggttcaagtgattctcgtgcctcagtttcccgagtagctgggattacaggtatgcgccaccatgaccagctaatttttgtatttttagtagagacggggttttgtcatgttggccaggctgttctcaaactcgtgacctcaggtgatccatgtgcctcagcctcccaaagtgctgggatttacaggcctgagtcaccgcacccagccaccccccattttcaagatgaggaaatttagaacatcacccaatgcaaaccaaaatttatttatttcatttattcacttaataaatttaactgaacaccattagaatccaactctgactccaacaccccatgttttcgcatattacaaaaaagtttacatgagttatctgaaacaagcccaaaacaatctggaagaagaaaagattattcttcagatttataggttgggagcttcctctctggctatcctggtattcttttcagtaactattctaggaagaagaaaataaagaataactcattgttggccttttccgcctcagtcaggccctaaaattttgtttaaagtaaatcacgaatttttttttaaagtaaatcaacagccattttacgtgaagcacacatttccttactcagctaattgcagaaaatgtcattcatcattttcaaatggaagaaagtagaggaagactatggcttgcagatttaaaacactctggcaaagtatctgtattaaaaagcatctaataaaatactgaatgggcctttcccttcacttaaaaacttaagggttttggctgggcgcggtggctcacgcctgtaatcccagcactttgggaggacgaagcgggcggatcacgaggtcaagagttcgagcggcctggccaacatggtgaaaccccgtcactactaaaaatacaaaaattagctgggcgtcgtggcacgcacctgtagtcctagctgctcgggaggctgaagcaggagaatcgcttgaacctgggaggcaggggttgcagtgagccgagactgcaccactgcactccagcctgggtgacagagcaagacaccgtttaaaaaaaaaaaaaaaaacttgagggtttttgttgaactctgcctgtcaaacaatgagggaggtgggtcacagcatgaagattcagaaattctagaagttctcccttttagtccctagctttaatattccaattcttttgctaaccttgagtgatatatcagtccaataaattcggttgtctgtcacatcaaaatccaaagcagaagcttctttgacaccagtgagtggaatagccacattattattgtttgtttccagagaaattcgtctgatatctgctctccgtgaaaacaaaaggaaagcctctgggacaatgcaggtcttcatgtcactgatgagttcaaagccaatagggcaagcacagcgaaggccctgaggtctatagaggcagagatggctacatcccccgttttcctcagcacaggggttggaacctaaaagattaattataaaaggggcacagaaggacacacacattgatacattcaacatattttcacttttaaattacttaagcgtttggttcacaaatgcctatgattatgtcttgctcccaatctcaagtttcaattctaatatcacaaacaagtaatatgcagattaatagggagtaaaagcatggtgaagtattttcctttaataccacagtaagctttaaagtaaggtatattattcatactatcagactgaattcttttgatgaaggtgtgcctgtgcatgtgtattcagcccttcaattcaaactgggtagctagagtagtaagtcaacgtttaaaaggtcccttctcagtaaaaaaaaaaaaaaaaaaaaaaaaaaaaaaaaaaaaggcgggggggcagtaaagaaggtttcaaaattgcctcaaaacatcaataatttacactgctgactatctccatcttttttcattcctggttcccatttctaagaaagctttggagttactcaccaatcactcgatgaacatttgtagcctttaggcccatgaggtcaggcagctgatctatgatcacttccctctctgcacttcgtttatgaactctttcaatgctacgcctctgccagtcagtccagtaaacatagtcacccaacaaagtaaatccaaatatgtgaggaattttgtcttccactagtactcgtctcccagtgccatcagtattcataaccttcaggtttaaattcaaaagagaaggggatgaattatgcatttattcttcagctaaaaataacaaatccaactgcctgttgtataaaaatccaagagtcatcttggtattcctattacaatgctttctcaaaattacatgatgattttataaaaatgatttcaaattttccatataagcctctatttgaccacttttccccccaatctcatattactcttccttctaaaaattctggcaactttagattatgcaactcttctattaaacaattgtggcaaaattaaaaatacagtatcatcaccttaagtttgcacatttgttttcaaattataatgtaccttcatatacattattttatcatatattttgttttataacatcttttattttatcttgagagctttgcctatggaaactgagattcatgtaaggtcacagagcttgtaaacacagttgatgtctttttcaggactttttccacttagcatgctttttattttgttgttgttgtcagtaacaacaaaaaacagataaaagggatctcaataaatctctcattcctctgagattataatcacaaaagtatcgggattatatgacaccctctctgcatctaagtttcaagaaactaggatgtaccttctctttccaactacctaatagtaacattattaaattcactctggcattcatactgtattcacagtgcattcaccatgcactattcagtgttgacttacttgggatacctttattgacataatataactaatatttgatatttacatataagattatatctgataccttttttgggggggtaggagcagatattgttcacatgtacatgtttttagtatgaaataacatttctaaaggctaatttgcccagcacgcaggcccctttaagtgacagaaatggtctcaggtagggacttgaacactgggactctggaaggcttgctgcatctttcagaacagaacaaggtcttctcagtttctactgcagcatttccaattgcatttccaggaacatgtactgctacctcatctaaaaggtcatatacttaacagtgaacctatgtcctgcattagggagagttcaatcattctattagggagcacccaacacagagtgataaatattctgtattatacaatacaaaaatattactttcttataagtttgtggtatgttaaaatatgcctgattcggttttattcttagatttaattctatcttattttgcattatcttacatttaataaattacgctaattttgctgatctttacattcaaatgttggctttcctattaaaatttgctggtgtaaaagcataaactagatgcccaatattaaacttttaaagaataacacttatatttctacttctattatgagatcaacaaaatcttttctctttcagctatatcactttccaacatttttgtttattttgataaataaatagcttaaacaaaagatggatgattaagtatgaattaggaaaatgaggctgggtatggtggctcatgcctataatcccagcactttggaaggccaaggcaggaggagcacttaagccttgggtttcaagaccagcctggacaaaatggcaaggccctgtctctacaaaaataccaaaaaattagtcaagcatggtgtggtaagcctgtagtcctagctactagggaggctaaagcaggcagattgcttgagcccaggagtttgaggctgcagtgagctataatcaagccactgtactccagcctaagtaactccagcctaggaaaaaaatctttaaaaagacagaaaataggtaagaatgaaattaaaaatcattgtgagaaaaataataaatgccacaattctaagacctttttagtaaacataattctgcatcttctatttaccagtttcccttcattcttctgttctctaaaaaatttctcatgatcagcaaacagtattgtggcagaaagagatttgtatttcaaatataagctttatcactcagtgggtacctttaagcaagtctcacaaataaaatagggacagcagtccaggcgcggtggctcacgcctgtaatcccagcattttgggaggccgagacgggtgggtcacgaggtcaagagatggagacaatcctggccaacatggtgaaaccccgtctctactaaaaatacaaaaaatttgctgggcgtggtggcgcacacctgtagtcccagctactcgggaggctgaggcaggagaatcgcttgaacccaggaggcagaggttgcagtgtgccgagatcgcgccactgcactccaacctggcaacaaagtgagactctgtctcaaaaaaaaaaaaagggacagcgccactgccatcactgaattagttaaggatcaaataaaataatgctaaatatatagcacagtattaggtgcactatctggtaaacactggttcctgtcctttaaaaatcattttattaaaatgctttagttcctaaatgtaaacagctaaatgattgtatttaattatttaatgtagtgcttcaaaataaaaatacataaatataaaagaatatatgaaaataaaagaccaaaacaaccactcactgttaaactgaagacaaaaaccaagagacctttatgtatcctgaaaccagtgggaaactacacagctacagcctcccatttcctactcccatttttattgtttacttttgctagttagatataaagtaactaaaacagtaaacaaaaaagaacaaatatttgacaatttcatatgagtacacttttgctgctctgccagacccctaactcacctccccgcaaatcaaacaacattagtaaagacatctagtaaatgcaaaccaccatgatagacctgatgaatgctgagaagtttagaacagggcctcttccagctaatgtattacaatctaattggggaggtaaacgatatttacattaaaattacacacatatcccctctctgtaagtaatcaggaaaaacttcaggaaataatagcagttgaaattcatcttgaagaattagaattttgacaaagaaaaagagaaacagattttctagaaaaaaagaaatgagttaagacacagcaaagccaaggatgcacacgacatgtttgactttgaaagaaatgccttgactgagatagaacgaacacatgggggactcaaaggatacagcatcaagcagataccaccctatggcaggtattaaattccaggataaggagaattacagaaagcaagaaggttctgaaagcactttaagcagggtgacacaataaacccatgtttcagaaacacttcatttatctctgtcaccctgttcagcttgtgttaaagataaatatcttattttaaatgtagaattatgaaaaaaataaataaaccaatatagaattatggttagcaaaatattttcaatttctgtgagatggcaagagaggtccaaaatcccttatctaaagtcagggtcagttgtattcctgaattcagactgtttttgtctttttgtttttttttaaagaaaggttaacacaatgcacatagcatatcacctctacttgggttcagggcagcactatttatagccaaacatgttaatatttctgcaataaaacacggccaggcgcagtggttcacacctgtaatcccagcactttgggaggccaaggcaggaggaccatttgaggtcaggagttcgagactagcctgacaaacatggtgaaaccctgtctctactaaaaatagaaaaattagccgggagtggtggctaacgcctgtaatcccagctacttgggagggtgaggcaggaaagttgcttaaacccgggaggcagaggttgcagtgagccaagatcgcaccattgcactccagcctgggcaacaagagcaaactctgcctcaaaatgataataataataataataataataaataaaagtatgcccgcagtgtgggacagactacaaatagtctcacactggttcagatcaagttttccaccaaatcaattaacaaaagcagcatttggttttcagagccctttggatttcagaattgcagataaaggattatagatcagaaatactttgctcatcttcacttcagtcccttgagaaaactggggtttggatcagtgttaatactgctctagatacaagcaagggtctcaggaagaagagagcaaagcaaacaatgaaaagaaaaaggtcttcagcaacatttgctgaaaggacaacaaatgaagaccacgatcaaagtattaacaagctcaacaaaggtattaacaatgaaggtattaagaatggcacagtggcgaagaactcaaaatagttcctgagaaggcacaactaatgatttggttgctttactcacttgagcactagtcccttccaaccattccttgttctctcactcgaaaagcaaaaactaaaaggtctttttttggtaatgacgtaaatacaaaagcaagatctatcaattcatgtctatttcaagttaagcaatgtaattaagatttattaaagatttttttaaaaccacgttttgtaagcacactgtttcctttaattcctgatctccttgttctcatctggtgtagtttttacaataggtttggatctaaaacagcactgtccaggagaaatataacacaagccaccaatgtaggccgtatgtgtccatttaaaattttctagtagtcatattaaaaagtacaaaacatgccaggagaatgttttcgctcacacctgtaatcctagcactttgggagtccaaggcgggtggatcacttgaggccaggagttcaagaccagcctggccaacatggtgaagccccctctctactgaaaatacaaaaatgagccaggtgtggagatgcacacctgtaatcccagctagtcggtaggctgaggcagaattgcttgaacctgagaggcagaggttgcagtgagctgacaccgcaccactgcacttcagtctgggtgaaagaatgagactcatctcaaaaacagtataaaacagtagacagaattttaatagtatactttatttaatctaacacatccaaaattcttttctctcaacctgtaatcaatattaaaattttattaatgacatttatggttttttttttaatactaggtctcttagaatgtgttttacaattaaagtacatcctaattcaacctaggcacattttaagttctgcagagccacatgtaattagtggctacatattgcactgtgctggattagagtcttcagagtggtgactacatacagcctataataaaattaattggttccttttttagtttacatcactgtcccctctatacctgtcaccttcaggcttacctcagatcgatcaggctcactaaagcttcaaacaaatgtcttttatttggtctttctttcttccaagctatatactatttaattctaatatgaagttaaaattacttcacacacacacacacacacacacacacacacacacacacacgtcttagatgaaaaaaactactttttttcttcttgtcacatttgcaagtttacatataaaacactagctaagaggttagttagaaggagcaacaaagacctgattctttcatttattttaggctatgtcaaaaaggaagtattaagaccatagatatattattagaaaacccatttctgccatctccttagccctcctgcttaagacacgctgcagtctagatcagccatgtactaacaatggttaaaactaggtagttcatggtcgtctctactctgctttctatactctgacattttccataatttttaaaaaatgaagagaaaaagctaagaagcaagtccaaggacacacaaataataatgatgatgataactgctgttattaataaatgctattattggccgagcgcggtggctcacgcctgtaatcccagcactttgggaggccaaggagggcggatcaccaggtcaggagatcaagaccatcctggctaacatggtgaaactccatctctactaaaaacacacacacaaaaaactagccaggcgtggtggcgggtgcccgtagtcccagctactcaggaggttgaggcaggaggatggcgtgaacccgggaggtggagcttgcagtgcaccgagactgtgccactgcactccagcctgggcgacagagtgaaactcagtctcaaaaaaaaataaaataaataaataaataaataaataaataaataaataaacgctattatcatttttgttagtatggtatagaaaggaattataaggatcctccgaagagattaagggatcaccagcttaaacaatatctgactgtgagactttgcatctaaacacacagataatgtattttccttcacacaaagtccaatttctgaaatgtttccttccattacttttgtagaggtgacactattagaaaactgacttctccactaagtatttctcttgtaccagccacacaatctttttctaccgggcacaagttaaccatagtgaaataagaacatgttgctctgtcttaaagaaatcactattccatttctcatattcctgtaaaagttttggacaggttactaggtctataaatacagtttaagctccttatgtttaaaataacacaaatcctggcaaaagcttgtttgtatattctgaacccagaacaaatgaaccactttaggcaattccaaaagattacacttatgctttaaaaactgtgccaatgttaattaaatctgacaactcttaagggtgtacttcactgtattacctcagagtggtttaattagttaaactgaaattaggcttctgtcacttctaaaatctaactccaaatctgaaccagagtctccagtggtttcagctgctttgaccacactgtggcacattggtttaacattctgaaatattctaaaccacactgagaatataggctacaagaggaaatagacgtgggttaaccataacattatctgcacaaagaagaagtaatggcaaatcttctacagacatcacatccagtttttgagtcatttcatcagctcattaaatgtcaagacaggactgcccatgcaatcttggaatgcagccagtctactaccaaaattgctgctatgcaacttcacttgacaagacaagttcaaggaacagatgcaggaggacaaccaagcaaccaccataaaatgtgctagagttggaatgctataaagttctagaagagaaactcaaattatgcccaaaatgaaccactcctcttctaatgttccagacaatatccaaaacaagcagtgaattaaaagcttatacataaggaagacagatatgactgagggttggggagcatattttttctgatacaacttcatagaacataaaatataatttcacacaaatgggattttaaaacacagaatatttatccacggaaataacatttcaatcatgccaaatctcactgagatgacaagtataaagaaatgctttggacccagtaggtgaagtaaagggacaccacacacctgtttgagagagaggtaggggcaattacagtgctatattcaaagccttttaacctacttcaagatacattaagtctgagtacatataagtgattttaaatatgaaaagaattgaagtatcatagttactctgggtagttttataatattttttgcaaggaatcaggcattgaatattaaagatttgcaattactatgctctttttctgttagagctaaaaattgctactgtgaccaaagctttctaaaacctgaattactccaggaaacgaaaaaattgagaacagagttccagatgaaggcatcatgatgacgaatgtcaacatcctggtcaattatactcaactgcttcataagacacttctgaaagcctcactgtcctgaggccccaaaaacctaatagggaaaagattaacatgtcaacaagggaaaactgccctctctgctctcattctttttaagcacagctaaaataaattcttttgtttttggggggacagggtcttgctctgttgcccaagctagagttcagtggcatgatctcagctcgctgcaacctctgcctcccagactcaggtgatcctcccacctcagcctccagggtagctgggactacagttgcacaccacaatgcctagctaatttttgcattttttatagagatggggttttgccatgttgcccaggcttgtctcaaactcctgggctcaagtgatcttcccacttcagcctcccaagtagctgggactccaggagtgcactaccacgcccagctaatttttattttctgtagagccggggatctcactatattacccaggctggtttcaaactcctagcctcaagggatccagggatcctcccacctcaacccttccaaagtgataggattacaagtgtgagccactgtgcccaataatcaactagcaattttcaaataggaattcacaaatttcattgttatgcgatgtaccccagacacaaaataacacaacaggccagcaccaggtttacaactcaatgaacattaagtccaaactccaggtgctctgctgagttgaggaatctaatgatggagtttatcaatatcattcttctctgatcatatgttatgaagatttggggagaaatatatatccatactaacatacagtacatgttgtgtggtaaagtagcacaaatgggcaaatatttaggtatttaaattagttattttgaatatttctcaaactgaagtataatcaatctttcttttttttttttaagcagagtcttgctctgttgtccatgctggagtgcagtggcctgatctcggctcactgcaacctccgccacccgggttcaagcaattttcctgcctcagcctcctaaatagctgggattacaggcgcatgccaccacgtttggctaatttttgtatttttagtagagacggggtttcaccatgttggccaggctggtctcgaactcctggcctccagtgatcagcacacctcagactctcaaagtgctggattacaggcgtgagccaccgtgcccagcctcaaactgaaggtataatcaattttaagaaacacaatgttacaaattggcaaagattcaaaaggaagtacttgttgatacttgtcatattatcagaacagccttatctcaacaatagatttattataatttcttaatgaggaattaatcttacaaaccaacagtaaaaaaaattatcaacaggttcctatatgtttttaacagtacaaaggctaagataccagacaaagaaactcctttaaaaaagaagtttgaatacttgggaaacaaatttccttattagggtattgatgaaataaaggaagttatcataggaaaatgtagccctgcaatttcaggcttagaatatgaaacagaacattcagcaaatgccaagttttcagtacacatcatacaaaataataccttctttattcaaaagttcttggtactaaaggttctaataaaccttgtttctgtttcccaacaaaggtgtgccaggtaaaattagatttgtacaaaactagctatggacattgtatcctcttaaagtagggaagcttactctaagatttaaagcaaatacacatgttcttacagtagacatgaaaatctctctttttatctatactatcaggtgttgctgcattgtcagtagaaactcagaaatgaaagtgggcaggagaaaccaaaataaaaagtatataatgaaaaaacaggtcgggcatggtggctcaaacctataatcccaacactttggcaggccgaggtgggtggatcatttgaggtcaggagttcgaggccagcctggccaacatggagaaatcccatctctactaaaaatacaaaacttagctaggcgtggtggcatgcgcctgtaatcccagctactcgggaggctggggcaggggtatcacttgagcttgggaggcagaggttgctgtgagccgagatcacgccactgcactccagcctgggcgacagagtgagaccctgtctcaaaaaataaaaataaaaaaggccgggcacagtagctcatgcctgtaatcccagggctttgggaagctgaggcacgcagctccaggtcaggagatcgagaccagcctggctaacacagtgaaaccccgtctctactaaaaatacaaaaaattagccaagcgtggtagcagacgcctgtagtcccagctactcaggaggctgaggcaggaaaattgcgtgaacccaggaggtggagcttgcatgcagtgagccgagatcgcgccactgcactccagcctggacgacagagcgagactccgtctcaaataaaaaataaaataaaataaaataaaataaaataaaataaataaataaatagaaaaagaaaaaagaaactgtgagagaaatttagcattgacaatactattgttttcaataaaaccaactattagaaacacactgattttgtcaatcagttaaatgggtatataacaagaaaagcaacctcaagaaaatttaagctaatagtacattcttaattttacaccatggcaaaaatgctttaaacctataaattatcaacgatatatcttggctattagtaagaagtactacaggccctcagtgcaacaaacgttttcagcagtaaaacctgatcctaaaaaaaaaaaaaggaatgctgttaagaaacaaggttgttctgcctactgcagggtcatataaaatagaaataaaggcttttgatctttcctctatcaaaaacatgaaaattattctttctgctaatgctttagtacttattatgggaaggccccacaacaatatagtaaaaatcaggagggggggtggtggcagaagtactgtgcagacaagtaaactaggtttgtccacaaaaggcaatgaagtcatttcagcataatgaagaagagacataaacaagtactagcaggcaccttttaaattttaacacctacagataggtggccactatcacctgacaagtagggaaaacagacataccctcacatatatgttattctattaaagcaggagccaaataccacaaccatcttttaaaaaatgtgacatcattagcaatgccctacgctcaatccctccttcccgaagcttattataaacctgaggttaaatctattcattctttctacaactctgtacaatataaaaacacatctaatacccagaattccccattccttctccctggtttccctaatgtagccagcatctggtcacatcaccacttacaaaagaggaagtgagaagctgatctaaagaatttccactaagcgagcaggtagcataaatgaatgaacacagtgagactttcccatgtgatccactcaagacacataggtttactatgtcttaccttgctatataaataatttaccaaataattatcttttctttccaaatgtactataaacacatatacaacagtgtgagcccaaacttttttttttttttttttttttagacagagtcttgttcttgtcccccaggctggaatgcaatggcatcatctcggctcactgcaacgtctgcctgccgggttcaagtgattctcctgcctcagcctcccgagtagctaggattacaggtgcccgccaccacgcccagctaatttttgtatttttactacagacagggtttcaccatgttggccaggctggtctcgaactcctgacctcatgatccacccacctcggcctcccaaagtactgggattacaggtgtgagccaccgcgcccggccaaccaaacagactcttaagtctttcagaagagaacagggttatcacaaccataatctgatactctgttatagtcccagcgaaaagcagctttcattctcgggcatgacaaaagctagggagctttctaaggaaaatgggactagaagggagaatgtcacccagactggggttagatcagtatctggaatcagttgccactaacaaaaggctagcaaatacacttcttggaaaaagagggatttttaaaattatacatctttgtaaaagttttcaagttcacagtattatcaaatcaagggagatgaaaagctggtagtagcagttgctcctagaatcactactagtctcaggatggaaaaccccagattttctccccgagttatgcaggactaatttagacgaagagctgcactctttctttagtttgccaagtatcagattttacatcaacataagaagagaataaataactatatgctgtatttcctagacgtgcctatgtaaataaaatgacaaaggctctgatgtcctaatagtgaattaggacatcagaatctccaggggaaattataaagggaggtcttcatgtatacagaagtaaatttaccacaaacatcaatctataaaaaggggacaaaaaacaaacagcagttgtgttccagcaaacctagaaggagaaagatggatctaaaaataagatttatgggtgacagagcctttgcagattaaaagaacgaatgaatgaaggaacaaatgaacgaatgaacgaatgaatgaaaaaaattaaaaacaggtttaaggatgctggtaccatacagggaagaaggaaagaaggggtgacggagccaatgacaccactgtatgtatgtgtctgtatgtatatatatatatatgcatagctcaagaaaacataacaaagaggccagaaaaggaattctaattttaaaatctactgcactcactgcaaactaggaaaataaatcctatttaatcaatgttatatattgttatataaagtgtattaatttttattcttaaagatggtcactcagaacctccataaattgtaatgtctttatctgaatcccttctgaactatttgttattctgaataaatttctgtatctaaagtattatacctaaagtgaggaaaataagacttgaaatattcccagtaagaaacaaatgattttattttcaggctaatcagtcagttatagcagactaagatgggcaaaaccaaatacggaattttaaaaaccctacatgataataaatttggtgcattcccttacgtaaattttcttgctacagatattcttctaaaacttatgggctttaaactgttttcctaagcatactcgtacctatacactcatgtatagttcataatccacaggtgtgaactagatgggattaggtaggcaatctatattcaagctgaccaaaatgaagctaaaagcctgtctgaaacataaactcataacctttgtctcatcagcaatgcactccaactgttaaaagattcaaacatcaacttggatttgaaaagagtgggaggcagtgaaatactaacagggagaaaatttatggagtctatgcaaaattttctattaatgaaaaccagctgcaagaacaacagatgccgttttcagtatttgagcctggtggaatactaacggggtttcttctattccaagtttccattttggaagcaaggccttgaagtcattattccctcagggtcatgggcactctacagaatacctttccaaaacaactgttctagagtctgaattttctgtccattagatgtgtacagtgtctctctgaagagccatttaaagccatccttgtatgtgaagtttcccccaaaggaaaattgagacctaactctgttctatctatgtgatccataagacctgtagcaaagtctaattcaaagttgttaattttagacttaacaccaatatcagggatataggccactaataaaacactgtgataaaatattaatcactgattattttcaccataatctatttgattgccacaaacttaactctaccacttggtaaatattttttcccaagctttggttaattagtcttgttcccacacagcccataaatcaattttaaaattgtttgcatgtaaccatcataatatttaatatattctaccatctgccccaacaccagttaacagcaataaaagatatagatatagatatagatatagatatagatatagatatagatatagatatagatatacacatacatgtgggctttgttttcctaacttaggacagccagttcttccagtatagatcttacataattttggtttgcagaaattgcccctaggaaattcagaaagtggctttacccaaaatgaggaaaatcacttacataagcttttaagactagaaactgatcagcagccatttctcataccaatacatctctccatcctaggattatgtggaagagaatatattatccctagaatcatgaaggttgagtaaaatttctgtaaaaggtacctttggcaccccagacaactgttaagaaaaaagaatatctgtactcaaatcattatactgtcgactcaaaacccattataaaagtggcttgaaaatgaaaaagcaaaaaacaaacctcaatcttgtctgttttggcatctccccagtatattttgccttcatcataatccaaggctaaaccatttggccaaccaagagaagtgttaaccaatactacacggtcagaaccatccagagctgctcgctcaattttcggaatttctccccagtcagtccaatacatgtacctagagaagtatacaaaaaatgagctaaaaatagataataaaatgtaactttcagatattctaaaggtgagatccatccctcctattacactggtatcatcagttaatgccaaggaaggggaaaaaaaaaaaaacatatgaagaggtgtttaagacatttatcccagcaatatataagattgtgggaaattttcagatcagtgtgttctagagccaatcctgaaaatgcctcccaataatgagattacagttttacttcttttttttttttttttttttaaatattttgtgtgcccttttccatgaactttctctctcttttccttgatggcttgtcatctctctgacacaaaaggcttatcccagcagtattagtcagatggcaaactgaattctcaaaataactatttcttcctgcagtgctaagtgattcttacggctcctggatgtttagatggctctaaggcattggtatatactgaggtgtaatttgtcactatgcttgtcctcagaataaatctcaaagtaacaaaattgttgagtatgtaaaaagttgtacttccctggactatgatcagggtggcatggcaaaacaaaacaaacaacaacaacaaactagaagtaaagctgcatgggctggcaaagttttggaaatcaagtcattcatgtatttagggaaaaaaaagtaagctatattcttactataaagtactgaaaatggaattaaagcttctaggggaagggaaagagttctgaaaacaatttcttcccacatttttcatggtaatgatgcaatccgagcaaaatctgcagacaacacccaaagtcagcaaacatggacttaatttagaaagaaaaaatatctaagacatccaaggcaaaaaactagcaatttttaaacttgagattgtattctaatcaccatatcctaaaatagacagccattaaagagctgtttactggaaaccaatatatatgtcatgttatcttagtcaatgttttcaggaacctgtgaaaaacagaaacaccacacagaatttactatcagtagagcttcttacccaaccatgggatctaacacaatagcccggggttcctctaagtcctctgaaatcaagatcttcctcatggtcccattgagccttgtcacttctattcgatcagtgccagtgtctgtccaataaagatttcgtgcaacccagtccacagcaataccatcaggatgggcaatttgagcagtgaccacaaactgactgccagatccatctataaatgaacggcgtatggccctcacttcatcatcagtccagtagatgtagccttccacaggatcgtaatctatggcaatggcatgacggatgtcttctaactgcagaacaatgtctgtaaaatctggtgtatccaaagaaatgcgtctcaagtctgtccttcgagctaaaagcaataattctgtggcacctagaacaacaaagtgaaatgaagaatactttgaaacccagaggtaaaatttacctgctctagataaagaatcaagaactgaaaaataaatataaaatatacataaattaacacaaaaggatgtgcactctctttagagtggaaatggaaagtaatacagtgaaatagaagagtctactctgaggtcaagctgtttaatggctaactctccaaattaagttgtgatacattctatggtttcattggaattaatccagctatttaaaagtacaatgaataatgactatgtaatgactaagaagctaagtagctcagtattaaaggagaaggaaatgtaggatatagatcctttgttcaagaagcattttttaaaaaaagataaagaaatttaggacaagaatctttgtgcttgataggaatgttctaaaattggattgtggtgataactgcgtaactctgtaaatttactaaaaagtcaccgaattgtacaatttaaaaaatggatggattttatatgctatgtaagttacatctcagtaaaactgtcttaacaaagagaaatacagggcaatacctcacagaattgaggacaaagcaagctatggagaaacaaacagctgcaatggagggaaggaaccagataaacataacacagtggttaagagttgtggatccaatataatttgattcaagaagctacacaaactttgggaaaatatctaatctcgctaagcctagtttccccatctataccttgtaaggttgttgtaaggattaaaggagataaatctaaaactcaggaaagtactgaacatttaagtactcaagaaatattaactaatacttaacaacagtattaaaaaataaagattttcagatttttatttcactgaattttaaattaggtttatttatgaactgtttaaagcccaagccccaaatacttaaccacataaccaagaatgaagatactgagctcaatctttttttcattttaaattgttcaagtaaaccaccagcaaaaaatcgtctaactataggaagctaataaaagacagtaagcaaattgacaactgaaagaataagaaaagattcccagctaaataaatgagtccaaaacaaaatactggcatataaacttcaagaatcaatctgcaattacaagtcaaaaaactgagaagaggagtgaagcctctcaatatcagccctttcactctagagctaattataaatgaattccaacttgaagaaaatacagcccaaatgccactgcaggaaccaagtaggaataactttgtacaattcactgccccggctaacaaccaaaaggagccagcctagaacttcacaaagaagtcatagagctgttaatttgagcaaggtgatcaaaacagaacagttaacttaaggctactacatgccaaatgcacacatgaaattcaaaactggttaaatatgtacacttgcactgctgtgagggagcagatagaccattattgctaaaataaatcctctgttttaaagtcaggctacatttttaaagaaaaaagcaacattacaaaaaccttttgttttaaattgaaaccaaattgctgtctgccatggaaaccatttgaccaagagtcagccagcttcaccttttactatgaggataatttatcaatgccaagtcataacaaacatcctgtacacagactcaattccatctctctgactccctggcccccttgccagggactctaacacactccaaaacacaggcttctgcttttcagagttagataaagaagccacagctaaatacaacaattttcttaccaggtcttgctggttgctagagaaccagatggtgatccataggggtgagaatgaagaataacattctcattaagaagaaaaacagaagaactggtgttcttccaaactggaagtcccttaaaatgtcctaaatcagtatactttctccaacgtgccctctctctatagggaattaagagtaaggagaacaggcaaagtgtgtttcttaagtataaaaagaagttgttttaaatatggattttttttcccagctctgaaagcatctctctgttgttaaaaagcaatttaaaacatccttaaataatttgttataaaatatatctcatgatattctttgtagctaaaagtttaataaacatactttctttcacagaggttctttattcacaaatgctacctgttaaaaatatattccttatgcgactactcatttccatagttatcaactgtgatatcaatgactatgagatttgacagaaaagatacaacacgtaacttttttcaaaaatatgttatttaaaacactaaaataatttataaaatagcattcaagtgatgccacagaacaaaacactcctattctataaccatgtgtgaagactgtgaaattaagtgactggtctcccaaagcagtataacctagagagctgattatagagaaaacaaatcatgaagaattccaatagttataaaatttttcattttggataatatcttcttaccatctttgcaggtttttccattctccaggagtttgaccccagtggggcaagcacactgataaaaaggcttgactggagacatcaaacacaaatgggaacaacccccattgtcaattccacatggatttgtggctgtcaaatataaatcacattgattaatatcaatgattactaagtacacaaaggttaacaaccataacatgaacaactgtgataagccaaaattattaccaaatgtcatgcaggtgcttgactatcaaaccatctgcaaagacaggaattaatcagtgtgaatttacttagtattttgtaaccaaagaggaatacacaagaagtaaagcaggagatccctgccctaaaagaggttacaatttagtcagttaaacaaaattaacaaaaagcaaaactaaaaacaaacaaacaaacaaacaaaaccaataaaactaagtgctattttgcacattatagacaataagtacagagtcaaatgggaaaaaaaccgctgaggtttaaagaattgaagaagagctttgtggagtatacagcacgggagccttcaaggataggaaggatagataagaggacatttcaagtatggtaaagctatctgaataaaactttgggggctataaactgggtaagatattaaggtgaacagtataactggaggttaaggtttctactgactaataggaactaaagctgaatgaatacaaagaatgggaatagattaaagtgaaggacactgaaagccaagaaaagtaattatgttgaaaagtcatgccttgggaagattaacatagaagggataagcagaaaaaaggggaaaatgaaaatcagagaaaactaattagcaaactttggaaattatggaaagggatatgtccaaacaatactcatagaaaaaaatcaacataagatggagaccaatggaacatgaaagataaaagtaaccaacatgaaagataactgcaaattctcaaattagtaaaacataaaggaccaacaatgccatttaaaaagaaaaacaagaggccaggcacggtggctcgtgactataatcccagcactttgggaggcctaggtgcgtggatcacttgagcccaggagtttgagaccagcctgggtcaccaacatggtgagaccctacctctataaaaaatactaaaattagccaggtgtggtggcatatgcctgtagtcccagctactagggaggctgaggtggaaagatcacttgagcctggaagttcgaggctgcagggagccgtgatcacataaacgcacaacagagcaagactctatctcaaaaaacaaacaaaaaacagggaaaattctcttttgagggctatgaagaataaaaaaattcatacaagtgactgaacattttcttttgtacagaagagtaacacatacacttaaaaacatttttatgggctcatgatcatcagattccaacataacactttcaatatttgattatctccccctaaatggagagctaatataaagcaacatatgttgcaaaatctcttcatttttggctatgtaataaaatctgaaatacactcagacagatgccagacatttatttacacaaaagtgccaaacccttaacattctcgtattccttttaaacctaattccagtcctctcttacaagttctcagcagtcatagcccgagtcattgtaaaggctgaccaaacacagaaccaaaactaaggaaaacaaggtgggaggggtacacagaaaagtttaagtaggtattttatttagcaagctgaggtacttaaattcaaatatattctagattaacagagttttcatttaaaaagaagaggcgtttttgtgtgtgtgtgtgttttttgttttttttttttttgagacataatttctttcttgttgcccaggctgaaagtgcaatggcgtgatcttggctcactgcaacctctgcctcccgggttcaagcgattctccagcctcagcctcccaagtagctgggattataagcacacgccaccacgcctggctaatatttttgttattttagtagagacggggtttcaccatgttggccaggctggtctcaaactcctgacctcaagtgatccacctgccttggcctcccaaagtgtgggattacaggcatgagccaccgcgcctggcccaagagtttgttttttaaacacactcacatcaacacattcaactacatactgaaagaaataatatgaacaaaaaaactcatttgtgtataagcctagcatataagctatctcaatttttaaattatctctctcttctccacctctaaaagcgctgactcaaaaaggctgaggtggtctgtagtgacaggctacaaaatggtctaggctattgcctaacctgaattatacttttacattttcccttttttttgagcaaagtctcgctctgttgcccaggctggagtgcagtggcacaatctcggctcactgcaatctccaccttccgggttcaagtgacactcctgcctcagcctcccaagcggctgggactacaggtgcacactaccacaccccattaatttttgtattttttagtagagacagggtttcaccaggttggccaggctggtctcaaactcctgacctcatatgatctgcctgcttcagtctcccaaagtgctgggattttaacttttttttttttttttttgagacacagtctttctctgtctcccaggctggagtgcagtggcgcaatctcagctcactgcaacctcggcctcccgagttcaagtgattctcttgcctcagcctcccaagtaggattttaactcttttttattcccgccaactatctttggatatgccctccctcctcctgatcctcactaaagccagacattagagtgctacaaagctgttccaacttgcaatttaaaaatcaaggatcacttaccatttggctgcctctgttggctgaaggcatgtatatccatgggagagaagatgtcagaatggatttcacgcagaccctcaccagtatacttgttgcaagccaaaatggagtgtgtgctccagtcagtccagtacaatatgtcctcaaataacgtcaaggcaaaaggatgtggaagggaacctttaaccactgcctgcctattaacataaagagaaaaatttaaacttatttctaaattttcttcttctatcataacgtcacctctcccattaaaatgatcttagttcacattaacacatacaaatcttgagtaatacataccaataggtcaaatacacctataaaaaataattcacataatgaattcatatatatttttaaggtgtccaaaagccccaaacaagcatttgggaatagtccctaacttggcagcagcctcaagttcagtacaagatacccggcagagagagagcactgctttttcattgtttgcactgctgtcaaatcctactcttcaactaccatctctggactcacagcttccaccctttcacacaattcatgtcatcagacagagaaaggtaagcaatgagaaaaatcacaggggttacagttggcactgaagtagatttatatcagcaataggttttttccttcttgatgtggaagaacaaagaacctgagcctgttttgtccatcacttcttatggttttgataactgagaatgaaacataaacatgaggccaaaatggcatgcaggtagcactctccccgcaaaccccagtctagctccagcaagtgatcatcttagctgacttttcactatattcaggcagccaaaaagaagtcctgttagtggtagaatatgttcatgagacaaagcagatccaaaattttcacaagcaatacatactttttaaaaggaaaagtagacagcctagttagtacttaaggcacagaactttgtagagtattagagagagttatagaataagcaaatgctgagggccgggcgcagtggctcacgtctgtaatcccagcactttgggaggccgaggtgggtggatcacaaggtcaggagttcaagaccagcctggccaagatggtaaaaccccatctctactaaaaatacaaaaaaattagccaggcgtggtggtgggcgcctgtaatcccagacactcggaaggctgaggcagagaactgcttgaatccaggaggcggaggttgcagtgagccgagatcgcgccactgcactccagcctgggcgacagagcgagactcatctcaaaaaaaaaaaaaagaaaaaaaaaagaataagcaaatgctctggaataatgaacaaatcacgttttgagtcaaaataatattcaagaaaatacatgttttgatattttcataaatccaagtttcccaatagcccacccaggaggcagagatgggcagagagggaggaagggaaagaaaaatgaagggaaaagggaagggaaagcataagctactgaagagaaattaaaagtatcatatattttaaggaagatgattcaattttcaggtccttgaggttaactgatgatttctactatctaacagactaccagcatattaaattaaaagcaattaaggtcatttttacgtgtaagcaggattaccgtctgtgattgcacatggaatgatcttagtctaaagcattataaattcagacaaaatacctgcactgccaacccatatcaccagttttctcattttccttaatcctctcttccctaagtaaaaagctcactattccttctaatttcccaaagagaactgtcacaataccttctcctgaagtgctttcttccactttttaaatggacagttttattaaatttactaaagagactatattatttacagggtgatggcacagtttatgttcaattttaaacaggcctgtatatttcacactaaagtcttccaaaattcatggtggaaacagagagagaactgagaaagctgccaaaaaagacaagtaacacaaatgaaaaataaagagtagttaaaactaagttacttggcatttcaccatcttaaagaactgctttgaaaaactcaaggaaaaaaaaggcttcaaaaagttttgtatatcattaagtgaaaagttgaaattcactctactgaactaaacataggaaaataaacatatggaaaaggcaaaatccctaaaagctatattcattttatatattaattgaatgcataaacttagaactcagaggtgagcttaaatccccccttgacacttattactgacaccatttctgcaagctttatttcttcatctgtcaacggaaggtaataatctatcctcactgcgttaatgtgaagattaaataacatacgcaaaagccattcagcactacgcttgctacttaacactttcgttaatgattcctcaattttaagacacatattttcaatattttaacatttctgatataagggtaacatttacaatgtgaatatttcatgtggtagtttttaaaatcagtaagttcttaaaatcaatggcttattagaatcagtaaatactatactaatattaattttttttttgagacaaagtcttgatcttgtcacccaggatggagtgcagtggtgtgatcctggctcactgcaacctccgcctccagggttcaagcaattctcctgcctcagcctcccaagtagctgggattataggcatgcaccaccatgcctggctaattttgtatttttagtagagatggggtttcaccatgttgaccaggctggtctcaaactcctgacctcaggtgatctgcccaccttggcctcctaaaatgctgggattacaggcgtgagccaccgagcccggccttaacactaaatataaatgtcactttcttttcatagccattcttaatttcctcccgccacaagccaagttagttttctttctctacgttctcataacagttagtgaactgttttataactgttcacctatccagcaactctataacagatgacctttttgagagtaaaactctagcttatttatataccaaggatcccacacaatggtaaggtgtacaaattaggcagacttactaaacactctggggatgcttgataaaattaaatgtttttaagaaaatatgtaattaacagagctgaacaaaaggcagaactaagaacactatcatgcaagggtgatataatgatttgtccagccaactatgacttgttcctgaaagtagggataaccacacagagtattcccctttcttctctctggctgagattaccaagtaagcctacctcctgatccccatctggaaacacaagttacttcaaggaggagttgatcatggctgctaagaaccaagctggcaggtaagatccaagcccagttcctcaatagtaggtcacaacgataacagaaactaaaaaatggatcaccaaactggggaccacagaaaagaaacagagactccccccaacctcactgaagttttcatatagtgcttgcaatctctgagcatcatctcctgcctatgtctgtcacattctgcaacttactgataaagctcaccactgccaatacctcccaggcacctcttgctagctctttgagattctttgaactctgcaagtggttcttttaaactctgcaccaactggacttatcctttataaaacacctgcatgccctcatttagtttttgtttctggacctcctcacagatagtcatcttctgctcctctctcagaactgcccacttgtgtgagtaataaatctttctttaatcataccacaggactgctgtcatgagttctgacatctgaacttaaccttggaaggaagcttcccttcaccacagtgaagctgtaataatatctaagaagacaatgtcagcagtgatggcaaagctttggaaaaatctccatgaatcctccatgtgaaaacagagaacaactaggtaatgaaccccaaatcccatggacaacattcacaacaaagctaggtaaaacccaagatacaaaatggtagagaaaactaccaacagccattaagatatgactgatattggcacctctgcaggatatgagaaagaaacaataggacatctggcaggacagaacacataaaacagacaacattggaaagcttagtagaccaatctgagaacagcaaccagctatgaggtgttctggccacttcaagagtaagtgaatacaatgaattcatcgtcaggcactgaaaggtctagcactatactttaacctattgtgaactctcaaaattgtccttcccgggctcccttccagacaaagcgtcatactgaagagaaatcactgggagcggactgaaaagtgtgcatgattggtacaggagaacaatgggaaaataaggtacagaaaaaagcagaaaaagtaaagtgggagagccaggaaatccagaaagctagctgccattattttttaaacacatatacatagacatgagagttctgtgaaactggagaacttatgaactctgccttcttctgaatgttcaagcaaaacagtttcacctgaaaataagaaaacaaattactaacatcaaatcccattaataagttaatattaaaaataagaaaaggataaagtgaagaataacattcctacagacaataaaaaagtatgccagaaagatatagaaatagaacaaattaaactgataacttatttcaaaacagtcaaagtatttaaagtaagatactagtcataaatgaacaacacaaattagaatcagacaactcacaagtgaggggacagaacttgaaagaatgagaaatacaaaaatacatcatttcagaaatgaagtctacgaaataagaatgaataaacataatacataaagaaaaaaatgaaaaggaagaaatattacataatagaaaaaaatattttcaaaaaataaaatatttgaaggacaaaggacaaggaagagaacagaactatactggaacaaggaaatgactccagatggtaacttgaaccctcaggaaaaatgaagaataccagaaatagtaaatatgcaggttaataaaaaagactctataaataatgttttctctttttcctttaacctttttaacagacataagattgtataaagcaataagtataaccctgtgttagatataatagaaatgaactataaatgacaataatagcagaaaggatgggagagagaatggagatatacttagagtaaaatgtatgtacttttcataattaagttaatattaccacaaagtagattttgacaaaatgcacgttgcaatccctaaaataattacctttaaaatccccaaaatacagtttaaaattatcaaccaaggaatcaaaatgacacaccagaaaatatctacttaatacaaaggacaaaggaacaaagatgacataagataatttaaaaaaaaaaaaacactaaaatgtcagacataagcccaaccatatcattaatgacattcaatgtgaataaacacaccaatcaaaaggcaaaggctgttagactgaataaagcaaaggttacactatatgctgtttataaaagcacattttacattcaaagatacaaatagattgaaaagaaaaggttacagtagacagtaaccataagagagctggagcagctctatcagacaaaaaagattttaagtataaaaaggtaactagagatacagtggcaggttttatgagaaagagtcatcaggaagttacaattagaaacatacaggtacctaaaaacagagccccagaacaaatgaagcaaaacctgacagaaatcaaaggaaaaatgggcagttcaataatatagttggagagctcaacaccctattctcactaaaggaaagaacaactagatagaaaattaccaaggatatagaaaatttgaacattattaaccaacttaacctactatctatagaacattccatgcaacaaaagaatacacaatcttttcacgtacacgtggaactttctccaggacaccacatgctaggagacagaattaatcttaaaagactgaactcatataaaataaaaagactgaactcatataaaatagactactatctgaccataatgaaattcatgaagaaatcaacggaagaaaatttgggaaatcaaattattttctaaatttttgaaatttctttctcaatttcctctaaatcagcaatgagtcgaggaagaaattacaataaaagtttttaaatattttgagctaaaagaaaatgaaaatacaaaatatggaaacgtatatagaatactaatgcctatactagaaaagaagagagattacaaatcaattatttatgatttgaccttaagaaactgtaagaagagtagattaaatccaaagcaagtgtaaggaagaaaataaaaacattagggttaaaaaaaaaaaaggcaatgaaacagaaaacagaaaaacaataaagggggaaaaatcaataaaaccagaagctggttgttctttgaaaagacccacaaaattgacaaccctttagtgctagactgacccaaaaaaaaagacgcaaattgtgaaaactgtgaataaagtgatgaatgaaagagaaacactgccttacagaaattaaaaggattattaggcaataccataaacaactttatgccaacaaattagacaaatttatgaaacaaaaatattcctggaaaaaaaccaaattactaaaactgactcaagaagaaacagaaaatctgatagatctacaacaaacaaggaaattgaatttgtaattaatatcttcccaaaaagaaatccccatgcccagatggcaggaaaagttgtatcaactggtcacacacttttccagaaaacaaagaaagaggaaatatcttccgactctatgaggctgatattatgctaatctcaaaaccaaataaacacaagaaaaacagactacggattaatatccttcactattaaagacataaaaatcctcaacagaatattagcaaaccaaatctaacaacatttcaaaagaagtataaaccacgaccaagtagaacttaccccagaaatgcaagatcggtttaacaactgaaaaccaattactgaaattcaccatgttcataaaataaagaataaaaccacataatcatttccatagatgcagaaaaaggaacggacaaaatccagtaattattcatggtaaatctgtccatgaactaggaatagaaaggaacttcctcaacctgataaaatccctttattaaaaaaacctacaggtaatatcatgctcaagactatttttaatcttttttaaaaaataaagccaatacagagaaaaacatacaaaacaaacatatagcttaacaagttactataaggcaaacactcttgtaaccacgaattcactcagatgaaggaaaaaaacttgatctgggtgaatcacccagacgacttcaaaaggccctgcatgaaccctgtcccaatccctccctctccatagaagtaacaattattctgattttctattagtcactttcttgcctttatagttttattgctttttgtaagtgtgcatccacagaaaaatagtttagtcttaagccccattttcatttgctatttcttttaaagtctctgttttaaaaaatgtttaactggtacataataattacacatatttgtggggtacacagcaatgttgcaatatatataaggtaccgtgatcagctcagggtaatcagcatatccataatctcaaacatttaacatttctgtgttggaaacattcagtatcctctttgaaattatataatgttttacctattaagtacagtcatcctacagtggtatagaatactcaagctttttctaactgtaattctgtattttttagcaaatctcttcttatctcttccttcccagcctctagtatcccctattctactctttacttttgcaagatcaacatttaccttccacatacgagtgagaacatgcatggtttaattttctgttcctggtcctatgtcacttaagataacatcctccaggtctatccatattgctgagaatgacaggatttcattctttttatggctaaatggtattccattgtgtatatataccacattttctttatctattcatctgatgttggacacctaggttgataccacatcttggctactgtaaatagtgctgcaacaaacataggggtgcagatgtctcgatacactgatttcctttcctttgggtaaatgccaagtagtgggactactggatcatatggtagttctatttgtaattttttgaggaacttccatactgttctccatagcggctgtactagtttatactcccaccaacagtgtataagagttcccttttctgtgcattcttgaccgtattattttttgtctttttggtaatagccatatggtaactagggtgagatgatacttcattgtgaatttaatttgcatttcctggatgatttgtgatgttgagcattttttcatatgtttgtggccatttatatgccttcttttgatacatgtctattcggatcatttccccattttttaaccaaactggttttttgctgttgaactgtttgagttccctgtatattctggatattaatcccatgtcagatgagtaatttgcaaatattttccctcattctgtaggtcgtcttttcactgtgttgtttcctttgctctgtagaagctttttagtttgatataatgcatctggtattttttgcttttgttgcctgcatttttgagatcttatccataaaatcctttcccagaccaatgtcctgaagcatttcctctatggtttcctctagcagttttatagtttcaagtcttacccttaggtctttgatccattttgagttgatttttgtataaggtgagaggtgggtttctagtttcattcttccacatgtggatatccagtttccccagcatcatttattgaaaagactatcctttccccaatctatgttcttggcacttttgtcaaaaagcaattggctatagatgcatggattaatttctgggttttctattctgttccatcggtgtatgtttctgtttttatgccagtaccatgctgttttggttactacaactttgtggtatattttgaagtctgttagtatgatgtctccagctttgttctttttgctcaggattgctttggctattcagggtcttttatggtcccatacaaattttaggatttttttttttttctatttctgtgcagaatgtcattggtattttaatagggactccactgaatctgcaggttgctttgggtagtacggtcattttaactataataattattccaatccatgagcatgaaatgtttttccatttgtatgtatccctcttcaatttctttcatcagtgttttgcagctttatctgaagaggtctttcacttccttggttaaatttattcctaggtattttattaatttcttatagctattgtaaatgacactgccttcttaatttctttttcagctagtttgttgtttgtgtatagaaatgctactgatctttttgtgttgattttgtatcctgcaactttaccaaatttgttgatcagttctaagaatttttttttttttggtagagcgttcaagtctcttttcctgtctgtctcttccttacaatctctccgttaaagtacctaagatatttcatttatatgtccagatctgctgatgtactctcatggtgcagttcaatgtttctctgtcctctgtatttcctacaaatggccagctgatatacagccttgaccagactcatgatgaattgatccctttgacaaaatagtaggcagtagtgtgttcttacaccagaaggcaaataatgtctgttctttttcttcttgtgatgttagtagccatcgacgctcaccacctagacccattcgttcaccaaagttataaaatggtggtattgcaattctgccatttctttttcatttatcaattgaaatagctctcccatatctactattttgttagccagaggtacactcacataggaaaagcaggataaattgcttctttcttgtatttaccaatgttcaaggtaataaatttgttcctatcatgctctaatctaagagtaaccaattcctttttaaaataccattatgaactcaagaatttaaacacacttcacaggtttctaccgatctctggccagtgggaattctacagtcatttctccagtctttctgaaatgaccctaaatagtctttaacagcctccttactaactgttatgacaatgttccagctcagcatgtacatttcttgcccaaaacctagaatcagcaattttgccagaaaggcttggtttcttttaaggtggaatggtttttcccaacaccacaatttgggtgctacagaagttcactgcacacagcactgtaaatgttcaattgctactcaattggtcatttttgatctagtcctcttcagtgttcacagtcaggaaacaaacaaacacagttgggtacatatatttttgaaagataaaatacctaataagcgcatactagtaagtaactttccattaaaatatggaataatcagtttgacttaacctctgcagtattacatctatacttcctctcttgcccattaagaatctagcatatgcaggagcaatatatgtcctaatactcacttacttgatgcaacaatataaagtttcagaataacaatattaattatgaccacaacaatgtagttactataagaattaaatttatggccaggcatggtggctcccacctgtaatcccaacactttggtaggccgagacaggtggatcacttgagtccaagagttcaagaccagctgggcaacatgatgaaatcccgtctctactaaaaatacaaaaaattagtcaggtgtggtggtgtgcacctgtagtcccagctacttgggaggctcaaggtgggaggatagcttgtgcccaagaggcagaggttgcagtgaacagattctgcaacctctgcaaaattcaagcaattctcctgccttagccccctgagtagctgggattacaagcgcccaccaccatgctcggctaatttttgtattttttgtagaggcagggtttcaccatgttggccaggatggtctcactcctgacttcaggcgatccacccaccttggcctcccaaagtactgggattataggcatgagccaccatgcccagtcacaaatcttcttgtaagaaactttttctatagttgttcatagttgttctattcccttgctttgcttttctttccaaagagtcttattatctgtatgttgtttcttctttgcctatcttcagtatttatcattttctctcaaatcatcttttgtctttctgtatttctttttggtctttaaatttttcctccttttcaacctctatttaaaggttttttggtttattcaacctagtgtcccttctagttttcttttctgaagtgattttttaaattctttcttaagttctatcatttcatttctgaatttttctcttttttttttttttttttttttgagacagagttttgctcgtcacccaggttggagtgcaatggcacaatcttggctcactgcaacctctgcctcccggattcaagcgattctactgcctcagcctcccgagtagttgtgattacaggcgtgcatcaccacgtccagcaaatttttgtatttttagtagagacggggtttcaccatgttggcaaggctggtctcgaactcctgacctcaggtgacccgcctgccttggccttccaaagtgctgggattataggcgtgagtcatttctgaatttttctaatcttatgttatcctttcacatgtcatattggttcctcaatgacttttgactcatttatttatttaaaatttaaagaaaaaatttattgaagatttgaaaaataattcctaaaagattgacttttccagaaaactagctacacaatgcatctcatctaccatgttaaaatgtgcactagacacaaatacaaaaaccatgcaacaagccaccattcttcaacaatttgagcaaagttaaatgccaaaggaacaacatggatgacttgcaaagaatgggctatttaagcaccatttaaaaaaaaaaaaggagcacaaatggatgagtgtgttcagttatatacactgaattgaacctttggcactaggaatcacagcattttgtcatatagcatgaacacatattataaaagtacgtagggtcaaaggaacaggaccaccagcattcaaaagcagctctgtcaactaggcaataaaacactctatagcatgtgtctctgttgtccattgttgaatacactggcaggaactttgaagtgaaaaaaaaggtaagataggaaaaaaggagctattactccttttattttctctgtttaaaattaaacaggaaaacatcaattgttgtacaataacatcttcaaagtgcatcatttgtacaaaagaaagactaagaacaaaaatgtgtttacagagatccaaacataagtgagtgagagcgtctctcagacagctttctgatggttctctggaggagccattcataattgctgggcactaaaaaatgttgcagaattctttgccaggtactttagggaactgtgaagataattcagtaataaaacaaggctcggccaggcacggtggctcatgcctgtaattccagcactttgggaggctgaggcgggcggatcacgaggtaaggagttcgagaccagcctgaccaacatggtgaaatcccgcctctactaaaaatgtaaaaactagatgggcgtggtggtgcgcacctgtaatcccagctactcagaaggctgagtcaggagaatcgcttgaacccgggaggcagaggttgcagtgagcttgagatcatgccactgcactcccacttgggcaacagagcgagactccatctcaaaaaaaaaaaaaaaaaaaaaaaaaaaaaaacacaaggctcttctcatccagaggtatataggccaacattgctccaatttgtacatcagtagatgtggtgctccataaaccttggacatgagtgcatgagggtgatctgcaagaatttcagcatactgtggtctgtcaaacttgcagagtagctgggtgcccaacatcacattgaagtattcttctatccctgccacaacttcattaacagcatactcattatctgtgtttccacgagattttttgcaatttgcataatcctggagaatggaatccacattcttcctggcagaaagaaaaaagagatgtttttgtctggtaattaagtcccagtcatcaacaagccatggtttcagctcttcaggaatcttcactttttagcttcaactctgttcatgaatgtgtcctcattttcaagagtaggatctacccgggggcccttttcttccaaggaggctgaggcatctcactggtactgccaccatctccatttccaggtattttctgtttgttcttttttgttttcacttcaacattttctgttgcagaccagatgtcttctttcttggggcagcccctctcatcttcccctctgcatactgctcctgatgggctttttgaagttgtttctgcaaattggtgtccacgtatttgagtactctgctctctggaacccatgcatcccaatttttattccaaccactgtaatatataaagtattttacttgtttgtcctttatggcaacctttacacattttgcttcataaagaagcagcccatgaaagcacagcacttgctcaccctcctggaacttagggtttgagtcctgcttccacgtcatttataagtgattcgcagcctcctccttctccagctcattttataatagagatttgatctgttctgtggtcatgtttttctggggtgcttttatttataagagcttttgttttttcctttataataactttaaatgggattttaccttgatacttttctgtttctcttgtctacgtaaaattagtgttcctgaacttttaaaataatgtagagttcaaggtagtttttctaacgtcacagaattcattcctctgttgttttcacataatgttcaaaaacctagtagcttgctttctgagatctactagccgttgatcttcccatctttatctgaaccttctctttccttcccctcctgttttactctattctattgtccctatcctgctcaatttggattattctatcctattcaattttgttttaatcagtgtggtgctctgtcctggatgagcactctggcaggttcatttcagtagttccattttgagagttcgttggggctagactgctctagcttcttctgtctttaccatagtcacactgcacttgcctaatattggagtgggcaaccctcccaccctcctatttcagctgctgttcttaaaataacccaccatcttgtccagcaaatagctgtggctattttggcgttcccctgctttcaagtcttatgagacaccctgttaaatctccctgcttactctcgcatagacagtgataacatggaggtcttgtggctgttggtggtttgcccttatctagttgtgctttcaaatgactaaggctatagtcaactttatccatgtttttggatttgctatctagtttctgtaggttttagttaaaaacaaaaacaaaaaaactatgacatggccacatccatcttcctagactccccctcacagccagatttgaggtcaaaaacagcagttgtttctatattcatcatatacttactttttgacatttaaatttacttaaaaccacattgttatatgtcatttcactcttttttgaaagaaggcaaaaaatactccaactccatgattacaaaaagtttaactgaattctttatatctttcctggttttcaatacttctaaatgttccttattcttagttcaggtaattgacaaatgtttattatactttgaaaaaatcctacagtcaccaaaaactctcatctggtgaggtctcagattgagatcaaaaaccaaaattatcattaaaacacaagaatccaaatataaaatgtctttaaaaatctgaacataatctgagaagaaattccatgtttatgttttacagactttgtcttccttgaacactgaaatgtatggtatatgcagtaggttttctccttgtccagagatgagcaaactacagcccacaggctcattctgctttacaaataaagttttacaccaggtgctatggctgatgcctgtaattctagcactttcggaggccgaggccggtgaatcacttggagctcagggcataagaccagcctgggcaacatggtgagacgccatctttacaaaaatgacaaaaattagcccggtgtgatggcgtgtgcctatagtcccagctactcggaaggctgaggcaggaagatcgcttgagcccaggagacagaggttgcagtgagctgagatcacgctactgcattccagcccggatgacaaggtgagactctgtctaaaataaatacgtaaataaataaataaagttttgctgcaacagtcatgcctattcccttatgcattactatagctgcttttaaactacagtagcagaagtagttgaaccggagatcataagcctaaaatatttactatctgagcctttacagaaaatcttggccaaaccccgtcctagtgtagagttttatcaaagttccattagcaggacttggggctttactggtaattttgagtgggacactctttgttgtactgatgcccagcacactgcaggatgtttagcaaccttggacctcccctccaccaccggaactaaaatactagtagcactcccagtccttgggttaaacaaaattctctacacatttccaaacaaaggcagtaaagatgctacccctggtggagaaccactgaagaactaagttagctcagagtaaggaaagaggaaatacagtctgtaaattctaaatgctatcaagatggatgataaatgtaattacttttaaagcacttttaaagagctaactaaaagactattcttcttcccctctggcacttagtcaaaaataaacatatttcttaataaaattaggctttgtaatgtatcaaggcttcatcgagttttcttaaaagttttttctaattcttgtaatcttaccgatttgttccatccagatttgatttgtggatgaaattaagttttgcatctgcccaataaagcttttgttcttcataatccaaagtcagtccatttggccagtaaatttcactgtttattataatgaagcgacttgaaccatccattccagcacgttctatctttggcacttctccccagtctgtccagtacatgaacctaaaaatcataaaaataattaaagccatgacagagcagatatcaatcaaatactctgtaattattactattaaagaaagctcaggccgcgcgcagtggctcacacttgtaatcccagcactctgggaggctgaggcaggcaaatgacgaagtcaagagatcgagaccatcctggccaacatggtaaaaacccatctccactaaaaatacaaaaattagctgggcatggtggtggtgtgtgcctgtagtcctggctactcaggaggctgaggcaggagaatcgcttgaacccgagaggcggaggttgcagtaagctgagattgtgctactgcactccagcctggcaacagagcaagtctctgtctcaaaaacaaacaaacaaacaaacaaaacaaaaaaacacctcattttagggacactaaaactcttagaaattgtattttgaaattctaatatctaccatttgcaactgccctggtaatacctgattcaaacaactatcatcaaggattcaaaaaccactgaatcaaaatgtattggtaaaaaggatatttacaccatttcaatgtatctccccacagattacttattaacaacaaagaagaaagtgataactttagagaaaataaacccagtggataccaccttaactgagtcatctaaattaacatcaccaataagggaacaaactggcattatatacctcttcatgtgatatacctttacagaacatagtgtcttttatacggtctctcttgcatattattcctgcccccaaaaaatgcataccccaaataaaattatgaggaaacagtgtgattcaagtcgagagacactacaaaacagttggtctttgacaatatcaatgtcataaaagtcaaaaaaaaaaaaaaaaaaaggaggggggggtcaggaaccaatctagactggaggagagcaaagagatatgataactacatcaagtgtatgatcttggactgatgaagtaggaagaaaaaaatgctatgatcactggggagaaaaggcaaaactgatgtagtgtcaaattgcatagtactgtactaatgttaatttcctaaatatgctaattgtattgtagttaggatacagaggggtttgctatactacttttgcttctattccacaagtttgaagacttttcaaaataaaaaatgagaagtctaaaagtctcattacagaaaaagaaatttttctttgatgtaaaagaaaaactctcttgggctgggcacggtggctcatgcctgtaatcccagcactttgggaggtcgaggcacctgtaatcccagcactttgggaggctgaggcaggcggatcacctgaggtcaggagttcaagaccagcctggccaacatggtgaaaccccatctctactaaaaatacaaaaaaaaaaaaaaagttagccaggagtggtggtgggtgcctgttatcccagctactcgggaggctgaggcaggagaatcgcttgaacctgggaggcggagggtgcagtgagccgagatcacaccattgcactctagcctggacaacaagactccgtctcaaaaaagaaaaaaagaaaaaaaaatagaaaaactctttaatgtattatacttctcttaaaagcatattttcaaaagttaatgaggagccaggagtggtggctcacacttgtaatcctagcactttgggaggccgaggtgggtggatcacttcaggtcaggagttcaagaccagcctgtccaacatggtgaaaccccatctctactaaaactacaaaaatcagtcaggtgcatgtaaccccagctactcaggaggctgaggcaagagaatcgcttgaatccaggaggcggatgttgcctcagtgagctgagattgtgtgccactgcactccagcctgggcaacagaataagactctgtctcaaacaaacaaaaaaaaaaaaaaaaaaaaaaaaaaagaggtaatgagggtgctatgaaacagatcaggcacttaataaatgtgttgaaacccaaatgaaattcaggtataagttttactcaaataatcggtggaatggtaatactgaaatgaatctacttaatgcatactgatgtctccactatttcatatgaactgcttactcaaagaaatgatgaggagaatatcatgtaggggaataaatacaccttctagatacaaggcactgtgctaatggcttcacatacattatcttacttaagccttaagcaaccctacaaaatattatttgttcatcaccacattttgatgagaaaactgagaaatgtaagcacatcactcaaagtcacattgctaataaatgaagaacagaaattcaaacctacatctcttaaattctgaagtctatgtgtatgtcatgggtcagagccttgatttttaaagaagagaaagcaaaatgctccctagattggggacaacagtcaaacactacccagaatgagcggtatggacaagattaatacaggataaaactgtggccatgagctgtgtaacaatgtggtcaacaacagactatgtataaaatggtggtcctataaaactacaatactgtattgtcactataccttttctatgtttagatacacaaatacttaccatggtgttatgactgccaccacattcagtatcgtagcatgctgtacaggttcgtagcctagcagcaataagctatcttatatagcccaggtgtatagcaggctgtaccatctaggtttgtgtaacacactatgttcacacaatgatgaaatcactcaacatttctcagaacatgtccctactgttaagcgacacatgactatatataggaaggtagaccagaccatgttacaatttttcattttggccaggtgcggtggctcacgcctgtaatcctagcactttgggaggccgaggcgggcagatcacgaggtcaggagattgagaccatcctggctaacacggtgaaaccctgtctctattaaaaatacaaaaaaattagccaggcgtggtggcagatgcctatagtcccagctactcgggaggctgaggcaggagaatggcgtgaacccgggacgcggagcttgcagtgagcggagatagcgccactgcattccagcctgggcaacagagcgagactccatctcaaaaaaaaaaaaaaaaaagaatttttcatttttattctgagaacaacacaaaggcactttaagacttttaaaattaaaggtgatggccaggtacggtgactcatgctgtaatcctagcactttggcaggccaaggcaggaggactgtctgagtccaggagttcaagaacagcctgagcaacacagcaagatgctgtctctattttttaaaatgaaaaaataataataaaataaaattggaggtgaaatgactggctttgtgttttcaggagggagaaaaaaatgcctgcggtttgggaaaaaactagaggaaaactaaaaaaaatcctgaggccaggtcttccaataggctctgtgagttcagcaaattctctcccttaagcaattaaaaaaaaaaacaaggtcaaatctaaccaccaaagcctccaaaaactgaccaaaggtcatacaacaaaatgagaagcatttattccagaaaaatacaccgcatctcaataagaactgtggtattttagctaggggctattcctatccccatctatactgccaggtttgtggcataaacattctactgtgggcaaacatggcaggccataaagagtggtagctacctttccctgcaagaggggactgaccttatttggaacgaggcatggaaaaatctgtacccaggaatgttgttaaaaacaagagtggactgggcgcagtggctcatgcctgtaatcccggcactttgggaggccaaggcagggagatcccaaggtcaagaggtcaagaccatcctggccaacatggtaaaaaccctgtctctattaaaaacacaaaaaattagctgggcatgatggtgtgcacctgtagtcccagctactcaggaggctgaggcaggggaggctgaggcaggggaatcgcctgaacctgggaggcagaggatgcagtgagccaagattgcaccaccgcacttttgagattccgtcaaaaaaataataataataatattaataataataacgctttcagtggcaggcatcacgagggccattatctaactgactctggtgggggcaagcaacaaaatagcaaactagccagaaatctaacaggaagatcctaggaaaaagactgccaagaagagccttaagtggatattcatgcttagtagtcaggaaggctgtctgcatgtgtaacgctacaccagaaagaacacttgcaagctagtctctggctgaacatgggtcaaatttgaaattgcctaaaattttaagacattctccaaaccataaacaggtccacaggaaaatggggtaacactaacttgctggtgttcaggaacaacctttaagcaatcattagctgaccactaagataacagtgacacagaggcaatcccccagaaagccaggcataagaaatattttaaaaggaaaacagaccacagaagtaatccaggaaagtcattaaacaaaaacacacaacaatggcaacaagcccagggagcggtcagaatccagaatccagtcaatataatatattcatacaatggaatactattcagcaacataaaagaactacttatcaatgtcaaggatgactttttaaaattatgttgaacaaaagaaaccacacataaaagagtacctactacgtgatcccattatatgaagctatagatgtaaaatcaaaaagactaatctatgatgataaaaccagattcacagttactggggaggagtaagggattgactgtaaaggggcttaaggcaccttctggagtagagtaatgaacgtttgtcttaggtgtatttatcaaagcccatttaacaatcaacaaaaaaatatgaattttttgcatgtaaattctaactcagtaaagttgcttaaaacgtgaataagaaacataaactatttcaagaagttaattcaaaggtaacttttcttagaaacctttcccagcttactaaggcaaagttattccctcttctgagctcttggcaggttttgttatatactatagtacttatcagagtttgtagataaactataaagaactcaaaggtaaagactaggtgtcactaccacatcacaatgactggcacattgcacgtattcttttttaaataaagatgaatccagaccttgtgctttccattttcaatttctcctctaacccccaactcagtgcacactgaaatgggtaaaggaagacacatgagatgctacaagaagagaaagaagtacaaaaggttaataacctaagcatagggacagccagaaacagtgaaatggttttgtgtgcctatgtctattataatatatgaactagatttctcctcaggatatctttaatacacaaatcaattgatatttccatcttgatagagtaatacagttaaaaacaagtccacagcacacttcattagccacctcccatcttttctctattaatgcataaaatgaaaactaccagtatctttaaacaaacaagtgtagagaaataagaagttactctcactgcaatatctactaatctatactctgcgccgtgtgtgcaacatgcattacttgagattacgtgatacaaagtttgaaatgttgccatcacaggctgggctgaccagaagcaatttgcacactataaagacagaaaatgcaataagggctattgtctttcttgtacaatataatttaggtaggtttcctaactgtaactaatctaagcatttaactttgtaactcagtgtctagtttatggtgaaataaaatgttacaaatgagtgagtcaacctaacaagattttagtaatgaataaaagtatttgcatgccactatgtaccaaagctaatggataatcccttcattattcaaccctaaaaaataaatcaagtcatgttttttcaaggataagacccagataaagattccaactacaataagtgaaactaaggcatttgtcagatgagaacttgacgaaaattagcatttttaaatagattacagatgtgccttcatttgtgcaaatatttaaaatataaaggaatagatttcatctataaatactaaacattttcattaacttttaaattaaaaagctcattacaaatgtaaccgaaaaagcgattaggacacagaaaatttttaaaaagtattttttaagttaccaatatattattcaattttcttaaggttttgaacacctattaaagcggtgagcacctattaggagctaagcaccatgcctgatacagggaatatgaaaataagcaaggcaaaactattgcccttacgaaattcgcaatgtagacaaggagtggcaagtatattgaggaaggtataaacaggaggctctgagagtatagagaagtgacacccaatcaagtcaatgaatgtaagagttgtcaataaaatataccagagaaagtatgtattttacttaggcagttgccaaaatgggaaatagtgttccaggaagaggacatagcatatgaagtcatgatatattcaataaacagcaagaagatccatagagctgtagcatatcgtgaggtacattgacaatgaaagaaatcccacgtgtattattttactatactaagaaacttggactccagtgacaataacattgagggactggctagaggaagaagaaacaagaaaaagccagaaaactgaaatattccaaataagaactaatgaaggcaacagaagttgaggactggatcaatatgaaagaggaatgagaaaggatagactaggatggctcccaagatttacaaatgtgaatgtgtgtgtattggtgtcattcaacataatatggaattagatgtggtttgggagagcaagatgatgagttcaaatatggatgaattgaagcatcctcacctcattgtttttccttctgtatccagaccaccagtcaatagaataacaggaaaatcagtgtaaaaataagtgaaagttggttagaaaaggtaaataaagtaaaaagcatattaacagtcaaagaagttggtctacagtaacagggcaaaataaatcacaattacgagttgcatatgaaactaagtcaatccagaagtgttgagccatgctaattctaagaacattaatgtgacacatgtaagtaactctgaaaggacctataaaaagccacaggtcctcaaaaacattttgttgccatcaaatttattttgggggaaacttcaaaaatcacatacatcattatcaaattgaaaatgcagccagtgaaaatagttctgattttaatgtgaaaaagaaaagtgttgtgtaaaattcacacccttcctgttactaacccctgaacttgattcctgaccccatgttcctctcttactccggttagtagattaggctttaagtgaagaggagtttgaagaatttacggatttctgcttcctaatagaagtgaaaagaaaaaaagaattgtgaagaaatcggacctacttctgcacttcccctctacttgatcatgtgttggtatcatattttaaaaacaagtagaaattaataaaagaggatagtgaaagcattcatgttagcaggttggtttctgtggttgtttttacagagaatatacagtaaccagataaaagagtctgggctgggtgcagtggttcacacctgtaatcccggcactttgggaggccaagatgggcggctaatgatgtcagcagtttgagaccagcccggccaacatggtgaaaccccaaaccccaacttgactaaaaatacaaaaattagttaggcgtggtggtgggcacctgtaatcacagctacttgggaggctgaggcaggagaatcacttgaacctgggaggtggaggttgcaatgagccgagatcgtgccactgcactccagtctgggtgacagagcaacactccgtctcaaaaaaagagagtctggaatggaattagatagacatggtttgggacggtaagatgatgagttcaaatacggacgaactgaagcatcctaacctcactgtttttccttccgtatccagagtagggatggctttgtcatcccatgtttttacctgtccctcaatagggataataattctacctaattacttgcttgtgacagtatgcatcatcatgaaattctgaatgtataaactggttgccctggagaaaataagaacctcatgaacagccttaagcacccagtctagtcgattacttttaaaaagttagtggacataatgcaaagaatatatttaattcagaaataacattggtaaaccactactagaagataaagattataacctgaaagcgggtaacagattacatcaatttaattcccaactatcatcaaagaaaatgctaactctagtaatttttcaaaattgctgttatacgtcattcctctttccaaagaatcaaaggtgatgcattttgagcgcctctaagtttaataaaaatgaaatattaactgtcaggaatgcccccttcaagcatactctcctctgtgctcctgcacgttattctgatactatgctccaggtacaaactacatctctgtacatttcaaatacagtattaggactgtttactcatatgttttcaccactctagattccaggtccttgaaaacaaggactttgttttattttttgttgtatcccctatcctaaaacaatctagcataatgccaagtacacagtcagcactcaaatatttaataatggtctgcactcacctgctcgtgagacctcttgtatctgtcttattaccaaggccgtatccttgaaaaatacaggtaaaattttattttaatgattacattattctactatgctccagttatgagctgcttttctttgaatgcacaaaagcatgaagagagcctgtcacataatatttctactgactaaaaattattacccacttccacaccttgtccctctagccaacaactgctcggctaacaagcaccaccctaaaatagtgcatccccaccgcccccctgccaagtaaaagtgaatactctgtcctttgtgtccccaccatacagatttccatagcaaaacttatagtttcactggtttattcatgattctatataatcagtctctttatatattttgcaactagtttgtctcagaaggtatactagaatatcctgtcactcaaatctggaagctatatatgcttcactgactttttcattaaatggtctcatagagagaattttattttttttaaggtaaatttatttcagtcatgctctatgagaacttcaactacctttctaataaatacatcaaaattagtttctgaggaaaattttgtccttgaccttgagaattcttggtcttgagaattagaacttatccagctcacctcacctgctttaactgaattgcactttgcccagatgccgcagggacaaatgccaaagaaatgtgtcactgtggatattataaagatattgttgaatatatttttcattatatcatatagcagcttctttagaggactaatgggaagaaactggtttcatcatctggagtaaatatttttttcagtgaacagcttttatctaaaggacattaactcatacctgatactttcttccctaaggaatctggcttaaaatcaaatgtgtgtggaagtatatgggaattaatgacatatgttttggtatgtatattttcactcctggtctcatcttacatgtatactcttatatttccatctcaattttaaaattttattttataaaattaatacatttatttattttgcatcacttttttatatcttcctaaaacatcttaaatccttttagagacaaagtaggaaaaacatttactatttttttcagtttagctattggggattaaacatttttcttattaatttgtatgcactttttatatatcaaggctaactctattattaatatatctgttacaaatatttttctttgtctttttttgcttgaatcaaaatttggttgaatcagtatttttctttgcaatttctttcattgctttcatgcttaaaaagcccttctctcttcaaagattaaacattcacgttttcatttgatgtttaagttttcacttaaaaatttttatccatctaaaatgtatctgaagtatgacatgagatactgatataaactgattttttctttcctaacggtaaattcttctagtatgacgtcccttccctcttgattcccactccttttatcacgttacaaattgtaacgtacagtattttcctaatctacttgtttaatatctattttttacaccaataatgtctcatagatttaacattagctctattaataccagtcttggataatcatgtgaccatagttttaattttcatctgcaaagtgaatacttcactagttgatgtaaggattaaagtaagacactttatataaaagaaaagtgtctttcctactggctttgacccttctgctctgatctggttgcaggacagttcttcatatttatcatcttctcttagacttttaccattacccaccccatggggtcttttagtcatctaaactccctgctaatacctattttataacagtaaccaaccaagaagccaagcagcaccccactctcaaaacacattttcaaaaatatgtcataagtaaaagaatatttattggatgcaggtatattacaagagaaaatttaggacaaaatagcatttactcaacaagaaaaaggaaattttcctttattctttaataaaacatctcagttaatatttacaagcactggatacaaatacttcctttatgttaaacctaacacccccttaccagtaaagataagcttccttttcataacaggtgaatacaatgtgccattcaaaggcccagtcagcttactaaaaacccattcttcagatatctcataaatcaactatgttatatagtaagaacctgaagtctttaatcatcataaacacattcctgcaaaataaatacataagcttaattcttaaaaggcaaaagcttaaaattcatgatctgatttgtaaaatatgctaagactaatcttttggttgcatttatttgaaatttctaagtcatgtgagaactttctttttcctttaactatcagagcctatttctgtaagcaagcatagaaaaaatagttttcctggttgggggaatatggaatgcgttttctccatttgaaaccaacccattagttccctagataggttttggataaacatagaagttgacccttctggtcttaaagcttgaatcttacatttgttttacctgagttccttcctcaggaaatgaccttcaggctgctcaaagtatcaaataactgaaactcaccagatcaccacattcagacagacaataagatgctagacaactcattcatcatgattgcttccttggcccgccttagttcctgtttcttttacatttcttccctgctatatgaacccttcgttttagtcactcagggagatggtttgagactgagttctcatcttcctggctgcagcacccatggcaatacttgttgtctcagtcactggctttctctgcagtgagcagcatgacctagaccaaacccctggtgttttggtaactcatttttatttgcagtttctgacatccttacaaataaacataaagttaacatttttacaaacacttcctaataaggaaaagtttgaggagggaaggacatcacagggaaataaatatcacaggttctcccactgatccctgagatttgaggggacagcaaactgtgcagaaataatgaaaaaaaataataaaaatagtctgataaaaacagtactgttgtttactattactaatggccttaatcagtaaggactaagattattttattttattttatttcattttgagacggagtttcactcttgttgcccaaactggagtgcaatagcgcgatctcggctcactgcaacctctgcctcccgagttcaaacaatcctcctgcctcagcctcacatgttggccaggctggtctcaaacttctgacctcaggtgatccgcccgcctcggcctcccaaagtgctgggattacaggcgtgagccaccgtgcctggccaaggactaagatttaagatttcagtagacagtgttttcaggtattaaagatcagagttttcttttaagaatctatttgtggccaggcgtggtggctcatgcctgtaatcccaacactttgggaagccaaggtgggaggatcacctgaggtcaggagttcgagaccagcctggctaacatggtgaaaccccgtctctactaaaaatacaaaaattagccaggcatggtggcgagcacctgtaatcccagctacttgggaagttgaagcaggagaatcacttgaacccacaaggcagaggttgcagtgagccaagatggggccactgcactctagcctgggcgacaagagggaaactgcctcaaaaaataataataataatgatctatttgtgtgatagactaatgtatctgcctaattgcttcatctttttcaaaatcttcaaagcggttatggtcttctatacctctcctctggtcctaattcgctgcaacagacttttacttcactttcttctgtcttaattaaatccacccacagacacacacaaacagggagaagacagaaagatttggagacccctctatctatcataagccaaaagctattagatttctgaatgtcctggatcttccagcacatttcaaagtgactttgttacccacaatggccataatgcaacattgttttataatgatttaaatttgaggttttaaaaaatgataataatatagccaattatactttttattcagctgaaaaatatgagggcctgaaaacaatgtaaatagtatttgagaagagaagacaaatccaagagctacttagaaggcagaataaacaagaattggtaactgattaaatgtgaggagtgaggaggtgggggcctagaatgactcaggatttttagtttctgcaaccgttaggtagaatgacagttgttcacaaattctgatattttgttatagggttttcttggatgtggtcttctctctgtacttaaaatttaaaaaaaaaaaaaaagaaaagaaaagctttgttaaaggttgttttctcaagccccaataaaactaacggataatccaaacagcctctttccagacttcccatcccctacccttaaggccattttccagaatactctgaaattaatgattatattaccaccacatcccctcccacacaccctccccctccctccccctgcccctgcaatctgggattatgtaatttccttactttcagcatgaatcccaaacttcttagcatgacatataagagcctttctaatttgtttctctgcttttggttcctcatttctcacggctctagtatcctgcctattgctaccagactgcctttcataaaatacagtatcatgtaaacacaaatcctttataactggggtccccaacctccaagccagagaccactaccagttcatggccttttaggaaccaggtcacacagcaggaggtgagcaacaggcaagtgagcaaagcttcatctgtatttatagccgctccctatcgttcatattactgcctgagctccgcctctgtcagatcagtggaggtattagattctcataagagcataaaccctattgtgaactgcgcattgcaagggatctaggttgcgtgctccttattagaatctaatgccttatgatctgtcactgtttcccatcacccctagataagaccatctagttgcaggaaaaaaactcagggctcctactgattctacattatggtgagttatataattatttcattatacatcacaatgtaataataatagaaataaggtacacaataaaggtaatgtgcttaagtcatactgaaaccatccctccagcccagtccgtggaaaaactgtcttccacaaaaccagtccctggtgccaaaaaggtaagggaccactgctttacgagacactcttagctttaaaagctatagggactcagatttccctattgctaaacatactacaaagccacagtaatcaagacagtgtgatactagcataaggacagacatctagataaatttaaaagaaatgaaaatccaaaaataaacccttatatttatggtcgattgactttcaatgaggatgtgaagacagttcagtggggaaaaacagtctgttcaacaaatagtgctgggataactggatatccacatgcaaaacaatgaagctggacctctaaaggacatacagaaattaattcaaaaacgataaagacctgattgtaaaagctaagaccataaaactcttagaagacaatgagtaaatattcatgatccagaattaaaagaatggtttcacagatataacactaaaaccacaagcaacaaaagaaaaaaacagatcagacttcatcccaaaactccattatatgtgtgtttcaaaagataccacaaagaaagtgaaaaggcaacccacagaacaggaaatcagtatttgcaaatcgtatgtccgacaaaggtctggtttccagaatatataaagagctcttagaactcaataataaaaggacttaccaggcatagtggttcatacctatagtcccagcgactggggaggccaaagtgggaggaccacttgagtccaggagttcaagaccagcctgggcaacataacgagaacccccatctttaccaaaaaaatttaaaaatttgcctggtgtggtgtcacccacctatggtcccagctactcaggaggctaaaatgggagaatcgcttgagcccagggagttgaggctgcaatgagccatgatcatgccactacattccaggctggggaacagaccaagaccctctctcaataataataataataataataataataataataataataatactatacaattttaaaataggtatttcacaaatcaagatttacaagtggtcaaagcacagaacatgttcaacatcagtcagtaaggaaatgtaaatcaaaacctcaataagacatgcctatacacccactaggatggttataactttttaaaaaaggagagagggccaggcacagaggctcacacctgtaatcccagctacaaagaaggctgagaagggaggatcacttcagcccaggtgtttgaggctgcagtaagctatgaccatgccactgtactccaacccaagtgacagagcaatacccccatctctttaaaaaacaaaaaaccaggaagagacaaagaatagcaaatattgcaggaaagagagaaactgaaaccctcatacactgctagtggaaatataaaaatggtagagcaagtttaaaaaacaatgtggggctgggtgtggttgctcacgcctgtaatcccagcactttgggaggccgaggcgggtgatcacctgaggtcaggagtttgagaccagcctggccgacatggtgaaatcgcaccgagatctcaccactgcactccagtctgagcaacacagcaaggctccatctcaaatacaataaaataacaacagattacttgtagggcccactttagttacaaattttatactcttaactgtctacccctttttggtttttgtttgtttgttttttgagacagtctcactctgtcgcccaggctggagtgcagtggcaccgtctcggctcactgcaacctccaccacccggggttcaaacgattctcctgcctcagcctcccaagtagctgggactataggtgcccgccaccacgcctggctaatttttgtatttttagtagagatgaggtttcccatgttggccaggatggtatcggtctcttgaccttgtgatccgcccacctcagcctcccaaagtgctgggattacaggcgtgagccaccccaacaggccaactgtcctccgcttttgtatctaccattgcacctcattcatttttcaacattagaaagggggaaaaaatacaaacaagactcaaatcacagcaaagatatccacaaatcctgtaaccattccctttcattcacaaaatgttctttcatggatatatggcactggagggggctacccagctttatcgaatccactttcctatgtttggagaattcttcactttataaggcagaaccttgccctaaaactaaagaaactgaaaaccaggtatttgctttccacatctctctcctaactgggacagggttacgtgtaagtcctgagcttttccagtcagacaaaccaaccccgactttgaaaaactgaatcaacaaaaggaggaggacgtagaggtcaaagaggaagcagcgacagaagcaagccccataagcaatccattctggtgaggttgaaggcaacagcaacagctaatttactccagtttgaattaattaatccttccagctgggcacggtggttcacgcctgtaatcccaccactttaggaggctgaggcgggcggatcacctgaggtcaggaattaagagaccagacaggccaacatggtaaaaccctgtctctactaaaaatgcaaaaattaaccaggtgtggtggcacacgcctgcagtcccagctactagggagactgaggcaggaggatcacttgaacccaggaagcagaggttgcagtgagctgagatcatgccactacattccagcctgggcaacagagcgagaacctgcctcaaaaaaaaaaaaaaaattcttccttcatccagttttaaaagggaacactgacaacagttttaggagtatctgtcaccttatgtcagagaaagtacaaatagtgtgaacatgtcacctaacagtgatgctttcactggaccagctctgcagtatagtacgtagcacactgttcctgcacaagactggttcttctaccctttaggaaattctatgaatagcccaatatcctctttaatcacaaagccatttatgattaaagtagagggatttctattatttaagactatgaacactaacgcatatttttcttagtttttttttttttttttgagacagggtctcactccatcacccaggttggaatgcggtggtacaatctcagctcactgcaacctccacctcctgggctcaagcgatcctctcacctcagcctcctgagtaaatgggagcataggagtgcgccaccacacccggttaattttttctatttttaggagacacagggtttcaccacattgcccaggctggtctcaaactcctgagctaaagtgatccgcccacctcagtctccgaaagtgctgggattacaggcatgagccaccacgcccagcctaacacatattcttagatcacaacggcatcccaaagcatcactttaaagttcagataaagtaacttcaacccttgctctgacaaagtttcgtatcttacaactccctaccttctacaagtggcatgtttgcagtctcagttcttcccacaatctactatgacccctctctccttaagaaccaatgtcaatattcgtgagactggttagcagaaaactgtcagctaaatcacatcctgacccttctttctgtacacacatttaaaacaacatcttgatgcaaactgatataaaaggaacaatttattacagatgcaaaagccaacttaacattaaacttttgtatttatatcaccataaacaatgaagtgtaagagaaaacccaattgaacagtttggttcacccatgccttcataacttcaaaacccaataatcatcaatacataatgatgacaagataaccagttcttgaatattaagaaactagaattgttgctttagcatgtttaagactatgcacctcccccctcttccctctctgacacacacacacaaaataacagcatcaacagcatcagcaacatcatgaaatacctacaacaaaaaatttcaaccctggcagcacttgagaatgacctaagaaatttattttaaaatatccattatgtgggttctttcatcagagattctgattcaattggtctgggctcgaactcaggaatcaatatttttttaacagcttcccaaggaattctaatgcactcacacagggcttagaaccagtgaagaggaacataatgttctcaagcacctgtttatccatagcattctattcttgcacagctggtgttaatgtatttaactcattaaccactgaccctaaatattagctaatcattaagccccagttggtactcgcctgtgtggaggttaccacatagtctgggaggatgacttaaaatattttattttggtgttggactgtgtcatctataattctggcttcagagaacagagtaaaatatgattgagatttaattggtggtttttctgaattgatctaggagtgatctgctaaatgctttatgtacttatacccttccactgtgcaagaccatataggggaacaaagtaacaactaaaattccttctcacacaatgggtttccacatttccttcaaaagctctacaaattgggaagggggatttgaaaagttcacaagtactgcttaaattttactaagcagtaaattttactaagtaaaaatacacacatctgtgagaataaaagtagattttcaaatttccactataacctttcaagcttttggcacccaattttatatatttatagcgataatcctctatatataaagaaagatcacggccgggtgcagtggctcacacctgtaatcccagcactttgggaggtcgaggcgggcggatcacctgaggtcaggagttcaagaccagactgaccaacatggtgaaacctcatctctactaaaaatacaaaaaaattagccggtcgtcgtggtggtgcctgtaatcccacctactcggtaggctgaggcaggagaatcgcttgaatccaggaggcggaggttgcagtgagccaagatcgcgccattgcactccagcctgggcgagaaagcaagactccgtctcaaaaaaaaaaaagaaagaaagaaagaaagaaagattccattcttgcgggggaaatattccaagacccgcggtggatgcctgaaactgcagagtaccaaaccctatatatactatgttttttcctatatatacatacttatgacaaaagtgtggtccatgaaccaatcaagctccatcctacatctacagaatcagaatctgcactgtaataagagaataaaaccaaaatactatctttccttacattagtctttataacatcagaaaatacatagtaaatgtatagtaataaaagttacatatacaatcctaaaaataacactaacgaatatttctaggataagtatataaagcatttagcaaatcactcctagaccaattcagaaaaaccaccaattaaatctcaattatattttactctattctctgaagccaaaattatagatgacacagtccaacaccaaaataaaatattttaaatcatcctcccagactatgtggtaacctccacacaggccattagttaagaatagtaacaattataaagatgttccaaggattttaagaaatacctccctaattatttcactcaagttcttcatttcatcagaaaaaaaaaaaaaaaaaaaccaggacctaagacctgaattttcccaaaccttttagatgcatgtgatggtcatttatctgagcctcccagaatgactgggaaatgaacatcctacaagtcttgccacaaaccaagtgtttaacagaaaattaggcacaagtattagctacactgaaaccttgttgctgtgtttccccttgggaatgatggctaaggtagaaccataccgcacatatttaaacaataatttacataaaattacaaatactgtaaaatacaaccactactcttatgatgaaggaatctgcacttgtttatatcaatacaatctttcatcttgagggtcattcaacaatatgactggtaatacataggtatgggcctaacaccctcccccagtctgtgagatctgacaaatcctacagtattttttaaatcaaatgctaaaaatattaattatacttttctactactcctatcttaatttttaatgggtataaattccaaggctgagattatttttcattgttttaaggttaatcaactaaccttatttaaagtgtacactgtatatagtaagctaaacatggactaaacgctgatgtctccaattctaatcctttaccacatggatcactctagcctccttctccttgcttgtaactttccattccaacagtgagaaatctggctaccacaatccaccatccacttatacttaactgtttagtatacattactagaggtatcagaattgcagtatcagaattgttaactatacctttatatgaagcaatattatcaaccaatgtacactacaagtaaagaatatgtgcagtgccttttgcctttagtattacaggcactatgcatctccaaaattaattagatcaacagttttcccccatcacccacttcaatgaggttgttttatacatctctaatacaattagattcttctgtctcaatctgcattccatcctggaatcccccagcctcctaaaagatggtcttttaaaattcgtattcattaaggtccacgctttctgctataaagtgctatgggttttgacatctgtgtagtatgcttttttcctgtttctcatcttctacatatataacatcttacaaacaattttaccaccattcttcaaacaaacatacatacttccacagtcatcttcaattctactaaacagtacagtctacatgcttgcaggcttatctccatgcacataccacctttttttttttcccacaatctctaggagactcatttcagaaaacttcactttcaagattactaacagttgtctgctcatgattaggcttcaaaagaaaaatgttaaatttatttatatagaaaacagatttcatatccttattttacaaccgagttctctaacacttatgtgtctatcaaaaataaattaatgaaagcttgaaaacagttatgaattcattatactgctttcacatccacttcaaacttcctatatataaactgatataacatgggttcacttacccagctcagtctcactataaggatttttaaacaaaatcagtccagtccactgaacagtatcagcttactgcaggtacattgtctttcataataaataacagtatcagtaatgcaataccaacacacagggaactagactaagaccaaggatataaataaggtaagaacatacctattccctggatgcctgcctgaatccaaattaaaaccttctgaatggccaggggcggtggctcacacctgtaatcccagcactttaggaggcccaggcaggcggatcacctgaggtcgggagttctagaccagcctgaccaacatggttaaaccccatctctactaaaaatacaaaaattagccggttgtggtggcaggcacctgtaatcccagctacttgggaggctgaggcaggcgaatcgcttgaacccagtgggtggaggatgggaggatgcagtgagccaaaatcacgccactgcactccagcctgggcgacaaagcgagactccacctggccggggtggacgcagtggggaagaagcttggaaatcgttactctatcctaatagtgagtaaaaagctaaacaacaacaacaacaaagatcaacaactcttcttagatccaccagagaagtaaggtcacagggcaaaccactgcccccacaattggatagacagacaaggtgataacaaaggatcataatttatcaaagcagaaatccacagacaaaaacctctctacaggagccagcacccgagtaggaaaacctaaattgcgattgatgacttgctggaggcttagtatagacaaatctgaaagttaaaaactctagggacactttttttggttttacctccaggagctctaccaggttctcacagtaaagatccaagccagtgtggtggctcactcctgtaatcccagcactttgagaggccgaggcaggtggatcacttgaggtcaggagtttgagaccagctggaccaacatagtaaaaccccatcgctactaaaaatacaaaaattagctgggcatggtggaggacacctgtaatcccagctactcaggaggcagaagcaggagaatcgcttgaacccgggaggcagaggttgcactgagccgagatcacaccattgcactctaacctaggcgacagagaaagactgtgtctcaaaaaaaaaaaaaaagagagagacctgagaaaaatacccactgctgcctgtgcaaggagagttcttgtaaagctatagtactggtaaggtctgccctcaagaaaatccatcttactacagcctaaccaacctgggggaaggaaaatatccagctccacctccctctccccgtctacacagaagaagagaaatacttaactccagcctcctctaaccattctgtcccacctaaggggatgaaaagaactgagaagcacttgtgaagctcacagcccagggcaatggctgactaaacaactgaaatatagtcattgaactatagactattttttctctccccacagcttaccatcacattacaaaaggcctatatatcacaattccttttatctgatatatcatatccagctttcaacaaaaaattacaaggcatactaaaagacaaaaaagcagtttgaagagacagagcaagtaccataaccagattgaaatatggcaagaatattgcaataaacagacaagaatttaaagcaactatgattcatatgctaaggatgctaacgggaaaaaacagacaacatggaagaatagactgataatgtaagcaaggggaaaaatcaaagagaaatgctggagaccaaaaacactataacataaatgaagaatgcctttgatgggtttattagtatactgttcatggttgaggaatctgagcttgggaatatgtcaatagaaacttccaaagctgaaaagcagattttttaaaaagactgaaaaaaagggaacagaatatctaagaactgcgttcagttcagcagcacatatactaacactggaacaattcacagatcagcatggcccctgcacaaggatgacatgcaaattcgtgaagcgttagtatttttataatatatatttttaaaaacaataagaactgtgggacaattattatacaaaaggtacaacatacacataatgagaatacagaaagagaaaatatttgaagccgtaatgacagaattccacacaaactaatgtcagacagcaaaccacagatccagtcagctcagagaacaagcgggaaaaggcaaaacaaaaccaaccaccacctaacaccttggcatatcatattcaaactgcagaaaatgaaaaaaataaataaatcttaagcaagaaaaaacaccttacttgtagaagagcaggattacatccaacttatcctcataaaccatacaagcaaatagagaatagagcgaaatattttaaaattcaagagaaaggaaaaacaaagaaaaaactgctagcctggaattctctaccctgcaaaattatccttaaaaagtgaaggagaactaaagactttctcaagaccaacaaaaattgagggatttgttaccagtagacctgcgttttaagaaatgttaaaagtagttcttcagaaggaagaaaaataatataggtcaaaaatagatctacaaaaagaaagtaacggcattagagaaggaataagtgaaggtaaaataaaaactttcttttcctttttttttttttttgacacagagttttactcttgttgcccaggctggggtgcaacagcgcaatctcgcctcactgcaacctccacctcccaggttcaagcgattttcctgcctcagtctcccgagtagctgggattacaggcacgcaccaccatgccaggctaattttttgtatttttggtagagacggggtttcaccatgttggccaggctggtctcgaactcctgacctcaggtgagccacccgccttggcctcccaaagtgctgagattacagacttaagtcaccacacctggccttttcttattcttaattgagctaacaggtaacagtttgttcaaaatagtaacagcacagtgtagtcaatgattttagcttatatataagtgaaatgaatgatggcaacaatacaggggatggaagggagaaattaggagtattttgtttcagccaattctgttgtaagtccaaaactgttctaaaaaatggtcttttatttaaaaaacaaacaaaaggcaagaggggagccctttctgcttcagtttgctgttctgtaaagcttggcactcatttttagtggtcagtggtcaataagactggtaccaaatcctcatttggcacatttccccgagagtagctaaattatgtatccaaggtaaggattaagaaagagagcctggccaggtgcagtggctcacacctgtaatcccagccatttgggaggccaaggcagggggatcacctgaggtcgggagctcaggaccagcctggccaacatggtgaaacccccgtttctactaaaaatacaaaaattagctgatgcacgcctgtagtcccagctactggggaggctggaggcatgataatcgcttgaacccgggaggcggaggttgcggtgagcccagatcacaccactgcacaacagcctaggtgacacagcgaggctccatctcaaaaaaaaaagaaagagaacctaacaggaagagataaatgctatgcctaaaaggtaacaagtagatgtcttcagtttatgcagtgacccagcagcagaatgagtctttagtctcaggatctgctttatgagactgtgcccttctctagtgcaggggtcctcaagccccaggctgtggaccagtagcagtcagtggcctgctaggaactggccgcacagcaggtgagcagcaggcaagcgagcattactgcctgagctctgcctcctgtcacatcagtggcagcattagtctcaggagtgcgaaccttattgtgaacagcgcatgcaacagatctaggttgcacacctccatttgtgcatctaatgcctgatctgaggtggcacagtttcatccagaaaccatcccacccaccccgctactgcccagtgcctgtggaaaaactgtcttccacagaaccagtccctggtgccaaaaagtttagggaccactgctctagggaaagcagaaaatggcaataggccccagcgagctaggaaagaggcattcattgcattcaaggatgcagcactgaagctaacccaagaggagtggtagctactgaggcctgctcagaggacatggtacagggatgtgatgcaggaaaagtcctgagggaaaaaaacattctcaagatctgctaggatatgacacaaacattttctattatgaggaaaatgaagaatatcggcccggcacaacggttcacacctgtaatcccagcactttgggaggccaaggcaggtggatcacctgaggttgggagttcgagaccagcctgaccaacatggagaatccccatctctactaaaaacacaaaattagcctggcatggtggcacatgcctgtaatcccagctacttgggaggctgaggcaggagaatcgcttgaacccgcaaggcggaggttgctgtgagccgagatcatgccattgcactccagcctgggcaaaagaagtgaaactccatttcaaaaaaaaaaaaaaaaagaagaagaagaagaatatctcacactgagacttgaaaatctctcccttaactcagccatttaaaaattaaactgtgacataaactccttgactacttcattttattttagactctttcaaaaaataaataataattggtgtgcaaatattaaggagcaggtttggttgttttgtttttgtatttaatctaccttagaatctaccttagaaacctgtagacacataaaagcacttaacaatgaagttgcttaattcaactagttgtgtaatatattctgcaagggcttttatcagcaacatattttaaagccaattttagtatgctttgggaaacagaaagtgtgtgataaatatctcccttggcttctcaaaagctaggctacaggcttatatagaagaaatctcacttcagcagtaatctttactaactctggttatgtaatctatttggcctctaatttattttggcctcaattagctttattttggctttgaattaagagagaatgaacatatgtacttgataatgattaaataaatatatgtggtcacagctccactttgcaatagtatacacatctgctattcatccaaaaatcatgaaaaccaggaccaggctgttatatgctgttcattagcgtccacacaaatgtaattttattgctgtgtctggtctcatattcatttgtaatgctttctggaaaataatttttaaatggagtgaaaggtagaagatgagcttcattttaactgggagggaagtaaagcaagtaaacatatattaagttttcaagatgtcacaatttcttatgccaggaaaataaaaatatctcaaactgataataagactagacacacaagccattttatacaaatttactttatacatttttattacaatccaaagcatttaatttatttgattaggtaaggataaaacaacaaatcttccaaaatattcacaagccctaatttggtaagtatactcaatctgaattcggcttcccataatgaaaatgttcagtttcaataaatctagactaaagggatgaaatttcaccctttacaagatgtaattacatacacaggtgactaattaagacattgagacttgagctataaaaactaagtgacccagatctatactagatcataaatcatgtcatgatccttgaagttacttatataatcctatccataattaaaataagtcattaatatacatattagcaagtatgaataatcctcaactatcatgcacatggtacatgaaagaatagacaatattttaaaacatgtaagtcagagtttctattctggtaatatggtaaaaagacaaccagaaaatacttcttttacaaaacatctagaactactggtgaatctttttatttgatttgtacatatacacaaaataaaatatacaaacacccctttaaatgtagaacttatcaagaaagtaggagaaatctcctgagaccaaaaatgaacaggaaagtaaaaagcagtacatggccaggcgcagtggctcacgcctgtaatcccagcactttgggaagccaaggtgggcagatcacaaggtcaggagttcgcgaccagcctggccaatatggtaaaaccccgtctctactaaaaatacaaaaattagccgggtgtgatggcaggcgcctgtaatcccagctacttgggaggctgaggcaggagaatggcttgaacctgggtggcggaggttgcagcaagccgagatcgtgacactacactctagcctggatgacagagcaagactccatctcaaaaaaaaaaaaaaaaaaaaaaaaaaaagcagtacatgtttgacctgatgctatgacgaccctggattttctgatttcagaaactgagaaacttctgttccaatgacaagccagagaagatcttggcacacaagacacagtgttagaagtaagattcctgcacaaagcatggactctcaaagaacaatgaagtagaaagatctgcccactggcagagggacacaggaagccttttttgtcttgccctaggctctgaaaaggtaggaaagatcaccaaagatttcataatcataagactgcccctacataggtttagagtttgatttattctatccacatagtacagaaactcccaacttcaaaaattaaatataaaaaatgacttctgcttgaataaggcaatgataacatttgataactcatttaccaaaactcaaactaagccgggcacagtggctcatgcctgtagtcccagaagtttttagatcagcccaggaaacggttttttttttgttttgtttttgtttaaacaacaacaaaaaaaactcatgctgagcagcgcagtggctcatgcctgtaagcccaacactttgggaggctgagatgggcagatcacttgagcccaggaattcaagtccatcctgagcaacatggtgaaaccccatctctacaaaagatatgaaaattagccggatgtggtggcacacacctacagtcctagctacttaggaggctaagatgggaggattgcttgagcttgggaggcaaaggttgcagtgagctgagactgcgccactgacgaagcgagaccctgcctcaaaaaaaaaaacaaaaacaaaaacaaaaacaaaactcaaacttcacacttgagatctgtgcaatttactgtatataaattatactttaaatagttaagtggtcggctgggcacggtggctcacgactgtaatcccagcactttaggagaccaaggtgggcagatcacgaggtcaggagatcaagaccatcctggctaacatggtgaaaccctgtctctactaaaaaatacaaaaaattagccgggcatggtggcgggtgcctgtagtcccaggttattgggaggctgaggcagaagagtgtcgagaacccaggaggcagagcctgcagtgagccgagatcgtaccactgcactccagcctgggcgacagagtgagacgctgtctcaaaaaaaaaaaaaaaaatttaagtggtcactggaaacacttccagtgaacttggcaaaagcaacccaaaatctctctggaggaatatgcccccaagtcattcagaattctcaaggacagcctctctgaagatctgttcacagtccaaaactatataaaacactcgaggaaacatttaaccttaagcaagaatccagcaggtgcaaaaaaaaaaaaaaacagaagtagatttttaagaacttcagaaaactgaacaacttgatagagattataaatatttaaatgatgaaaacacataaaagatggaataaaatatatgacacaagaaaagacatcatcaaacaataacatatctctaataagaaaatacaagaagcaatcctcagtgcatgctaaaataatcaatagatgagtggttaataaggaactaggtatttggcaaaatacaaaaggatcatcccacaaataacttaaggacacaagaggaaagggctcaacttacaaataaagatagtaactttcaggcactagagtcaaaaaccaaatattataacaaaagatgcacctaacatcccaactgctcagaaaatctgaccatctgaacctactgaataatcttagcaacactacaatataggacaacttctgatgtgacaaatacaaagtactcagtactacctatgaggcattcatgtcaaaatgttaaatctgtctctaatcaagtcttcaaatctttctttccaagtaacacagggggataaaaataagtcaaataccacaataatttgttagaaaaaaaaattgtctgggcgcggtggctcatgcttgtaatcccagcactttgggaagccaaggtgggtggatcacaaggtcaggagatcgagaccatcctggctaatgcgctgaaaccccgcctctactaaaaatacaaaaaaattagccgggcatggtggtgggtgcttatagtcccagctactcaagaggctgagacaggagaatggcgtgaacccgggaggcggaggttgcagtgagccaagatcatgccactgcactccagcctgggcaacagagtcagactccatctcaaaaaaataaatgaatgaatgaatgaaaataaaaaatctgggatattctataggacagctgacccagtcttttcaattaagtcaacaaggtgagagataaaaagggaaagggggaggaccaactgaactgctctagaaaaaccacatacaacttgtaaaccaaatgtttggactctgatttcaaacaaccaactataaagcaacatttctgagacacagatatctgagtatgaacagactaatttataacattaaagaattgttcatcgcaagttgtgtgaaagacagtggcattatgattctagaaaaaatattttttagagatggaaaataaagtatttacaagtgagatatcgatgtgtgaatctgctttaaaatatctcagctaattaaaaaaaaaaccagcctaaaagcctacacatagagagtagttgaataaactatggtacactcacacaatggtatactatgcactggcaaaaaacaatgaggaagatctctatgaaatgatatggaatgacattcaaaatgttaagttttggccgggcacggtggctcatgcctgtaattccggcactttgggaggccgaggcaggcggatcacaaggtcaggagtttgagaccagcctgaccaacatggagaaactccgtctctactaaaaatacaaaattagccagacgtggtggtgaatgcatgtagtcccagctactcgggaggctgaggaaggagaattgctttaacccaggaggcggaggttgccgtgagccaagatcgcaccattacactttagcgtgggcaacaagagcgaaactccatctcaaaaaaaaaaaaattagcaaggcatgatggcacatgcctgtagtcccagctacttgagaggctgaggccaaagaatcacttggacccggaaggcggaggttgcagtgagcccagatcgtgccactacactccagcctgggcgacagagtgagactccgtctcaaaaaaaaaaagttaagtttaaaaagaacatgcaaaagagcatctactgtatgttactctttcatgtaagaaaagaagattataagaatatacacattcacggctgggcacagtggctcatgcctgtaattccagcactctgagaggctgaggtgggtgaatcacgaggtcaggagtttgagaccagcctgaccaacatggtgaaaccccgcctctactaaaaatacaaaaattagccgggtgtggtggcgcacatctgttaatccagctactcaggaggctgaggcaggagaatcgcttgaacccaggatgcagaggttgcaatgagccaagatggtgccactgcactctgggcgacagagagagactacgtctcaaaaaaaaaaagaatatacacattcacattctgagaacggagatataataaaagaaaaaaaaagaatatacacacgtatcaactcatttgtacataaacaaattcacaagaaaaaagcagaaattattaagactaagatacctatagagaagggtggggaaagactggaaaaaagggggtaggagatgggactaggatagaagggatggggaagaagaacactttcctgagtataaatttttgtattattttttactgttaggaacatgtcaattgtttcacataacaccaaagtaaattcgtttctcacaatggtggtataggctaatgattttaaaactcccttaatgtgtacactaagatgggcaaataagaaaatctatcatgataatgagagccaggtttctcactatcacagaatagaagtaaatatcccaagtaagaaaagggagaagactacaatgataattttgtggtagtagactggaattggcgataacatgaatttgtttttacgtatagcaaagacacagaactaggggtatgtgtgtctacatacatcatatatttcctaactctgtccactgagaggtactaaactaaatacaataaaagaaaatacagccgggagcagtggctcacgcctgtaatctcacgcactttgggaggccaaagcaggcggatcacctgaggttgggagttcgagaccagcctgaccaacatgcagaaaccccgtctctactaaaaaaacaaaattagccaggcatagtggcgcatgcctgtaatcccagctactcgggaggctgaagcaggagaatcacttgaacccgggaggtggaggttgcagtgagccgagatcgcgccattgcactccagcctgggcaacaaggacaaaactccggctcaaaaaaaaaaagaaaaagaaaaaagaaaatccagtagcaaagagcatacctagtttccacatcttcatttctaaataccattctctaataaaaggagccagaactccttggagaaatagttgattcaaggagtggaacagaaaaaggacacaatgagtctggactgcctggagtcgccagaaagtaaataagtacttaaaaaacaatgagggcggctggacgcggtggctcacgcctgtaatcccagcactttgggaggccgaggcgggcggatcaccaggtcaggagatcgagaccatccgggctaacaggtgtgaaaccccgtctctactgaaaaatgcaaagaattagccaggcgtggtggcgggtgcctgtagtcccagtcactcgggaggctgaggcaggagaatggcgtgaacccaggaggcggagcttgcagtgagccaagatggcgccactgcactccagcctgggcgacagagcaaaactccgtctcaaaataaataaataaataaataaacaaacaaacaatgagggcatgtacaaatgactcaggaaccaacttgaaagagctcccagtggtcaaatctgcaacaatttgagcaagaaaatcatgacagttttggattacaacctacaggataaaataaatgcccatgaatccatactaattgtatcagaaaaacacatttccttctctcacagggtcaacataacagaacatttctgacaccagatcgctgggcggggtgacgggggggttccccacaccaagcaattctacaacaccagctgggtgtcctacaagccagttcaattctgacactatctatgtgaagacagcatcagatcccagtaacgggctcggtcctaaaagactgcctccaacactgcaggcacccgtgcttctgactggccagctataaactggatgttcccacaatcccctcctcaggttcaatcatttgctaaagtagctcacagaactccgggaaacactttatttatatttatcagtttattataaaggatattacaaaggatacagatgaacaaccacatggaaaagatacatagggagagatccagaagggtcacgagcacaggtgattccatcctaatgaaacatgaaaatggatgtgttcaccaacccagaagctctccaaacccccataattcagggattttttttttgaggctttttatataggtatgactgattattagctctatctccagtccctctcccctgcccaaggatgtgaagtggagctgaaagttccaagcttctaatcatggcttggtctttctggtgaccagcccccatccagaagcctatcaagagttgcctcattagaacaaaagatgttcctatcacccaggaaattccaagggattaggagttccatgtcaggcactggaatcaaagaccaaatattagaacaaaagatgcacctagcaaccctactgctcaggaaattacaagggttttagaagctctgtgccaagaaccaggggactgagaccaaatatattttcacaatatcacactaatataaataactgaataaataaatgagagagacaggacagctctacgttaaggtagaaagctaataatgcacacagaaggaataatggaactagaaaaatcgctatttggcaaacagcaaacatcacagtaataattaacacaggcaaaaaccatcaaggaatgctaaaatttgtggataaaagtatgatgagaaacaggataattgcacagcctcaaatatatattgcaagggaaaaaacagtaactacagtgaaaaaaaaactagcagacaaaaccatagccaagtgatcaactgtaacatcacctagtatccacataatgtgcctgctgacaggatgccctgagaagggcataataccacttctgtggtattcttgccaaaaatgtataactttaatcaaatcatgagaaacagcaaatagagccaaactgaggaacgttctacaaatgactggccaataatcttcaaaaatgtccaggttatgaacaacaaagaaagactaccaaaacatctcagattagaaaaggccgaggagataactaaatgcaaaatggtatcctggaccagagaaaggactaatggggaaaacggagaaattcaaatatggtctacagattagttaacagtattctatcaacattaattcctggttagataactgttctatggttatacaaaatgtcaatatttagggaagctgggtgaaagttacactagagctatgtacaatttttgcaactttttttccaagtctaaaattactgatatactgttttctctacttttatgtagctgaaatttcttcataagggggcacaaggaacttctaaaaaaattaaaatatagtcactgatattaaaacctcaattaacatgttaaactgcaaagttaggcacagctgaagaaagaattttgtatctagatggcaggtacaaaagaaaaaaaaaaacagaaagtggctcagagaaataatgagagagaagataaaagagcaaaattaagaggaaaggaacagggaattagaaaggaacacatatcaaacaagagttccaaaggagactaaggagaacgaaggaaaattaagaaaaaaaaggataagaattctctagaattaacaaacgacaaaaatgcttagattctagaaatatgaatcctaaccaggataaataaaaatatatccacatctagacacagggtagacaaagctgcaaaataccaaaaatcaagagaagcttttaaaaaccacaaaaatattaaaaaagataaatgataaattacaatgcaatacagacttaatcgtaccaacaattaaagccatacaccctcaaaggtctgagtgaaaataactaatcacgtagaattctatactcaactaattatcatttcaagaatgagggcaaaataaatacatttttagacaaagaccaagagttactattaacagacgcttattgaaagaaacactgaagggcatacttcaaacaaaaggaagctgaatccaaatggattaactgggatgcaaaaagcaatggtaaaataagaaattgctacactgagtaaacctaaaaacatgaaacttattttaaaaggtcctttaaacaaagctaccatgttcaattttttaaagtaattcaactcgtaaaaaaaacacaaaaaacaaaaaacaatggcttcagtaagatacctttcacaaagaaaaaaagcaccaaacacggaattcaaaaatttcaactaagaatatagctccctctcatttatcttggtcaaaggccttggtttcttcacccaaagaagggaaggaaggcatttagctagaggatccttaagattcccttccagttctaggattcaagggatagaaaacagaccttcccaatttaacagaacatccttcaaaactgtaagttgtttacaccaagatccttcatacacagggacagtgctttaaagcaagatccagtctaaagctttagattttaaataattggctatctgcttctatgcaaaagccaactggaaacggatatgatctcagaaaaagaacaaagaaaataatgcacttttaaactgttccatttttaaagagctgatggaggaaggaaaggcacggtccaagtggtaggacaatggaaacagtacaaaactcaataagcttaagtgaaaatttctaaaagaaatatagtatcaatatcaattgttacaaaaataaaaacagtcatattttattcctagttcacaaattagctgacaaacccctccttccaaaatcttaaagattcattgtaatttctgaagagtcatcaactctggaatacatcgaaggtagacaaaatccccaagtgcaggcagcctatactcataaaggtaccctattctttttcttttttttttttcatctccagccatacagaggaaggtatccttttctttataatcaccaagtttcaatcttctactaaggatgaatgaaaagctcaatgttacaagcaaagaaagcttttattaaaaagcaaagctattaaaatactgtgttatgtaaaggcattcagttatactacaactactccccttcaaaattccttcaataaatgctaggagatatggagcataaaaaagtagacaatacaattgaaacttattaatttgagacacggtgatggatattacttgatatgaagaaactaaaactggatgagagttaagatattaaaaaaaaaaaaaccctacattaacatttgagaacacatgtacacacacacacacaaagagacacacaccacgagtttgttgtttcttaatttccaagaccctgattcatatgccattcaagctaaacccataatccagatttcccgaaaagatcagtggttcttctaacacatcactcttattttttagataatgatctcaaaaaacctcatctccaaacatatgtgaatctatataatctgcctaaatgtaactggctacattttccactttccatacaaaaagaatctttttatggccgggcacagtggctcacgcctgtaatgccagcactttgggaggccgaggcgggcagatcatgaggtcaggagatcgagaccatcctggctaacatggcaaaacccgtctctactaaaaatacaaaaaattagctaggcaaagtggcaggtgcccgtagtcccagctactcgggaggctgaggcaggaaaatggtgtgaacccaggaggcggagcttgcagtgagccaagatcgcgccactgcactccagcctgggcaacagagtgagactccatctcaaaaataaataaataaataataaataaaaatacatacttttaaaatataaatatcattcaaagctgtttaatataaattcacttcaaattgaatcattaaagtttaactttataaaaaaaatctaaaatgatttggaatatgaaaggatcctaaacaaacaaacaaaacacccttaaacttgacacaggtcctcaacatcaccaagattagtacggttgcttagcatggtaactgtggaatcagactgaggggctccagcattaggagcagccacataggaatcacctctactcactgtaacataagacaactgtttactgtaactctggttgttcatttctctaacaatttcatacacacatcttcccgttgcttagtctgaactgtatactgctagtcattatcataaggaaaaaaaaatctcagactaatataatagaggccaaatttagagagaggaataaaaatcttccttcagtctaggctaaatggactgattacacaaagaactccatacatccgaaagcacacagatgtctgcactagttcccagggctcaaacaataccagtcattcaatagctttccctttacgtaagttgctatgagagagctcaatcagctcttgtgaacctcataatccaggatcctggaactctgaaaagtctacatttttcctcagcactgttttcatgtactttgtctggaactcaaacttcgtatttcccccaaaaaataaatctggaaatcatctcttctgtttgacaaatgatgtactctacctataattacttttcaactaaaaccacaatccacgatacaaatctaagatcattaacactgaaagatcatctgatgaatatatttttcagtgtaggagtttaaaatataattttaaatacgctccatcatttgtacatatatcaaatgtatatataccatttgaccagattctatttgtttccagttgagtcgtttttaaaataaccatgacacaaaatgacttctcaaaattaaaagaaattttgagaggactgttaaagctggggaggggggttgaatttacccgctctctctcccctactctcccctcctctgcctcccacattaaccacacacatcaaaaataatacaaaatatttcactgggtgtttgaccaagcctttagtccacagaaagagttattcttcactgaaccaccttcagaagctaaataacactaccttctaccttcaaagtaaattgctactgattcttccaataatcttttttatcagctaagtctttggtgaattctcacattcaataatgagaaataacaaggataaattaaagccacagaaactctaaagtattttttaatcaaatggcgaaattacttcagaagatacttatcagacctgctacccagaagtaaagctcattagttttggggaacaaaatgaaaatgattaatttactcactgaactgttagatcctgaagagtcaagaggaactatatacattcagttccctttaataatgtactatcaggtaatcattaatctcttatagaaatgatcaagatcccattccaaaatttggtaatgaagctcataacagctcttgtgccccttctaattattttaacactcttcctctcttcacattcatgttacataatgcaaataaacatgctttgaagaagaaaaagttgtctctcccaagttttctgtccttaaacagtaaagataaaccaaaccccctctctccaaccagagtacaaaatgcagaactctgaacataataaccatttaacagatatttcattaaatttcaatcatcacccttacagtggtaaaattgaacttgtcaagaagaggggaaaaaagaactttatcttttcaccacggtattcttccctaatgacgactacaagcaccaaaatcctatgtgttctacaaagcagtaacctcagaaacatttcaacaccctctgagccttacaaactctgttagcaaaacacaaactccgtttctcaaaaatatctataaagttctcaacaaccaaattctttgataactacagttacatctgagacctcctcctcaggacatccaatcgtttttcctacgatcagagccactacaatatttcctggtgctttaagagcaccatcttgcttcaacaaacacgttttaatttcactctaaaaaatacatatttgtatttccagacatctccctctaaaatttccctatactactgcccacataatcctttacagtcaaatcagtcttctcatttttctacaacatggcatcctgttcaacctctgtaaccaggcctgatatcaagataaagaagcacatataaacctttcttccattctccccaagttctcatttattacataaaaagaattcactcctttctataagtgaaatgagttttaaagcattctaatacaactgaaagctaaagaaaacaaagtattaaaatagtacaggttatttatctttggattttaaccaaatattagtcattttaggttcatgttcagatagttatctatacttagccatgacagactagccatgacaatttattcaataaagaaatatcacaaaatggtgtatactaatagtagaaatgagacatagtaacagagaagcaatgtgaggatacagttcacactctgaaatgagatttactcagagctttaagttttccttctcattagaaaataaacctttattgcaaatatatgtttagctaactagaaatgagttatttaataatttttatttttcattcaatactgacattaaataacgcttcagagtgtaacaaaaaaacactagtatcacagtatcattgtgtatataataaaaggtataagatctagattagtctatctcatcttgggctatcaaatacttctcatttcattccttcttctctctctttaaattatcttctgatatcacaaaaaataaatacagaagaaaacccaagaaatataaacatggctattagaaacccaaaacgatttacagaaacactaagaacacaacacactgggcacagtggctcacacctgtaatcccagcacttggggaggccaaggcagagcgattgatcacttaagcccaggggttcaagaccagcctgggcaacacggtgaaattctgtctctacaaaaaaaaatttttttgagacaaagtctcactctgttgctcaggctggagtgcagtggtgcgatctcagctcactgcaacctctgcctcctgggttcaagtgattttcgtgcctcagccacccgtctagctaggattacagatgtgcgccactacgcccagctaacaaaaaattttttttagctagccaggtgtggtagcgcacacctaaagtcccagctacttgggaggctgaaatgggaggatcacttcagcctgggaggctgacagtgcagtgagctttgattgcaccactgcactacagcctgagtgacaaagcaaaaaccctgtcaaaaataataataacacaacgtaactttccacattcaagtctactcaacaaagaagcccaaagaatctaaaattcctgttttcgatctttcttttctcataggggtcagggtggtgtatgtcagtggagaaaaaccgaaaggaggtatgatgatcttcgtacactgtacaaaaacttacccacttgaaggatctaaggcaatagctctgggttgatccaactcttgccaaaataaaacttttcgtaaagatccatctaaattagaaacttcaatccgattagtttcagaatctgtccagtacaatttttctccaagccaatcacatgccagcccatcgggggacaataatccagaaacaacaacattctgcacactctcagttttgttaaattctgttcgtttaatggcttcttcgctgacatcactccagtatatcaagccatgactaaacacaaagtccaccgcagctgcatcctccaagcctccaactacaatcgtagcattctctttgccatttgtagcatcaaccaatcgcaagtcccgtctgtttgcataaagcaacaaaggggccgctagaacaaaaaaagaaaaatatgtaagtgaaaaggaagaaaacgtattggttcttataaactgcgtttcaaatcggtttaagtgagcaaagactgtcgaaaataagaaaagaataaataaatcattaggagaccatctaaacttcacacacaaaatattatttttgcagcatttaaaaaataagacataggaaatggggggaactatttccaccacgatagtcttttcttgttaaaataactcagataaaattttaaagcctggctataccaagaattggcaataatatggagctactggaacactcatactctactggggtgaatgtaaaatggtacagccacttgggaaaacagtttggcagtttcctaaaaggttaaacatacaacctactatacaatccaaggcaatagctagatactgtttattccacatctaggtatttactcaagagaaacaaaaacatatgtcaatacaaagacttgtatgcaaatgctcataccaatttatttgtaataacccaaactggaatcaacccaaatgtcatcaacaggctaatggataaaaaactgtgatactgccatacaacagaaaataatgaaccctttgtacatgaaaaatgggtggatctcaaaataattcagaatgaaagaagccaggccaaaacaaaggtatatattgcatgactctcatctatataaacttttacaaaaggcaaacttttgtaaaaacacaaagcagatcaatggctgtctcaaaatagggaaagaaggtgcaaaagaatgagggggaggattaaaaatgggcatgagcaaacttttgcaggtgatgagctatattatcaataatgatggtttcggaggtgtaaacatgtcaaaacttattaaattttacacttaacataagcaaaatttattgtctatcaattataccttaataaaactgttacagtttgacagaaatagttcttagtaaagctactttattctgttctatattactattaaaatgacctttgaaaagacccgaaactaaatataaagccaatcttacagaaataacatttaactttgagaaagttgaagctgttgggagtgaggtagtataaattccatgttttttggtttttattaaatatctattccaagcttctgacatttactttcctagtatcaagcaacaattaaaaatctagagcactactgtcctacagaactttctgtgatgatggaaatgtcctctccactgcataacacagtaccaccagtcacacgcagctatggagcgcttaaaatgtggctagtgtgactacaaaattaaatttttaattttatataaactttttttttttttttttttttttgagacagagttttgctcttgttgcccaggctggagtgcaatggcacgatctcagctcactgcagcctccgcctcccaggttcaagcaattctcctgcctcagcctcctgagtagttgggattacaggtgcccaccactatgggtccggctaattttttgtatttttactagaggtggggtttcgccatgttgaccaggctggtcttgaactcctggcctccggtgatccacccgccagggcctcccaaagtgcttgggattacaggcgtgagccactgcgcccggccccaattttatataatcttaattcattccaatttatatagacaagtgtggctagtggtagtattggatagcacacatctagaggctggaatgcagaacataaatgaggcagcaaaagtaagaccaagccaggcacggtggctcacgcctgtaatcccagcactttggttaagcccgggagttcaagaccagccttggcaacacatggaaaccccatctctacaaaaaaattaatttaaaaaagtagccaggcatagtggtgcacgcctgtagtcctaggtactcaggagactaaaatgggagggtcacttgagcccaggaatttaaggctgcagtgagcctgggtgacagagggagaccctgtctcaaaaaaaaaaaaaagagtgagttatgatacaattatctacatgatcttctttcataattacttactaagggtctacaactgtgtcatctgaagccaagcccaactaccatttagaagtaacgattccccttttcaagaaattactccaatctcaaaaaagtgtaagaaaaaagtgatgtttacactatagattgtgtctgtcaaatagttataaatgtatactattttcatctataagtacaacataaacttccctaactaagcttaaatccaactttcttagtcaaaaacaaactggcagacagcttttttaaaaagtggctaaccaatctttctgcttattctgtgtatctgctgcagctatcagcaaattcataaacttccctaacagagtcacttttaattcatttctggccttcacacatcacactgatttatcagtccccacagagcccactatactgagtctctcatactatgggccaaatataaacatcagaaaaaaggtccctactagtgaaggatacaatgctaagtgctgcataaggctaaggaatacccacgaaacacttaaaattgaaaattcaagagtgataatcatctaatatttactgggcaccttctttatggcactatcttggaaaactatatcaaagctataggacattaggtggcagccaaatgtctttcattgctttcaagtcaaactttaacacttctacgtgtactgaatatttttggtctacaaaatccaaaaacgctttctggtcagttaaggcctcacaagcattctgagtctcttctccctcctgaaaacgggtgaaggaggcaaagttaatcttttttaagttagcaatactggttacaattgaggatttgtaaaggactgtacataaatctgctgcacataaaccacactattgaaaggaaatcccagggttcatcctgtccaaccacccttctgatgcttgaatactttctattacattgtcaccagtatctgttcagcaacatattaaatgggatatctgataggtataatttgatttgtaacattgtttttatctaccaaacagatacactggaaccacatacttgctccctggaacatgccagtatcttccattccagagagcttactttctgactgcctagtattcagataacccaaataatcaccatcacttctcttcagtggaacactcacagtgctcaggaatccttgttttcctttattaaactcctgggaaactttctctaccagcctttctaagccttttctacttttaaagactaatttccatgccctgaatcctttatcctcagatcatctcataaaacaatctcagtgaagcaggatacaaggtaaatgtcatacatccccaacatcttaatttatacctctcaaaattttctctccacccatcttcccttaccttgtcctcagtctcaaatgagaagatggccttcctcctaaggctaaagcaatactttcggttcagcctccttacctcctctctacaacttcgctctatcaattgttctgtatttctcgtattttcaatggtttacgccaggttccttgctattgttttgttttaataaccctaaccttgctaccatcagaataataattatatttctactaactgcaaaatcttataacattggtatatatacttcacactaccattcattagctattactcttttatctaacttcctatccatcactcaactgcaagtgcttcctctaaatctttataaccaaatccagtggtcttttctcagtctttactcttttttttttttttttttttttttttttgagatggagtctggctctgtcgcccaggctggagtgcagtggtgcaatctcggctcactgcaaggtccgcctcccgggttcacgccattctcctgcctcagcctcccgagtagctgggactacaggcgcccgccactacgcccagctaatttttgtatttttagtagagatggggtttcaccgtgttagccaggatggtctcgatctcctgacctcgtgatccgcccgcctcggcctcccaaagtgctgggattacaggcttgagccactgcgcccagcctctcagtctttattcttaacacctctagagcagtcaatgctgttgactatatccctacctatatagaatgttctcctcatacaatactacctattttttcttgtcttgtttcaaaccttccacttcctatatataggtatcctaagactctctgttgttccaaatgacagagtataaaaaattaaagttcacaagcaacagcaacacaaggtggcagccaccacaggctcgggggtaaaagtcccttgcaatttcccacttttggaagaactcaaagaaggccagaaaggagtaggagatggcagttagctgaggtctagacaatgataaagacgtgacacttacaagacgtacagggatgataattgggcctgcaagaacaatttatgaaaactgaatatacagccttaaaataaaatgtggacctaaatacccagaagcacccccctttgtaagatttgtaacaaaaaattaatatgaatggagttaatagttctaatggattggtggacccaagagccatatcagtgctagcaaaatggcagaattcacagcaccaaagttgtcctgcaagagctttggcgcctaatggtgtctaaagaaaatatgaaactccctcagccacctcaaggacagtgttacagcaactaatcgaaaagaaaaaccacaacacagtgttacagcaattaatcgaaaagaaaaaccacaggcccttcctcttccccctcattcaatttaagcagtcttcattttccacagcagcaaattttctagatatgtcttgtagacctcaaagtactggaaaggaagctcccattcaaaggaaatttatcttaagatgctgtaaaactaattttttgtccatttgaaatatataagttgtgctataacagaaggaaggaaggaaggaaggaaggaaggaaggaaggaaggaaggaaggaaggaaggaaggaaataaattaattaaagttcacctggtcaacaagcaattctatgcagctaattcccaaaacatcatctctagttctgtccctctaactttttgttggccatctctacctcccgttaaattaaattcatcacctttcccccaaaacaacaaaatccctcaccagtcaatggtacacaattctaaccttactggcatgccttggagccatctttgagcccctccccttttcccctagtctgacaattactgtcttgttgactcttattttacaagcatgtctttaaatctgtctcctcttctccatttttaaaaccactatcctactctagaccttcatgactttaggcctaaaatatcctaatagtaagttatctcaatattctcccctttccttttctacttctaatactttcagtttagccaactcaaaagccattctgattccccttgcctaaatttacaaaatgcctcaatacctcagccttccaccatgacttctacctaggactctaaattaatcttttatagtctctgcatcatacaaacaggtttcaaaacatgtaaactgggagtacatcacacccatcattgcagagtattcattttcctgcctactccatacttctctttttctcccagcaagcaagtccttcaaggccagagtcaaaccttacctactctgtaaccctttctaattgactcagctttacttcttttaatccttagtctttagtacttacatgatattagctttttttttttttaagcatacttcctacctctaggatctcagcccttggaaacaagaaccataccttataactaattttatcatcaatgcctactacagttcactgcacacagaaatatcatatacatatttactaatattttgggggttttgttttgagacaaagtctcactgtgtcacccaggctggagtgcagtggcacaatctcggctcactgcaacctccgactccctggttcaagagattctcctgcctcagcttcccaagtagctgggactacaggcgcccaacaccacacccggctaatttttgtatttttagtagaggcaggtttcaccatgttggccaggctggtctcgaactcctaacttcaaatgatccacccacctcagcctcccaatgtgctggggtaacagacgtgagccaacgcacctggcttgatttttttcttcttcttcgtttttcgagatggggtttcgctctgtcacccaggctggagtgcagtggtacaatctgggcttaatgtaaccttcacctcccaggttcaagtgattctcctgcctcagcctccctcgtaggtgggattacaggcgctcgccaccacacccagctaatttttttgtatttttagtagagacgtggttttgccatgttagccaggctggtcttaaactgctgacctcaagtgattcgcccacctcggcctccgaagtgctgggattacaggcgtgagccaccgtgcccagccaaagccggctaagatttgacgggtttatttgtaagatgtttttaagtgcttatcaaatattatagttacgtaaaactagattttagttttctctgttaaaatgacggattttcttcagttattagtttgtctttttgatttttgttttttgagatggagtctcactctgtcacccaggctggagagcagtggtgggatctcagctcactgcaagcaccacctcccgggttcatgccattctcctgcctcagcctcccgagtagctgggactacaggtgcccgccaccacgcacggctaattttttttgcattttttttagtagagacagggtttcaccatgttagccaggatggtctcgatctcctgaccttgtgatccacccacctcgacctcccaaagtgttggaattacaggcatgagccacggtgccccgcccattagtctgcttttaataaagaagttattaaaggttttcctttgccttctgaataatctccacagaaggcaaagattgtgtcttaccagaatttcctgtgcttaatgctgactttatcatgtccttaattacttaaaactgtattcacacccttaaaagggtaaggttcttcaccactgcattacctcccatgcttacttttttcaatattttttttaagagacagggtctcaccctgttgtccaggctggagtatagtggcacaatcatggctcattgcaacggcacaatcatagctcactgcagcttcaaactcctgggctcaaacgatcctcctgcctcagcctcctgaggagctagaactataggcatgaaatctttcgcccagctaatttctgtagagacaggatcccaccacgttgcccaggctggtctcaaactcctgacctcaagtgatcctcccatcttggcctcccaaagcactgagattacaggcatgggccaccgcactgaactaaaatctttttttttttccggtcacttttggttaaatatgtagccaagtatttttttccacagtggcccatgatcctatttaatcaaatgttcaaacctcctaaatgatgccttttgtaccaacaactgtctttgagatttcccctaaggggccctagaaaatcaaaattccctttaccttgtaaaagagagatgttaaaaataatagtttatttgatcaaacgttatgggtcatatggaaagcactgtcaaagccagagaggcttaccctccctaagtttaagttaaatttgtataggtaaaatgttattaatagggatattttggaagttctatgaaggtataaagctcctagaaattcatcaatgccctcattgtccatgtctattaatcagagttctggtgctgctttgcctggtattagacaacagtataatgtcatcagtcataatttcagggattttttttcctcaatgttaacttggtcataatttggcttctttaatcttctaggttggctaatggttctcagttaagaattcacatcatttacttatggaatgctattatatagaagttaacgacctactccagactgctaaatctttttccttgataatcttgatacattcttgatatactctatacatatatacattcttgatatactcttgacatattcatggtccattacatcttaggattatatgtctttagattttctctctgcaatgaatatattcatctatattcataaatgacatgtactagccactcttctttaaaataaggttaatcggctgggcgcagttgctcacaccttaatcccagcactttggggggctgatgcaggttgatcacctgaggtgaggagtttgagaccagcctggccaacatggcgaaaccctgtctctaccaaaaatataaaaattagcagggcgtggtggcgcgtgcctgtaatcccagctacccaggaggctgaggcaggagaatcactggaacccagaaggcagaggttgtggtgggccaagatcgcgccactgaactccagcctgggcaacacagcgagactctgtctcaaaaaataataataaaataaagttaatcattacgcttatagatatgcttttgtctaacacttttttgggttgattttagttcgcatgccacaaaaatcaaacttccttgccaatttcattatcttttctaacaaagtttcataagatctttcactttttttctttttttttattattatactttaagttctagggtacatgtgcacaacgtgcaggtttgttacatatgtatacatgtgccatgttggtgtgctgcacccattaactggtcatttacattaggtgtatctcctaatgctacccctcccccctccccccaccccacaacaggacctggtgtgtgatgttccccttcctgtgtccaagtgttctcactgtttaatttccacctatgagtgagacatgcggtgtttggtttttcgtccttgcaataggagatctttcacttttaagattatcagtaataggttaatcatcaccgttttaagtattttgtcatctacagatagttttctgttttactctaatgcttccctgaaagcacttgcaaatcagctacaggccagagtgcacttgtcttcaataaaaaagggctatgggccaggtgtggtggctcacgcctctaatccccacactttgggaagctgaggtgggcatatcactggagcccaagagttcgagaccagcctgggcaacttggcgaaaccccttctctaccaaaaaatacaaaattagctgggtatggtcgcacacacctgtggtcgcagctactagggaggctgagatgggaggatcacttgagcccaggaggtcaaggctgcagtgagccaagattgtgccattgcactccagcctgggtgacagagtgagactctgtctcaaaaaaaaaaaaaaaaaaaaaagaaagaaagaaaaaggaaaactactacgccaggtaacctgaacacaagcgtctgatggcatcacttaaataactctgagaccacaccagtggactgagtcaagatttccaaacagctagtagaaaaacagatgggttcgtgagactgctaacacagatccagcagaacaagaattaattacataggactgaataaactgatgaaggatgattatgggtttcgtttaaaatattgctgatgccttagcgtcctattttctggatataaggaacccctttctcttttctctgaagctatctataactcacaacaatttaaggagactatgtttttgtaaaccgaaataaacacttatctttttctcccccgtcttactcctccagaattcaaaaactcttattatttttattttcatggcaatatagttatctgcagaggttcaatgagtctgccttctagctggaaacattacttatgcaaccaaggctttgactggaatgccacatttgaaaatattcatttaatcaggtatgaccaaatacttctaagttacagttgactttatgaaccaacgcttacagtcctcttaggaaaactggcctggtaactggcttacagagttcccagccttgcaggtgaattaagcaagatcacttcccggcaggctcaaaaatcctagaatattttgggaacttcaagacaggaattcacccaaatttataggtattacaagtgaaacctgatggtcagttcttgacttacctttatagtctcaagaggcattttaaagtccaatcagattccttaaaaaaactttcagcaaggcaatattaaaagacctattatatgataaattactattattgctacacctatgtaaataatcaggcccaatctaatgagatcaacttctcaatgactcttattccattgtcaacagtgactgattttgttttaaacaacagggagactgaccagtgcacatcacaattgcccattacttactcattgacttggcttgaataaactttagtcaggattctcttctccccacaaattcctaaactttggcttgccctaagcttaagaaagtagatgcacaacttcttccctcattctgaccattagctgactgcagaaaaaaaaaaaaatgctttccagttaaatagtcctggtcatgcaatctgctcacccctacctatttggcccacattcccacaaagttcctgatagccctgcttacttctcctttctataaaaaaaaaaaaagcctttttcggtttgattttgaagtgtgttgcagatcctgtagtaagcatgtccttctactgcaaaaatcctttcaaataaagtctctccttacctaagtctagctttgtttttgcttttgggtttggtcacttttttttttttttttttttttgagacagagtctcactctgccatccaggctggagtgcagtggtgcgatctcatctcactgcaacctccacctcccaggttcaagcgattctccctcctcagcctctcaagcagctgggattataggcaccaccatgcctggctaatttttttggattttttttgtagagatgaggtttcactgtgttgtccaggctggtctcaaactcctaagctcaagcgatcctctgccacggccttccaaagtgctgggattacaggtgtgagccactgcaccttggcctcagctttgtttttatttacagtataagtactatgacaaactacctatttgcaaatgccaaattttacattaatatgtatttccctctatcaaagtcatcagcatctctttcaaaaccacaagaaggcccaggtaaaataaggtacatacagaaagtcctgcacgtaaaattactgtccagagtacaaacaatctggctttagtcattcatctttctgatttataaaacgaaggagttggcccaggtaatttctaatacctcttctattttcttactctagatatgaatttagtaaaaagatttaactgcaacaggacgattgacagggctattcagaaacacgagatactggtaaactatttagtgcttctccagcagaaaaacaggaacttaaaatattttttaggccaggcgcggtggctcatgcctgtaatcccagcactctgggaggcagaggcgggtgtatcaccgagcccaggagttcaaggccagcctgagcaacatggtgaaaccccatctctataaaaaatacaaaaacttagttggaaggatcaccggagcctgggaaggtccaggctgcagtgagcaatgatcgcgccactgcactccagcctgggtgacagagacaccagctcaaaacaaacaaacaaacataggccagagtggtggctcatgcctgtaatcccagcactttgggagccaaggcaggcagatcacttgaggtcaggaggtcaagaccagcctgaccaacatagccaaaccccctctctactaaaaatacaaaaattagccagcatggtggcacacgcctgtagtcccagctactcaggaggctgaggcatgagaatcacttgaacccaggaggcagaggttgcagtgagcagagattgtgccactgcactcctccttgggtgatgaagcaagactctgtttcaaaaaaaacagatttttttaacgtatcaaaagctgagattcagaaataatttctcaaggtaaagactccaataatcaaacccacactcatttgaaagtatttaatatatccatacaatggattactcagccattaaaaggaatgaagtactgacacatgcaacatgaatgaaccctgaaaatgctaagtgatagaagctagacacaaaaggccacatattttattccatttatatgaaatattcagagtaagcaaatccatagagacagaaagtaaattcatggttaccagaggctgagggaagggagaaatgggaaatgtatgggttttgagggagcaggggatgataagcgttctggaatgagatagtggtgatgttttacaaccctgtgagtatactaaaagccaccgaactagacattgtaaaatggagatttttactgtatgtgaattatagctccaaaaaacttggtttaaaaaagtacttgacaggccgggtgcggtggctcacgcctgtaatcccagcactttgggaggccgaggcgggtggatcacgaggtcaggagatcagaccatcctggctaacacggtaaaaccccgtctctactaaaaaaatacaaaaaaaattagctgggcgtggtggtgggcgcctgtagtcccagctacttgggaagctgaggcgggagaatggcatgaatctgggaggcggagcttgcagtgagccgagatcacgccactgcactccagcctgggcgacagagcaagactccctctcaaggaaaaaaaaaaaaaaaagtacttgatagaaagggcttaatgaaaaaaaaaaaagaaagaaagaaaaaagtacttgaggccaggcatggtggctcatgcctgtaatcgcaagcactttgggaaaccaaggcaggaggatcacttgagcccaggaattcgagaccagtctgagcaacatagtaagaccctgtctctacaaaaaaaaaaaaaaaaaaaaaaaaaaaaaaattaaaaatgagccgggcgtggtagcacgtgcctatagtcccagctactctggaagctgaggcaggaggatcgcctgagaccaggaggtccaggctgcagtgagccatgatagcatcacaccacactccagcctaggaaacacagtgagaccctgtctcaaaaaaaaaaaaaaaactaattatatcagtgcaatagttatatcctaaaaccagaaaacacgttacatagtccacaccttgaattcaatctcagatatgaatatgctgattttttagtagtctatttaacatatctaatctatgctaagaaatctttatttatttattttgaaagacagggttttgtctgtgatatggagtgcagtggcatgatcatggctcactgtagccttgagttcctgggctcaagtgatcctcctgcctcagccttctaagcagctgaaactacaggcatgtgccatcgtgaccagataattttttaattttttatagatgtttcccaggctggtcttgaactcctgacctcaagtgatcctctcgccttggcctcctaaagagatgggattacaggtgtgagccaccatgacccagactaagaaatctttgtaatcgttacaaatttataatttaactatagctaatgaacgattgagtcaaaacacaaaatggcattccaaataaatgtcataaaaattcacatctttttatattactttaaatgtaaaatttacagtgctcaatatgtgcaaacctctggtacatggtgcatataaaggggaaaaaggtctactcttcaaaaacttttcatcaaagagctatttctgcattagcataaatctagaaggttacaaataaagacaatataatgtgtagctaagaattcatggtaatgaagttcactcgtcacctttctcagacttgcaaaacatagtatctttaaactggatatatggatatacagtacttaaattatacgtaccaataaagctaatcattagtgaggaagactcctatcccttgcagtcctttacttgtagtttgggtcttgtagtgataaaacaatgactaagaccattagagaaaatagcctcctggttaaacatacataatttgataaaggtaggtttccaatatttgggtgactattttcttgggaaaaaaaaaatgacagctgtgtgcagcaggctcacgcctgtaagcccagcactttggaaggccaaagcgggtggaccacctgaggtcaggagttcgagaccagcctggccaacatggtgaaaccccatctctactaaaaacacaaaaattaggtaggcatgatagtgggcgcctactaatcccagctacttgggaggctgagacaggagaatcacttgaacccaggaggcagatgtcacagtgagccaagatcatggcacggcactccagcctgggtgacagagcgagactccatctcaaaaaaaaaaaaaaaaaaagactactgctggtcatgttatttttattgagagtctcatcaataactttaggcctggtgttaataacttacataacttaatgtagttttctgcctaaaaatataatttcattttgcatccccaatctcctcctgaaattagttccaaaatatttaagcacttatacaaggtccttccaagcaagatattacagaaactacaagttatgataccgctaaaaggatcacagcatcaaagtatcaataattttcaccgaagagtccaagcacattttaaaagtttctagcctcacacccgaacagcttgaacctttagtgagaatactcactgccgcaaacacgaacagcttgagaaacaaaagcatatgttaataataccaaataaccttgtttccttgcatttatgtactgacaaattgtattttaaaataaataattttaagagcaaacagcctgttcttagattgcctagtctgtatatttgactaaatttcaaagttactcatataaaacagtgttttattcactgaagtgaggcttactttatagaagataaacacccttatccgaagtgaaaacatgcaatgcagaaactcagtatagcattcagccatcctgcagaaagaaatccaccaactgaataattgttgtaaacaaataatgcaatttctcaattagatgtcttgataaaattattttgcccatgcttaactctttaataagtatcacaatcatttgaactgtctgttctgtagcttatttataataatcatcacctaaaatagttatggctgcaatcctttagaaataaatttaggccaggcgcggtggttcacgcctgtaatcccagcactttgggaggccgaggcggctggatcaccaggtcaggagatggagaccaacctggctaacatggtgaaaccccgtctccactaaaatacaaaaaaaattagccgggcgtgttggcggggcctgcagtcccagctactcgggaggctgaggcaggagaatggcgtgaacccggggggcggagcttgcagtgagccgagattacgccactgcactccagcctgggcgactgagcaagactccgtctcaaaaaaaaaaaaaagaaaaaaaatttagtgtcattccgttttatatcaaacaaaacagaaatttccataagtaaaagtattttatggagcttttattccagttgcagaagaatcaaaaaaaattccaaaaccactggcctaaaactatcaactgccaaaaacagtgcccaggacatagcgacacttaaaatgttttaccagtctttccagagtataatgtttcttttaattcggccatcttaataatagcaaccatttattcaatgtctactattgactgtgcgttctactacccctttacaaacatttcgtcagttctcacagaagtcttgcaagttatatccccacctaacaggaaaggaaataacttgtccaaaggaacacaaagcggcagaagagtttaacttggcctgtttaacaacaagccatgtctttctgctatagtaccttccatataatcttctctaaatgtaaactttcaatagaatttctacgatgaaaataatctttctcagagtagttacccatggcctaaatagcactaaacattatttttccagtatgcgcaaaatatttaaacaaaaaatatacgttctcataaaatattttccattaatatatcccttcccagaatctcctttgatatttaaaacagtcctttctgacagccaaagcatatataaggacacagtagttcagtacagcaaatggaaaaacttccaattaaagcaaagaaaaaaatctcttaaaaattgaatcatggccgggcgcggtggctcacgcctgtaatcccaacagtttgggaggccgaggcgggcggatcacgagatcaggagatcgagaccatcctggctaacacggtgaaaccccatctctactaaaaatacaaaaaattaatcgggcgtggtggcgggcgcctataggctgaggcaggagaatggcgtgaacccgggaggcggagcttgtagtgagctgagatcacgccgctgcactccagcctgggcgacagagcaagactccgtctcaaaaaaaaaaaaaaaaattgaaccacaggaaatcactattagcccttctgataataacaagctaaaaccttaaaatttaataaccagacaaattattgtttagccaaatgagcaaacctgaagccaggtaagtaaacaggaatgacagtatcaaattaactatatgaaactgtcatcaaatatcaatgtaatacttgacaagtttggaaaataataggttaaacaaagttaaaaccggtctctttacctcaggacttttcagaacccttaatgtgttaacatgaattctaatctccaaataaagtgtacagagatcactcaaggttacacagcaaatttagaaccataacttaattctcctgattgccactccaaaatttgttctacttccccaagactttataacacctgattttaaaggaagaaaggatcgcttctacagaaatacaagatgcaaaacattagtggtttgttccaacaatatttaccagcccaccaaaacaaaaaaaagtaacgaagaatttttatataacaagcctcctcaaaaaaagctaaaaaggccaggcgcggtggctcacgcctgtaatcccaacactttgggaggcagaggtgggtggatcacctgaggtcaggagttcgagaccagcctgaccaatatggtgaaaccccatctctactaaaaatacaaaaattaggccgggcacagtggctcacacctgtaatcccagcactttgggaggtcaaggcaggtggataacttgaggtcaggagttcaagatcatcctgaccaatatggtgaaagcccgtctctactaaaaatataaaaattatccgggcatggtggtgtgagcctgtggtcccagctactcaggaggctgaaacaggagaattgcttgaacccaggagggagaggttgcagtgagctgagatcatgccactgcactccagcctgggcgacagggtgagataccgtctcaaaaaccaaaaaaatacaaaaatacaaaaataagtcaggcatggtggcaggcacctgtagtctcagctactcaggaggctgagacaggagaatcgcttgaaccaaggaggcagagattgcagtgagccaagatcgcggcactgcacttcagcctgagcgacagagcgagactccgtctcaaaaaaaaaaaaaaaagcaagctaagaaatagtatttcacagattacacacaccgatggtattccaaaacctatattcttatcaaaaatacttccagcagaagatcagatattattttttctcatcagtatccgaatggaactaagaaaatggtaaggatggcaacctaaactgtgaggcccgttagattaggaaacacattgttttactcaccatcagtaccagaggctgacatataggaggtattccatacatatttgctaaaagaatgaataataaatccctgccccatctttaattaacctacctttattaaattacagtatctctgaatctgagtttccccacttacaaataaactggtgaggctcaaacgaccaagatccctttcacttttaagaatgtgtgaatctgggccaggcgtggtggctcacacctgtaatcccagcactttgggaggccgagatgggcagatcacctgaggtcgggagttcgagaccagcctgaccaacaaggagaaaccccatctctactaaaaatacaaaaaaaaaaaaaaaattagctgggcatggtggtgcatgcctgtaattccagctactcaggaggttgaggtaggagtatcgcttgaacccgggaggcggaggttgcagtgagccgagatcatgccattgcactctagcctgagcaacaagagcgaaactctgtctttaaaaaaaaaaaaagaatgtgtgaatctggccgggcgtggtggctcacgcctgtaattccaggactttgggaggccgaggtgggcggatcacgaggtcaggagatggagaccatcctggctaacacagtgaaaccccgtctctactaaaaaatacaaaaaaatgagtcccagctactcaggaggctgaggcaggagaaaggcgtgaacccggcaggcagagcttgcagtgagcggagatcacaccaatgcactccagcctgggcaacagagcaagaatccgtctcaaaaaaaaaaaaaagaatgtgtgaatctgcacctgtaatcccagaactccgagaggcggaggtgggaggatcacttgagcccaggagtttaagaccatcctgggcaacatagcaaaactctggctctataaaaattagccaagtgttatggcacacaactgtggtcccagctacttgggaggctgaggtgggaagatcacatgaacacaggaggtccaggctgcagtgagcagcgatcatgccactgcactccagcctaggcaacagagcaagaccctacctccaaaaaaaaaataggaattcgtgaacctggccaagcatggtggctcacacctgtaacctgtaatcccagcactttgagaggatcacttgaggccaggagttggagaccagcctgggcaacatatcaagacacccccacaccaaccccatatctacaaaaaattgggggcatagtggcacgtgcctatagttcagagctttgggaggatgaagcaggaggatcacttaagcccaagactttgagactgcaatgagctgtgattacaccactgcaccccagactgagtgatgaagcaagactttgtctctttaaaaaaaaaaaaattgtgaacgttatacaaattaaatctcaaatcatgaaagcatttgaggatatgtccctgaacaagcaaaaattatagcaaaaagtaacattaacaaggtactccatattatttcatttaaaacacccaataaccctgcaaactagtcaggtatcattatccacactaccagtaaagaaactgagacctagagaagcggactagaccagaaccacaaagttatgaagttgtgacacttgggctttaaatccaagattttagtattgaaattcccaaatctttcctttataccttgtcatgtgatgatagagatagggacacagcactaacagtattccctggctttctgctactaattcaacagggctacaggacagaaggtctcccagactctcacataccccatcacacccagccaatgttaaagccccaattctttgtgggggaaaaaaatgacctaaatgcaacaaatcaatcagatttttctccttggagtccaaggttgactaaatatctttactataacagaggatgacattctcaaagaatgaattaattctaaattatgaacaaaaatattttacatcaaaagacagttttacttcaaataatatgtactcacagctaagtacagtactgttacatattagaagaccaccttacaccatatttcgccacatttaaaacgagagctccacttctgaaaactttgctagtggaaacgagacaatttaaactattacctcttccaggtcttgttacataaataagtgcaacctatctaaattccaataatgaacaaacccagctctggtctcaaagctggtgttaaacaaacggcatttacatcacacgcttctcctccaagaaatacaactagacaaccagaaacatcccaagttataagttttcccacgactctaaccaatcagctggttctcatatttgtcagccctattaaccttatgtcttaaaatacatacatattcttatgtcaaatatagttgtttctaacagctacagcaaaacccctttcaatagagtatgccaataataaaataagtatatacttatgaaacctctccagtacgtaacacttcattaaaatttctgccacaaaaatctaatgaacactacctttccggggtttacatgtgggaaaactttgtaatatgcttagagtatcaagtaatataacatgcaaacacaatgctgcattactacagagtaactgaagaaagtatttctcctcctccaaaaaaaaactcaatcattctcatccgaaatacatatacacagtacacgcaaaaatatacacctgtcacagactattagttactattagtgttctgtaaacttaaattagtttggagaacttaacaaaagtttagcttgttaacacctaaaaatctccagcgaccagcggtcacatgcctgaaaagaacttactatgaacgccagtaagaactttaccaaaccaaaactacaagccaccgtatcgagcagtacttaaattcctctgctggtaaatgctccacagccatcacagccatctcaagttcaacactaaatagtttgagaagagctgccgacgggccagtcaaaaatctttgtgaactgtcacaaaagtcacagagcatgtgtcagctttgcagtccaattcaaaacatcatagtgccatcgaattcaagcgattcccagagcaaattatctcgaacagcctatgcaatttaccaaagtgccaagcagtccccaggggtgcagagcaaattatcattttggtcccaggaccggctcctcttcacacgaggatgaatttccctacttagtgccaactgtacacttgcatactccgaaaataggggcaagccgtgaataccagaggttacaagggcaatgttttattttattatgggctgaagctcagaaggctcccaatgctgaaacgctcgacctataaccccggagtcactttccaactgcgctctcacccagggtcattatatcccaaacggaagccaatcattacctgtaacaaggcctggaaaaaatagcaagagggctttaaaagttcacctaagaaacaccgaaacggggtggggagtgggtggcggggcttcgatggataaggccaaccttaaagcatctcggactcaaacattttaaaagccaaaatacgtacaaagacccttttccctggaagaccccaggcagagagaggcacacagacactcagtcatcccgacagcatggggtgccaagggttccctaagaccagcagccgggatcgaagctccgatgtgtccggggaaggtctgggaagccaggccaggtccgcattgtggccgggcggtgcacgcagcccctgctcccgggcccctttctctccccctccccacgaccaggcctctccccgctcctctccccttctcccttcctccgtccctcccctccccctagacacatacaacaaggccacctccccccgaaccccaccaactttccagtgcccccactcttcccacctctcaggagcacacagaagctgcaggccaggaggctcctcaggacggcccccatcttcccttctcgcgttctcttctctcaccggcgaggggtggccagaagtgggggaggcgaggagccggggcggccgccgcagcggcagggctgcacgctcatacttcccagcttcccagcgagagaagaaagaaaggggcacgtcaaggttccgcgcgcgccgccgccgccctctctaccgcgccgctcggccccgggctcgcgcgacgccagcgtctgcttccatcccgccgcctcctcccccggcgccccgcttcccccgcgcagctcctcattcagcctctgcctcgcgcagcggcgcagggatacggtcggcaccgcctcctagggtcgccgcgaccgtgtccctgcgcgcaacgagccccttctcccggtactgcctcctgtacggccagggaagggagtcggcaaccgcacgcacagcctctgcctgagaccctgggagaggttctgggctagcagaggcgaactgggagggaaagcctcctcccggtggcgcattccagcgggattctttcccggaccggccgcttcggccctccccgcggagggcgtgaggcggcgttgaacaacattggagccggcgtggtcgggactactttctgcggctcggccgggcagccgtctgccccgctctttgtgcggccgccgccggcagggccaggtggggctccggtctcgcgcccccagccacctgagactgcccagccgcggtgcacgcgcggggagccacggcggatcccgttgcggggtgatgagctccgtcttcggggttggaaatcggtttcagcatcctttttttgggagggcggaatttttgaacgctgtttacaccggctttcagcgtggatctggtgaacgatattaaaacgccaattcaaaactgagattgtcatttttctcccgccttcccagaaatacaaactgcccccagaattaagcccgaccagctaaagatttctaaactggcagataaaattccaagataaatgcctcaaaacctaagagcaaagggacaattggacaagactatttaggattttacaagttgcatataataacgaatgtttggcatgcttcgattatcaattctcagcttgagaaggaaaagattccctagaatctcagactgtgcacagcctctgctactcccagtgcattgggcattcaggagtaatggcccagacgccccctgaaatcacctgccaggctttcgtctgggcagaggcgctccaacagttaaccctaatggagccatcagatgcatcctgcccagctgtcacacgcccttacctggaggcagatgggcaagaaagtggagctgctaccacaatgttaacaagtacctcagtgacattggagttcactagtgcttgaacacaagttatcatatttgacactcaaaactaccctggggaaaggcaggttttgttacttattctttattgcacagaggagcaaaatgagaacctgagaggttaatgacttacccagggccactcaagtaatgaatagcagtacctcagcccaatccaggtctctgacttaagccactccgctccttccaagaaatgcgcgctgaaccaaaggtgctgcaggtttgtaagtagatggacagcagaaacagccaaatcactttctcccaaattcacctgaggtctagtcaccgtttatttaaatgacctgcttctaagaaccaagtgagttttgtattctggcttcctcaaagcaggaaactgggccgggggcgggtggctcaggcctgtaatcccagcactttgggaggccgaggcggacagatcacgaggtcaggagttcgagaccagcctggtccaacatggtgaaacccccgtctctactaaaaatacaaaaaaaattagccgggcatggtggcacacgcctgtcatcccagctgctcaggaggcagaggcaggagaatggcttgaatccaggaggcgcaggttgcagtgagccgatatcgcgtcattacactccagcctgggcaacagagcaagattgcgtctcagaaaaaaaaaaaaaaagaaaagaaagttaaccttcactttcacaggccccttccaatgtctggggaggggcctttatggtatgttcacatggtcctatttgcaaaacaaagataattttgaattcctcttctgtataattgtattatacaaaattgtataagcttcaagtcccacaaagcctggatctgtccctatttataatagaaaatgcggtacaactggccgggcacggtggctcacggctgtaatcccagcactttgggaggccgaggcaggcggatcacgaggtcaggagatcgagaccatcttggctaacacggtgaaaccccgtctctactaaaaatacaaaaaattagccgggcgcggtggcgggcgcctgtaatcccagctactcaggaggctgaagcaggagaatggcgtgaacccgggaggcggagcttgcagtgagcctagatagcgccactgcagtccagcctgggcgaaagagcgagactccgtctcgaaaaaaataaaataaaataaaaaagaaaatgcggtacaacctaaatctcctcagactatcaacctaagtaggggaatgagatattacacactgctgaaaaataataatttagaggattatgcaacagtgttgaatgtttatagtgagttaagctttttttttttttttttttttttttgagacggagttgtgctcttgctgcctggactggagtaaaatggcacaatcccggctcaccacaacttcctcctcccaggttcaagtgattgtcctgcctcatcctcctgagtagctgggattacaggcatgcgccaccacacccagctaattttgtatctttagtagagacgggctttctccatgttggtcaggctggtctcgaactaccgacctcaagtgatccgctctccttggcctcccaaagggctgggattacaggcgtaagccaccgcgcccggccgagttaagcttttaaaaagtgaaagtgcatgtacatttgattatagctatgtaaaataaaaatatatataatatacaaacataaatgcacacacatatatatagcacatatttgagcaaagaccaaaagtaagtgcactaaaataggcattaggatggtgaaataatatgagatgtagtttgcttttctgttcttcaattttgtttaatgtactatatatttactacaaatttttaaaagatgcttaagtgaaaatctataggttaagcttaagccctagagagaatgccattattactgcataactaattttgtttctcattcttttaagtgccaatcagataccaatcactctgttaagtgttggggatataaagatgagagtaatcatagtccctaccctcaagaagcttacagcctagtttggaaacactgattaataaagtgagtaattaaaatattaaaatctgcagggcacagtggcatacaactgtaatcccagcactttgggaagtcaaagtgggcagatcacttgagcccaggagctcgagaccagcctgggcaacatggcgaaaccccatctctacaaaaaatacaaaaattagctagacatggtggcgtgtacctggagtcctagctattcgggaggctaaggttggaggatcacttgagcctaggaggccaatgctgcagtgagctgtgatcttgccactgcactccagcctgggcaatacagtgagaccctgtctccaactaaaaaaaaaaaaaagacaaaattgctaagtgtagagatgcttttctgcctagacaattcaaagaagggaaaaaagggccaggcgcagtggctcacaactttaatcccagctactcacgaggctgaggcacaggaatcacttgaacccaggaggcgaaggttgcagtgagccgagattgcgcccctgaactccagactgggcaacagagtgaaactctgtctcaaaaaaacaaaacaaaacaaaacaaaagaagggaaaataaccctagcgctgaggttggaaatacaaatcagactttgccaggccaacaagactgaaaaaaaatttcaatcacaatagtaggtttaaagacactgaatcattagagaacttagtatgttggggatttgaaagtagattcatatagctgatgcatggaatgcttttagagaatgtcaggaattgaggcaggaccattaaatagctattgattaataaaaaccttttcaagccatgctaagaagtttagattttagcatattaacaatgcggacattgaagaattttgcacattgtacagaagtctatgaaaggggcaatcaggacagcagcgctgaggactgaaaagacatcatggatttaaagaatacgagattaaaacaggacttttagttgtgaattgagagagaaacagagagtaatgggagtctcctttacaaagaaaagaaaacctaagaagtatttcaagaaggagtgggtaataagtttaacaatggctcttttgtattggaggtgtctatgaaacatccaggtggaggccgggcgcggtggctcacgcctgtaatcccagcactctaggaggccgaggtggatggatcatctgaggccgggagtccgaaaccggcacggctaacatggtgaaaccccatctctactaaaaacagaaaaattagccaggcatggtaacacgtgcctgtaatccgagctactcaggaggctgagacaggagaattgcttgaacccgggaggcggaggttgcagtgagccaagatcacgccattgccacccagcctgggtaacagagtgcgactctgtctgaaaaaaaaaaaaaaaaaaaaaaaggccgggcgcggtggctcacgcctgtaatcccagcactttgggaggccgaggtgggcggatcacgaggtcaggaggcccagaccatcctggctaacacggtgaaaccccgtctctactaaaaatacagaaaattagccgggcatggtggtgggcgcctgtagtcccagctactcgggagaatgaggcaggacaatggcatgaacctgggaggcggaggttgcagtgagccgagattacaccactgcacactccagcctgggcaacagagtaagactctgtctcaaaaaaaaaaaaaaaaaaaacacttattgaaattgctaccactggccgggcacggtggctcactcctgtaatcccagcactttgggaagccgaggcagacggatcacgaggtcgagaaatcgagaccaccctggccaacatcgtgaaaccccgtctctactaaaaatacaaaaaaaaaattagccggtcatggtggcaggcgcctgtaatcccagctacttgggaggctgaggcaggagaatcgcttgaacccgggaggcagaggttgcagtgagccgagatcgcgccattgcactccagcctgggcaaaaagagtgaaactctgtctcaaaaaaaaaaaagaaagaaagaaattgctaccactaaagaaggtatgattagtaatggcaaatgcagtgttaactgttaacaacagagagtctgctgtgagaagtgctgaaaagagggcattgtgactataactttctcgaacgtcattgatgggaacatacattatgccagtgttttagaaaatcagtctgggagtaaaatacatacacctttaaactgaaacgctggccgggcgcggtggctcacgcctgtaatcccagcactttgggaggctgaggcagacagatcacctgaggtctggagtttgagactagcctgggcaacatggtgaaacccctgtccctactaaaaatacaaaaattagctgggtgtggtggcaggcacctgtaatcccagctacttgggaggctgaggcaggagaatcgcttgaaccccggaggtggaggttgcagtgagccgagatggcgccactgctttccagcctggcaacagagtgagactccatctcaaaaaaaaaaaaaagcctacaaaaatgacagttttcctggttcaacctaatcaaaagaacctgaagcctgctttttaaaaaaaatcacagataaagtgcacaaaatagtcattggtgactttaagccaaagcagtttcagcagaggtatgagatccaaagcaaaagtgcagtgaattgagaaatgaaggggaaacagggagggagggcagtggtttttcccaaatcttattgttaaaggaaagagaacacttgggtggctggaaaggaatgtgaggctggaggaatctgggagttgacttagttagggttgattgcttactttgtttttaagtttgagaggaatgtgatcatatttgtaacctgaagtaagtgatcaaataaagaaggagagtgaggaaagtgattcagagacttcaagaggatctggagcctagcagaatggatcagccttggatgggaggaggagcaggaggatttccacttctggaggagaggagagtcagtgtggctgcttgaccttcagctctcctttctccactcccactttcacagactccttccagaggccttgggagggaccatggcaatgattaggatggtcatatgtttttatactacttgcaaaaccaagattgttttagtattcattttctttaaaatatctccttctccagttgtatatgctcagcactacaaaacctgaatctgcccctagtagctataaataggtttcatggggaagggatagtggagacaagatttgattgccttcatttacataaaaacagaaagcaaagtctacattgagagtgaagtaagaaagaatatggtggtcggggaggaggtcaggaaagtgacaaaggtttggagaagctgggaatggaagagggagttgacaaaggacacattataggatcctctaacagcacagaggatgctgctataactccctaccagaaatgtggtgtatatcatgaagagtggccttcttgcctctatttttcttttttcttttttgagacagagtctctctctgtcaccaggctggaatgcagtggtgtgacctcggctcactccaacctccacctccagggttcaagcaattcttatgtctcagcctcccaagtagctgggattacaagcgcgtgccaccatgcctggctaatgtctttctttcttcctttttttatttttatttttttattattatttttttaatagtagagatggggtttcaccatgctggctaggctggtcacgaactcctggcctcatgatctgcccacctcggcctcccaaagtgctgggattacaggcatgagccaccgtgccctgccttctttctttttcttttcttttcttttctttctttttttttgacagtcttgctctgtcgcccagactggagtgcagtggtgctatgtcagctcactgcaagctcctcttccccagttcacgcctactgcctcagcctcccgagtagctgggactacaggcgcctgccaccacgcctggctaattatttgtatttttagtagagacaaggtttcaccgtgttagccaggatggtctcaatctcctgacctcgtgatccgcctgcctcggcctcccaaagtgctgagactacaggtgtgagccaccgcacccggcttttttttttttttttttgtatttttagtaggggcagggttacgccatgttggctaggctggtctcaaactcctagcctcaagtgatccagacttgagggacaagtgttccagactcccaaagtgctgggattacaggcatgagccactgcgcctggcccatctatttttccctccttcaatgggaataacacttgttcctagctgcaccatgaaaatatcacatcagatgcctaagaagaattcactataattagaaaataagtatactttggggccaggcatggtggctcacgccagtaatcccagcactttgggaggccgaggtgggcagatcacctgaggtccggagttcaagaccagcctgatcaacatggagaaaccccgtctctactaaaaatacaaaattagccaggagtggtagcacatgcctgtagtcccagcttctcgggaggctgagacaggagaatcgcttgaacccggcaggcagaggttgcggtgagccgaaatcactccattgcactccagcctgggcaacaagagcaaaacctcgtctcaaaaaaaaaaagaaaaaggaaaagaaagaaaagaaaagaagtaactttgttttcaataatatttttcttttttcaacatcagctatataaaccccctgtaaagtctattaaaacatgaaaaataaattaaacgctatacattaaatttcttacgtttgtcccaaacaggatgaaaggatatctgcaatagagggtaacctggaaaagggaagcggagccagagaaaacagaggagggagtccattcaggggagaggatgatggcggtgttagaatattggttacatccagcctggcatggtggctcatgcctgtaatcctagcactttgggagtccgaagtgggtggatcacaaggtcaagaggtcaagatctgcctggccaagatggtgaaaccccgtctctactaaaaactacagaaattagctgggtgtggtagtaggtgcctgtaatctcagctactcaggaggctgaggcagtagaatcactggaacccgggaggcagaggttgcagtaagccgagattgcaccactgcactccagcctgggtgacagagtgagactccatctcaaaaaaaaaaaaaaaaccaaaaaaaaaaaagaatattggttacatcgagaaggattaatctactaagtaaatatattaaagataatggaatcagagtttctaactatcagagaaggaagttacaaatacaacaaagataccttggtgccaatggcaatgaaaatggtggagtaagaaactctaagggtagggaactctcttcctttgcagaaacactgaaaaaactggcaaaagtcatgagaaacaactttattagaactctagaagatagtcaaaggtttacagcaaccaagctaatgcttaataaggataatgggcactgaatcatggtaggagaggtttgtcgtgttttaccttacccttgtccaatccccctgcccagtgcagcagcagtctagaagacagcagcccatgctctcagtgcaggttctcagtttgggaggtgtgttaggccattcttgcgctgctgtgaagaaatacctgagactgggtaatttacaagaaaagaggtttaattggctcatagttctgcaggctgtacagaaagcatggcaccaggatctgcttctggggaggcctcaggaaatgtttactcatcaccgaaggcgaagcaggagcatgcacgtcacgtggtgagaacaggagaaagagagagagtgagggcaggtgccacacactttcaaacaaccagatcacatgcgaacccagagcaagagcatcaccaaggggatggtccaagccattcatgaggaatctgcccccaagatccaaacacctcccacccagccccaactccaacattggggattacatttcagcatgagatttgggtgggaacaaatatccaaactatatcagaagggaatggagggaatcttgttcctgagaaattgtgttcataggttttaatctgtttgggggatccccaaggggactaatgcagggtacttgcctttgttccacttacctcaaaactctctcaggatagaaaagttgctttgtggaagaggtttctcaaaaacattggacagccaatgaataaagcccagatgcctagagcaaaagataacagctgtggcaaaaaaaatacacttgtagaaagcctgagaagaaaaacttggggattgatatacttgcggaataaaggctctgaaaagcccctggttatgtaggggaatcaaaaaggcccaggccaggatacatcctcagaaaaggtctgagaacaccataggcttcacctctggttgatttttaggcttagcacaagtaagaagtgaaggctaaggcagagttataaatggtgtggctagtcagccgggtgcagtggctcacacctgtaatcccagcactttgagaggccaaggcaggcagatcatgaggtcaggagatccagaccatcctgtccactatggtgaaaccctgtctctactaaaaaatacgaaaattagccaggtgtggtggcatgcacctctagtcccagctactcaggaggctgaggcaggagaattgcttgaacccaggaggtagaagttgtagtgagccgagatcgcgccactgcactccagcctgggcaacggagtgagactctgtctcaaaaataaataaataaatggtgtggctgagcattgaagtattggcaccaacacagagccaatttgcaaagacctgatggtactttttcttttttgcctctaggagtttaagaaaatctttgataaaccattagctgactactatgctaaaaaaacagagaccacacaattcaaagaaccgtataaaatagtttagaaaagtcactaaacaaacaaccacaacctacagagagcaacaaaaaatcctggaatggggagaattttatttccagagttaccgcattgttatattcaaaatgaccacttttcaacaaaaaattatgaggcatgcaaaaaacaatgaagtgtgccctgttcataggaaaaaaaaattaacaaaaacagtccttgagaaagcataggcattggacttactagacaaagacttcaaatcaactctcttaaatatgctcaaagaactaaatgtagctggccaggtgcagtggctcatgcctgtaatcccagcacattgggaggccaaggcagatggttcacctgaggtcaggagttcaagaccagcttcaccaatatggtgaaatcccatctctactgaaaatacaaaaattagccaggtgtggtggcatgtgcctgtagtcccagctactcgggaggctgagacagaagaattgcttgaacctgggaggcaaaggttgtactgagccgagatcgtgccactgcactccagcctgggcaacagactgagactctgtctcaaaaaaaaaaaaacaaaaaaactaaaggaagccatcatggacaaagaaccaaaggagaacagtgtctcaacaagtagaaaatatcaataaaggcagaaaaattatttaaaggaaccaaatagaaattctggagctaaaaagtgtaataaactgaaagaaaaaattcgctagacacattcaacagcagatttaagcagtcagaaatatcagaaaactgaagataagtcaattgaaatcatccagtctgagaagcagaaagaaaaaagaatgaagaaaaatgaacagacactaagagaattgtaggataccatcaagtatatcaatatatgcataacaggaatcccagagggagaggagggatagaaaggaggagaaagaatacttgaaaaaaataacttaaaaacttcctaaattttttttttgagacagagtctcactctgtcactctgtcactcgagctagagtatagtggcatgaacttagctcactgcaacctccaccttccaggttcaagctattctcattcctcagcctcctgagtagctgggattacaagtgcgtgctaccactcctggctaatttttgtatttttaatagagacagggtttcaccatattggccaggctggtctcgaactcctgacctcaagtgatctgcccgcctcggtctcccaaattgctggggttacaggtgtgagtcactgcgcctggtcaacttcctaaatttaacaaaataaatgaacatctcaacagatacacaggaattacaaataaagaaacagagaaaactagaatgaccctgtgatgccatattaataggatatattcatataaattcacgattttcaatatatatggataggtatagaaataaatatagttgtaagtgtgtatatgaatatgtgcatgtatttgtgtacacatgaatgcacagatcctagctctgtctaccaagaaaatgtgttagttaaggcctactaataagcaggcaccgagacagaattcaatgtgcaagagatttattgggggagtgtgatagcctccagcatggtccctaatgattctcacctcttggtagtcacatccctgtgaaatcccctcccacactgagtaggactgacctattactgcagtgacagcatgagactttcaggctaaacaataaaagacatagtagtgtctgtgttgttctattgaaacagtcactgtagggggagaatcagctgccatggcatgagatactcaagatgccctatggagtcgtccatgtagtaaggaactgagacctccttccaacaaccaagtgagtcatcttggaagtagatccttgaggccgaagccaagccaccatatgactatgctttggctgacatcttcacagcaacatcatgagagatttcaagccagtgaagctgctccagaatttctgacctatagaaactgtgagataataaacacaatcgacccttgaaaaacgtggaggttagaagtgctgacctccactcagttgaaaatccatgtatagctttttttgttttgagacagagtctcactctgtcacccaggttggagtgcagcggtgcaatctcggctcactgcaatctcagcctcctgagttcaagcgattctcctgcctcagcctcctgagtagctgagattacaggcatgtgccaccacacccagctaattttggtgttgttgttgttgtttttgagacagattctcactctgtcgccaggctggagtacagtagcgtgatctcggctcactgccacctctgcctcctgggttcaagtgattctcctgcctcagcctctggaatagctgggactacaggtgcgcaccaccacgcgcagataatttttgtatttttagtagagatggggtttcaccatgttggtcaggatggtctctatctcttgagctcgtgatccccccaccttggcctcccaaaatgctgggattataggcgtgagccactgcgcccagccctaatttttgtattttttaaaagtagaaacagggttttgccatgttggccaggctagtcttgaactcctgacctcaggtgattcaccctcctcagcctcccaaagtgctaggattataggcctgagccaccgtatcagcccatgtataacttttgactcctccaaaacttaattactaatagcctattgtcaaccagaaggcttactggtaacatagttgatttacacatattgtttgttatatttattatatatactgtattcttacactaaagtaagctagaaaaaagaaaatgtaattttatttttcatgaaaatcttaaggatgagaaaatacatttacagtactatacagtacagtactgtactgtgcttatcgatattgcaaaattacataaagatggatactttgaagtaatgggtaatggtatgcagacctcaatctacagtacataccaagcaattccacttttttcttgtaaggtcatgacttttttctgcttcttgggagcacttccagcatcactagtggcactttgcatgggttccaggatgttattcaagggtttatggtattgcactaaatgcgataaaaaacgtgcaagatccacgagaaatcacttttcactgtgaaatgccatttactggaaagatcagctgctcacacagagatgagtagcatcccactgggttttaagcagatactcacaatacttgatctcatcacaatagcaataggaggtggctgtgaaattataacagtagtacagtatatacaacagttaattttatgcagttatgatttcatattgcatctttacatttgtttacatttatctagacgaaaatgaagccatgtatggtctgtatttgtgtgtgtaagttttgataaatttcaattttttggaatagatttgtgtataatttatggtagtaaatgacaaaaatagactagtatctacatatattttgtgcattcatgacatacctaactttttcttaatttttttgctatttctagggtatatggtttatcttcaagttttttcaaattgttgccaatctccaaaaaaattccaatatatttactgaaaaaagttcatgtataagtggacccactcagttcaaacctgtgttgttcaagggcaaattgtacttattttaagccactacattttgggggtaattgttacacagtaataggtaagtaataccagtagaaagtaagagaaggaagagagattcctcacgctgagatgcagatctgacatttctagaaggagagaagaatgaaggattggagtaggacaagtcttggactactgcattgttccaagaatgaatttaccaagcagattgggagtcccaagccaaagttgtcccctagaggattcctgtattttgccagaacagacctaccttagtacccctgctgggctcaggcactgactgggaataaccctttaaaagttggcctcagtgtgaatagggtgatagatttaggaggcagtagttggggctatctgtcaattatgctccccacagcaggagaactgagtgacacatttcatagctatcacagcaggcctggaagagatgacagcccaatagcaatgagcagagctagtgtcaagatgttagcttctttttttttttttcagacagagtttcgctctggttgcccaggctggagtgcaatagtgagatctcagctcattgcaacctccgcctcccgagttcaagcgattctcctgcctcagcctttcgagtagctgggattacaggcccccaccaccatgcccagctaattttttgtatttttagtagagatggagtttcactatgttggccaggctggtctcaaactcctgacctcaggagatccacccacctcagcctcccaaagtgctgggattacaggcatgagccatcatgccaggctcaagatcttagcttataaataatattttccttgaaaaggaaccagggctccttagagaaatggctgatcccacatctgaggcaggaaaagtataagatgagtctggaacagctggtagtgacagagcaaggaagggctcaagaaatgacagaaacatgtgaaaaggacatagatgccagcttgaagggacttccactggtcaaatcaggaacaatttgagcatcaaaattaaaaatggcagtaagagattataacccattgaataaaataaggaattatgggttcaaacagacataaagacatatacatacatacatacatacatacacacacacacatcaaaagtttgatgaggaatgggatatttacgtggttcatggtggacagatactgcccagatcaaagaaccaaagtcaaaatcattagtaataggacaaattgaaattatgtgctacctgataggatataagaagaaagcagttatcacttctatggtattcctctaaaaggtgtataacctgaatgtaatcatatgaaaacaccagtaaaccccaaattaagggacaagttacaaaataaccgacctgttttcttcaaatgtatcaaggtcatgaacgtcaaggaaagactggggaattgttccaggctgaagcagactagacagacataaagactcagaacaatgtgtgattctgaactggatcctattgctacagaacattttattgagacaattgacaaaacttgagtgagatctgaggattaggtagtgatcatgtatcaatgttaattttctaattttgatggttgcactgtgattacgtaggagaaggtctttatttgtaggaaacaatactaaaaatatttggggtggtggagcaccaagtcctcactctcaaatggtcaaggacaaaaagtcctttgcactgcacttaacttttttattcaactttgcaaatgtttcaaaataaaaaaataaaagtatgcatgctatttgaaagataaacctgttataaatataaggttttatcatttaaatccggagagctctttaacatctttaacttgatgagtagctaccctctttcttttctacccgtccaagcttactttaattcattcacaagactgaatggaatctcaacatttaaatacttaatctctttctttaatctttggcaccaaggaactggatttccccagttgtatgagtcacccgataacaaatttcccagcttaaatagttttaaagttgtactattagtaaggcaacactgttcattgtgtctcagattcaaggatttatagtaacaatgtgttttagcatgcatattctttttcaacatatacgtttttctttgatgccgtaaaaagtctttctgatgttgaacagttttaatgcagttatgccatgatggaaccacccctctcctcactcccagaaaatcacacagcttgatatgtttttagccttcatctgaattgtaaaacactgaattcttacagttttctaaaagaaaaagaaaaaaacttgccattgctattttgggagcatttgtccagataaataaaacacggtcctgatcccaccctgcctgtcctcgcatttctgagagtgaagatacagaacactgcagtcaggggagaaaacatatttttttttccttccctgtcagaatctgttccattgggaggtgaagtatatgaacccaatttttgccttggagataaagagaaaaaaatcaattctaccaagatttactttatgtgaaagcacttaagcagattccctagacatgtgtttctgaagggttgcaccctccagccatctgacttttggccaagtccagagacattttaggttgtcagaactacggggtgggagatgctactggcatcttgtgggtagagggcagggatgttgctaagcatcctacaacatactagacggtccccacaagcgagttggccaagtgcgatggctcatgcctgtaatcctagtgctttgggaggtggacatgggaggatctctcgagcccaggggtttgagaccaggccaacaaacagtgagatctcatctctacaaaaaaataaaaaattagctgggtgtggtggtgcatgcaggttgtcccagctattcaggaagctgaggcaggaggatcacttgagcccaggaggtcaaggctgcagtgagctatgatcgcaccactgcactccagcctgggtgacagagcaagactctgtctctaaaaaaaacacaaaggcctagctcagtggctcacctctgtaatcccagcactttgggaggctgagccagcaggatcacttgagctcaggagttaaaaccaagctgggcaagacctcgtctctacaaaaaagaaaaaaaaaaaaaaaaaaaaaaaggccaggcgcagtggctcacagctgtaatcccagcactttgggagcctgaggcgggtggattccttgaccccaggaggtcagctgcagtgagctgtgattgtgccattgcactctagcctgggcgacaggaatgagaccttgtctcaaaaaaaaaaaaaaaaaaaaaaaaaaaaaaaagctgttagtgccaaggctgagaaaccctgtccaagattaatgcagagtacagagaagaaagaagacctcaggaggaggggggaaacaccaagaaatacaaacacaaaattaaaagaaaaaaaaaaacctaataaacagtgaatttcacaccaatttataaagatacaggattttagggattaacattcctatttggtggcctttcaggatattgctaagaggactttaaggtcattttgagtttttctactactacatttttatcaattctttcaccaagcatttcttgagcacctactgtgtgccagaggctgaggacacaaagatgtgagcttttctcttccctgggggagctgggagattttagtggtggaaatacctataaatgaagaattggaattccaaggacaagaggtaaagggcaagaaaaagagttcttctctataccaagcactcctgcttacctccagtcatcttcattccgctctcaccagtgagtgttattcccttttcacaaaagaagaaactgtgagattaataacaagagcagacaagcaagtgtcgggccctgttctcaatgttttaattaatttatttatttttaaattgttgttgttgttgttgttgttttgagaccaaagtccccctctgtcgcccaggctggagtgcagtgctgtgatttcggttcactgcagccctcgccttctaggttcaagcaattctcatgcctcagcctcccgagtagctaggattataggcgtgcaccaacgtgcccagctaatttttgtatttttagtagagaccgggtttcaccatgttggccaggctggtctcgatcacccaacctcaagtgatccacccgcctcagcctcccaaagtgctgggattacaggcatgagtcaccacgcccagccctcagtgttttctcatgtaactcattttattttttttattaactcattttactttcacaactatcctttgaggagggcattaatatcatcaccttcgttttacatccgtgggtgctgagggaccaagcgtttaggtaacttgtccaaggtcccacagccaggctgtctggccgcagaatccatgcccttcacaatctacactggtgcttctcttatgcttcatccaaggaagaaaatggtagatctgggcttaaaagccagagtgtgactggaaacccaatgctcttctgctacatgatactctcccctgttctagaaaagagctcaacatgctataggctcacaggtgtctgattgcgcctgaagaagtcaaagtcgatttcagttggaggtagcatctgagctcatagtggaggtatatgccagaaggaaggtcagacaaagggagaaggacaagaacagctggaatagaaaacaataaacttcaccatggctagcagtttgttgtggttggaatgtaagctataccagagcaaaggactaaagagaacctagaggccaggtgcagtggctcacacctgtaatcccagcactttgggaggccaagatgggaggatcacttaagcctaggagtttgagaccggtctgggcaacataaagagacctcatctttacaaaaaaataaaattttaaaggcatggtggtacacacctgtagtcctatctactcaggaggctgaggcaggaggatcacttgagcccaggaggctgaagctgcagtgagccataatcataccactgtactccagcctggataacagagcaagaccctgtccccaaaaaaaagaaaaaaaaaaaagaacctagagaagtaaataagggtaagatcaggaagtgtgagctttaacttccaggcaaaaggtaattattaaaagaccataaggaggccaggcgtggtggctaacacctgtaatcccagcactttgggaggccaaggcaggtggatcacctgaggccaggagtttgagaccagcctggccaacatggtgaaaccccatctctactaaaaatataaaagttagccaggtgtggtggcctgtaatcccagctactcgggaggctgaggcaggagaatcgcttgaacctaggaggcagaggttgcagtgagccgagatcgcaccactgcactcagcctggacaacagggtgagactcggtctcaaaaaaaaaaaaaaaaagaacataagcagagcatgatctgacttaacatcaacttgatatcaacccatactttggagtctagaacaaatatttcccattcctttctgtccacatgccctgctcttgttctttttaatctcactttacctggtttaaatatttatttatttatttatttatttatttatttatttatttatttgagactgagtctcactctgtcgcccaggctggagtgtggtgggacaatctcagctcactgcaacctccgcctcccaggttcaagtgatactcgtgcctcagcttcccgtgtagctgggattacaggagcacatcacatctggctaattttcatatttttagtagagatggggtttcactatgttggccaggctggtctcaaactcctggcctcaagtgatctgcccaccttggcctcccaaagtgctgggattgcaggtgttagccacaagcgcctggcctaaatgtgtataatgtgggagaagaagacgaaaaatctggactgcctttcccctagcaattctcagcagctctcaatgccactcaagcctgctgacctgcaggagttattaatgatgacagagtgctgttgaaagcaataagcaatgtgatgaaattacaaccaaaatcacgctttctagattgatgtggttgggtacattttgagtgacagtggtcctattagtaatactcatatagggctttatagtataccaagcgtttttacatgcactctgttgtttgatcatcaaaacaaaccaaggaggtaggtgttatcccatttcacagatgtggaaactgaagcttccagagcttgtttgggtaagtagaaagaatgaacacagaactccagacttccagtctcatcctctctccttgccttcctgccttgccttcctccctctttaacaatattttcttttgttttgtttttgtttttatatgttttaattttcccgtatgagtgggacagcaaaagccaggagacttgatttgtcctcccctgtcttgtgtagggttagcccactgtggcccctacgcttgctaatgcagccccgtgatgtttttccagatccctcctgtcacccttagtggctcttgatcctgatggatcaagagtgtgcttcttggctaggtgcagtggctcgcacctataatgccagcactttgggaggccaaggtcgggggaacacttgaggtcaagagttagagaccagcctggccaacatggtggaactccatctctagtaatacaaaaattagccgggcatggtggcgggcacctataatcccagctacttgggaggctgaggcaggagaactgtgtgaacctggaggcagaggttgcagtgagccaagatctcgacactgcactccagcctgggcaacagagtgagactccatctaaaaaaaaaaaaacaccaccaccatcaccaacaacaacaacagaaagagtgtgctctttggcatggcacagaagactttctgcgtcctgtcttctgtcctcctgtgaccaaccatcctggtttgcccagaactgagggacaggggactttcactgctaaaactgggacagttctgggcaaagtggagcagtcggttactcttgttctccctctccagctgcctaatctgccactctcaaactccaacttctaagatcccagcaattgctgtcctgtttcaaccccctgcctttgcttatgctgttctttttatcgaaaacacatacctctaccttctctcagccacttcctactttttctttaaaactatgttctggggccgggtgcagtgtctcacgcctgtaatcccagcactttgggaggccgaggtgggcggatcacgaggtcaggcgattgagaccatcctggctaacacggtgaaaccccatctctactaaaaatacaaaaaattagccgggcgtggtggtgggcacctgtagtcccagctactcaggaggctgaggcagcagaatggcatgaacctgggaggcggagcttgcagtgagccgagatgacgccactgcaccccagcctgggtgacagagcaagactccgtctcaaaataaataaataaataaataaaactatgttcttaaatgtaggtactgatttctttctttcttttcttttcctttttttttttttttttttttttgagacgcagtcttgctctgtcacccaggctggagtgcagtggcatgaacttggctcactgcaacctccacctcccgggttcaagtgattctcctgcctcagcctcccgagtagctgggattacaggtgcatgccaccacacccagctaatttttgtttttagtagagatggggtttcaccatgttggccaggctgatctcaaactcctgacctcaggtgatccacctgccttggcctcccaaagtgctgggattacaggtgtgagccaccacacccagcttgtttctttcttttttcaattaaaaaatatatatatatggaatgctggtggggctcggtggctcacgcctataatcccagcactttgggaggctgaggcgggcagatcatgaggtcaggagtttgagaccagcctgaccaacatggtgaaaccccttctgtactaaaattagccaggcatggtggcatgtgcctgtaatcccagctaaggctgaagcaggagaattgtttgaacccaggaggtggaggttgcagtgagccgagatcacgccactgcactccagcctgagcaacagaaaaaaaaaaaaaggaatgcttcacgaatttgtgtgtcatccttaagcagggggcatgctaatcttgtatcattccaatttttgtatatgtgctgccgaagccatcaccaaagcatttgtttctttgactgtattgtgaactgaatgtttgtgccccccaacaattatatgttaaaatactaacactgaaggtgagggtagtaggaggtggcatctttataacgtgattaggtcataagggggagcccttacaaatggtatcagtagataccatttgtggatatctactgtgggtgcagtggctgatgcctataaccccagcactttgggaggccaaggcagacggatcatgaggtcaaaagatcgagaccatcctggccaacatggtgaaacctcgtctctactaaaaatatgaaaattagctgggtgtagtggctcacacctgtagtcccagctactcgagaggctgaggcaggagaatcgcttgaatccgggaggcagacgttacagtgagccgagattgtgccactgcactccagcctggtgacagaacgagactgtctaaaaaaaaaaaaaatcaaaaacaaacaacaacaacaacaaaaaaaaacaaatggtattagtttccttataagaagagacacgagagaggtgatatttttttctctcccatatgaggatacaatgagaagatagccatctacaaactagaaagagtgccctcacaagacaccagatctgtcagccacctaatcttggacttcccagtctctagaactgtgagaaatacatgcttgctgtttaaaatgtttattctttaagccacttgctctatggtattctgtgatagcattctgaatgaaaacaggctgtctcttccagaatatgttatgcttctttgtaaggcatcttttcatcccagtctgttgtagaattcctggcatgtagtaggcaagtaataaagctatgcaagcagatcaaatggtgctaggactctgtaagaatttttctcagttcccttccacagatctcttgccagagagaaaaggttcccctcagggcagcaaggtagaagactcaagaagtgagcagagttgagatcatagaaggcttggctttccatgcttaggggtgcaggctttcatgtgtttgcaatggagagtcattaacaggacaaaaaaaaaatcggtggccctttgtctatgaactcaataagagcctgggcaagaaaaaaagaaatgtaggtaaccagcccagcaagaatagcaacaaagaggcaacactcaagcctcctagtatgtctagagttctgtacaccctcctcagggctagaagggcctcagtgtctgagtctacctgagcccacaggtggaagaacaaaacaggaaacatttcctgacccaagaaaatagtttaaattgcaaaggcacacattacagttaggtacaatataaacaattccctggcacatttattgtcaaactttagtgtacgtcagaatcacctgtagggcttgttaacacagagattgctgagtcccatcctcagagatctgattcagtaggtttgagatgtggcctgggaatctgcatgtctaacaagttcctaggtggtgctgctggtctggagacaatgcttctaggaccaccactccagaacccactccacctctctctcatcaacggataacttgcctgtccttgattcaaggcttgcctctttccttgctaacaacatccctcaatctcctttcagggactcattctcctttggacattttcagatctgtgctatgggtggggaggacaaaataacaccttccctcatcagagctaccttaaccctcactctacttctggctttttcttacaacttcaaaaattgtttgtggccgggcgtggtggctcacgcctgtaatcccagcactctaggaggccgaggcaggtggatcacctggggtcaggagttcgagaccagcctggccaacgtggcaaaaccccgtctctactaaaaatacaaaaatcaggcgggcgtggtggtgcgcgcctgtaatcccagctactctggaggctgagacaggagaatcgcttgaacccaggaggcagatgttgcagtgagccgagatcgcaccactgcactccagcctgggtgacagagcaagactctgtctcaaaaaaaatacaaaaataaaaattgtttttattgactactttcattttctcaccattcattctctctttaacctcttgtaatctttcttttatcctgtctagcactctgttattcataaagagtatttataagctgggcgcggtggcttatgcctgtaatcccagcactttgggaagccgaggcaggtggatcatttgaggtcaagagttcgagccagcctggccaacatggcgaaacctcgtctctattgaaaatacaaaaattagttgggtgtggtggcacgcgcctgtaatcccagctactcgtgaggctgaggcaggaggatggctagaacctgggaggctgaggttgcagtgagtggagatagtgccactgcactccaacctgggcgatagaatgagaccctgtcttaaaaaaaagaagcacaagaagagattgcccttcttgcctttgagtacagttttcctgaagatgtgaatggttgaagctgtgacagccattttgttagaatgaaggcttacatctgagcacaaaacgcaacacattgaggatgccaaagcagaacgttgagaagcatctgggttatcaacatcattttgcaactaattaaccaattccagaattacctgtcttcagacttcttgctatgtgtaatgataatcccctatttttttctttgagctggtgcttttcttttttctttttctttttcttttttttttctttttgagacggagtctcgctctgtcgcccaggctggagtgcagtggcgcgatctcggctcactgcaagctccgcctcccgggttcacgccattctcctgcctcagcctcccaagtagctgggactacaggcgcccaccaccgcgcccggctaattttgtttttgtatttttagtagagatggggtttcaccgtgttagccaggatggtctggatctcctgacctcgtaatctgcccgcctcggcctcccaaagtgctgggattacaggcgtgagccactttgcccggccgcttttcttttcttttcttttcttttttttttttttttgagacagagtctcactctgtcgcctctggctggagtgcagtcgtgcgatctcagctcactgcaacctctgtgcctcctggattcaagcgattctcctgtctcagcctcctgaatagctgggattacaggagcccgcgaccacacccagctaatttttgtattttttttagtagagacgggttttcaccaagttggccaggctggtctcaaactcccgacctcaggtgatccacccgcctcggccccccaaagtgttgggattaaaggagtgagccaccgctccaggctcacccctttagaatctacttgctactctgagtaccttcttacaaatgcaattgcggtgcttctcacagattcatttaaaaaaaaaaaaaaaagaggccgggcgcggtggctcacgcctgtaatcccagcactttgggaggccgaggcgggcggatcacgaggtcaggagatcgagaccatcctggctaacacggtgaaaccccgtctctactaaaagcacaaaaaattagccgggcgtggtggcaggcgcctgtagtcccagctactcgggaggctgagccaggagagtgacgtgaacccaggaggcggagcttgcagtgagccaagattgcgccactgcactccaaagacttaaagtccaatgttaaaaaagggagaaaattacccaggatattttgtatcctgagtatacgttatatagagattggtggtggtggtgatttttgttgcatttgggagttgctatgaaagttgagggactaattttttttttctttttgcttaggcaaactcctgaaaactacttctcttcctattttcatgcagagaaacttaatttctccttgccttttctccccctgtggagttaaaaatagtatggatgcatttattttgtgtcaatttccattaggatgcctgcagatactaacagattcttcaaagtccaaaaagcaacctcagattttcacattggggtaagtggaaaatagaaggcccttgattcctattaactaacctgattgggtatcaccattgttttcattgctaataattgttttccaatgagaatatgaatatttttattttaatggaagttttatacctacagtaaattcataggcattagttcattcactactaaaatgtatacttctctgaactcagacacacaggccatttaacaggatacatgtgacataataaattaaagtgacatgaaaatgaaagtttcatctatttagaactgcagagaagatttcaggttgtcagattatatgttattactaagtcttggttattgaggttagtgcagtaaattgattgagtgcttcatttaaaatactaattgagcacctgtctgtaaacagcagttaggcaatatgggtgaatactaaaaaggtaactttggtaatattgggaatactaaaaatatatacagagagaacgagcacgaaagtttcattaaagaaaagtgtaatggaagacatttgacatatacataagaaaaactcattaataatgaaaagcaaccatacaagaaatttagagaagcagagtgccgagggagtgggggcggtgggaggcggtaagtgctaagcatcggtcccctcagcagtttgaatgattttatgaagcaggtaagattccttcataggaagctgagagagggtgagggtaagtggaggggcttggatgatcacagtatgaaaaaatgggaaaaatggaaggaagactattctattcaagaagacctaacagcaaagccatgctcatggaccagtgactaggccaatctgaccagagcagagatttcagatgggaaaaagcgtgaaaatcatattttagtagcgttggaaaatatctaagatttcatcagcaagtttcctggaagagattgagactggaaggttagtttgatttatcagtgtctagtaaagttgaaaacacacatacgatatgttctagtcaatgcttggcaggaaacagaatgagctctcaccctgggtaattgaggacaattcaataaaagaactatttaccaaaatgtgggcagggttaatggcaaccttaaaaagcaacaagggtagcaatagcaggggagcctgggggacttcattgctgcccccaggcctgaagaggcaaagagagggaatggtgatcagaactgcagaacacagggagaatagcaggggcagtaggagagctccttgacaggaggcctttggtggaggaatgcagccaacccacagaggcccagcaggacgggagccaggagaataaatgcccagatcacactctcctcccaccctctgctttcctgctggcatcttccagaggccaaatccaacaagaagtcagagggaaaggaaattcatggctagcagttcataaaggtcagcttcctggggccaatgcagggaggaagaaagagaagatcagaggagcaaatggaaaacatccagtataccacgtgacccacaattctgttacaggaccacaacactaccccaaaggtagccattgggtcagggtttctgcactatagtcccatctgggttgccagaaatatgttacaaggaaggggtcccgatctagaccccaagagagggttcttggatctcgcgcaacaaagaattcagggcgagttcgcagtgcaaagtgaaagcaagtttatcaagaaagtaaagaaataaaagaatggctactccatagagcagcccagagggctgctggttgcctgcttttatggttatttttgaggttatgctaaacaaggggtggattattcatgcctcccgtttttagactacattagggtcacttcctgacgctgccatggcatttgtaaactgtcatggcgctggtgggactgtagcagtgaggacgagcagaggtcactctcgttgccattttggttttggtgggttttggctggctcttttaccgcaagctgtgtttgtttgtttgtttgttttgagacggagtttcgctcttgttgcccaggctggagtgcaatggagcgatctcggctcaccgcaacctccgccttccgggttcaagcgattctcctgcctcagcctccggagtagctgggattacaggcatgcgccaccactcctggctaattttgtatttttagtagaaacggggtttctccatgttggtcgggctggtctccaactcccgacctcaggtgaggtctcccaaagtgctcggccttccaaagtgctcggccttccaaagtgctcggattacaggagtgagccaccgcgcccggccttactgcaaactgttttatcagcaaggtctttatgacctgtattttgtgctgacttcctatctcatcctgtaacttagaatgccttaaccttctgggaatgcattccagtaagtttcagctcattttacccagcttctatttaagatggagttgctctggttcacacgcctctgacaattctactctaaatttcacaccgtatagaaacttccacgtgtgcaaaaggacaagcacaaatattgtcttgcagcatcgtttttagtagctctaaattggggaaaaactgaatgttcatcaatacggggctacgtaaattgaggtgtattcattgatagaatgtagtgcagccattaaaatgaatgaactggatatatataagcatttgtgtgtgtttgtgcacgcgtgcacatgcatgttttagagggatacatgtagtatgacatactgaataaaaatatttaaaacacacagaaaaagcaattgtatattgtttctacctacatgttatgtaatagaagtataaaaacatgagtaaggccgggcacggtggctcacacctgtaatcccagcactttggaaggccgaggtgggtggatcacaaggtcaagagatggagaccatcctggccaacatggtgaaaccctgtctctactgaaaatacaaaaattagctgggcatggtggcacgtgcctgtagtcccagctactcgggaggctgaggcaggagaatcacttgaacccggcaggcggaggttgcagtgagctgagattgtgccactgcactccagcctggcaacagagccagactctgtctcaaaaaaaaaaaaaaaaaaaaagagtaaaagaatatatgaagtcgcctgtaatcccagcactttgggaggccgagtcaggcagatgacttgaggtcaggagttcgagaccagcctggccaacatggcgaaaccctgtctctactaaaaatacaaaaaaattagctgggcatggtggtgtgttcctgtaaccccagctactcaggaggctgaggcaagagaatcgctggaacccaggaggtggaagttgcagtgagctgagattgcaccactgcactccagtgtgggcaacagagcgagactctgtctcagaaaaaaaaaagaatacatgaaatcagagaaactcaaattgtgatagtagtttcttctggtgaaggaagaaaagagaatgatatcagggaagatgaaaaaagagactgtattagtaaggcttctccagagagaaagaatcaacaggatcaatggatgcataggtagatagatagatagatagatagatagatagatagatagatagatagacagacagacagacagacagacagacagatgagaggggatttattagaggaattagctcaagtgatatggaggctgaaaaatctcatgacagtccatctgcaagctggagacccagggacactaggagcatggctcagtccaggtctaaaagccaaaaaaccagggaaactgatggtgtaattatccatcccaggtggaaggcctgagaacctggagtgcccctggtataagtcccagagtacaaagacaggagagcctggagttctgacttccaagggcagaagaatgtgtcgcagctccaggagagagagagaaagaatttctttcctccgccttttgattctatctgggggccccaaggcaatcggatcgtgcccgcccacatggagggcatatcttccctcctttatccagcaactcacacaccagtctcctctggaaacactcccactgatacacccagaagtaatgccttaccagctatctaggtatcacttaatccagtcaagttgacacgtaaaattaagcgtcacaggggccttcaactgtattgcttatttcagaaagatctgaggcaaatatgacaagtctagtgatactgctatgaagggggaaaaaggcagaggaaggagatggggaatcatggtggatgacatttaaaatctaggaagaatgattacaagaatccctcctggggaggggatatcagcgcagagacctaaatgaggggagggtagagatgcaaacatccaggggaccaatactccaagctgagggagcggcaggtacagacactaaggggtatcctgtttggctcatgactgcagtcccagcactttgggaggctggagcaggagaattgcttgagcccaagaattgaagaccagcctgggcaacatagcaagaccctgtctctacaattaaaaaaaaattagccaggcattgtggtacatgcctgtaatcccagctactcaagaaactgaggcaggaagatcatttcagctcaaggggttgaggctgcagtgagccaagatcacagcactgcactccagtgtgggtgacagagcaagaacctgtctcttaaaaaaaaaagtgtatatatatggaaaaaaatatatttatataaggagaatatatatatatttccatatatatatttatataaggagaatatgtatattctctaaaaatatatatgtttttccttatatctgaaaaaatatatatatatactccctaaaaaggaattccctgcattttaaaactgaaatatatataaatgttttatatacataacattacatttatatttttatatatatatatatatatatagtgttctgtttatgttgttgttgttgttgttttgagacagagtctcactctattgcccaggatggaatgcactggtgcgatctctgctcactacaacctctgcctcctgggttcaagcaattctcccgcctcagcctcctgagtagctgggattacaggcacatgccaccatgcccggctaatttttgtatttttaatagagatggggtttcaccttattggccaggctggtctcgaactcctgacctcaagtgatccacccaccttgacctcccagagtgctaggattacaggcgtgagccaccacacccagcgtaaagtgttctgttttaagtgaacaatccagcatatttagtatattaacaatgttgtacaaccacaatctctaattccaaaacatttcaatcactataaaatgaatcactctgtgcccataagcactttctccccatttcttcctctccccaacccctggaaaccaccaacctgcattctgtctgtatacatatacctttcgtgactatttgatataaatggaatcatacaatatgatctttgtgtctggcttctttgacttagcataatattttgaggtttatctatatacgttgtagcaaataccagcacttcattcctttttatggttgtgtgatactccatgtacatatatttgcagtcataatattaaaaaatttttaattgtggtaaaatcacataacaaaatttactatattaatcattttaagtgtacggttcagtggcattagtaatgtacattcatgttgtttacaaccatcaccaccatccacctccagaaccttattcttcactccaaactgaaactccatatccattattattgttattattattattattattttattattactattttttgagatggagttttgctcttattgcccaggctggagcgcaatggcacaatctcggctcaccgcaacctccacctcccgggttcaagcgattctcctgcctcagcctcccaagtagctgggattacaggcatgcaccaccatgtccagctaattttgcagttttagtagagacagggtttctccatgttggtcaggctggtctcgaactcccgacctcaggtgatctgcccgcctcggcctcccaaagtgctgggattacaggcgtgagccaccgcgcccggccccaaaactccatacccattaaacaataactcccaattgtcccctccctcagcccccggcaaccaccattctaatttctgtctgtatgaatttgactattccaggtacttcatataagtggaatcatacagtatttgcctttttgtgactggcttatttcatttagcataatgtcctcaaggctcatccgtgttgtattatgtgtcagaattttcttcctttttaaggataatatttcattccaaatgtatagaccacattttgtttatcattcatctgttgatgagcacttaggctgcttctacgtcttggctattgtgaataatgttgctatgaacatgggtgtaccaatatttgttcaggagtctgctttcaattctttttctttttttgagacagggtcttgctctgtcgcccaggctggagtggagagcagtggtgccatcacagttaatcgcagcctctacctcctgggctcaagtgatcctcccactttggcctcccacgtagctgggatcaccagtgcacacctcaatgctttgctaactttttaaaaatgtttttgtggagatggggttttgccatgttggccaggctggtctcaaactcctgggctcaaatgatctcctgcctaggtctcccaaagtgttgggattacaggcatgagccaccatgcctagcctgctttcaatccttttggtatatatccagaggtgggattgctggatcatataataattctacttttgattttttttgaagaatcattatgctgttttccataatggctgcattattttacattcctagcaacaatgtgaagtcttggtttgtgtgtgtgtgtgtctgtgttgttttttttgagatgatgtctcgttctgtcacccaggctggagtgcagtggcgccatcttgccttactgcaacctccacctcccgggttcaagtgattctccagcctctcagcctcccgagaagctgggatgacaggcacgtgccacaatacctggctgtttttgtatttttagtagagatggggtttcaccatgtttgccaggctggtcgcgaattcctgacttcaggtgatccactgcctcagcctcccaaagtgctgggattacaggtgtgagccactgcgcccagccaagtcttggtattttaatgttccccaattcagtgtgtgtggagagtactgggcagctctggagtggacattcacctgcatgttatctgatgggtctctctccttggttcaagagtgcaaggccaggtagtaagccagatgtggcttatgtaagtgattaattttatgtgtcaacttgactgggaacttagtgttgaatgtgatgcccagattaaacattatttctaggtgtgtctggaactcggtactaccaccttactccccaggtggtctgggagaggcagcaacagaaagtagacagtttattagggacccagcagatgctggaagcccagggaagggagtttcagggccctgcatccccctacctgtccccacaaatgcaccagctgctaagaccacacctcagcctccttcaccggacctctaaccccccaactatctcttcctgtggttggtcagtctatccacataggtgatgttatttgtccagctggcatctacaattcatcagtcagaaccttggtgatgacctgtccagagtggcaaggggtccaggcagatgagggtgtttccagatgagatgagcatttgaattggtaaactcagaaaagtactttgccctccccagtgtggatggacaccgtccaatttgttgagagcctaaacagaacaaaaggtaacaaaataaggaattcacctccccccactttttttgttgttgttgttgttcctgtctcactgcttgagcagggacatctcatttcttcttctcctgctctcagactgggatttatgccatcagctcccctggttcttaggcctttggaaatggatggaattatactactggctttcctggggctctagctggcagatggtagattacgagacttctcagccttcataactgcatgagccaattccttatcatctatctacctatctataagtccctttggttctgtttctctagaaaatcctaatataggacaggtgtagtggctcatgcctataatcctagcacattggaaggtcgaggcaggcagattacccgagctcaggagtttgagaccagcctgggcaacatggcaaaaccctatctctacaaaaaaaaaaaaaaatgcaaatattagccaggcatagtggcatgtacctgtggtcccagctactcaagagactgaggtgggaggatcacttgagcccaggaggttgaggctatagtgagtcatgatcacgccactgcattccagcctgggcaacagagccagaccctgtctcaaaaataaataaataaataagaaaatcctaatataccaggtgttcattataagtagctagggggttgggacaggaaaataaagaagttggtggtgcaggaagaggcttggagtcagggatcaaggggctatttgagggcttggactaggcttatgcctccaagaatggaaaagggatggaagcaagagacattaggatatggctaggatcaaaaaatcagatgataggccgggtgcaatggcttacgcctgtaatcctaacactttcggaggctgaggcgggcagatgatgaggtcaggagttggagaacagcctggccaacatggtgaaaccccgtctctactaaaaatacaaaaattagctgggcgtgattgcatgcgcctgtagtcacagttactcgggaggctgaggcaggagaattgcttgaacccgggaggcagacgttgtagtgagccgagatcacgccactgtactccagcctgggcaacagagtgagactctctctcaaaaaaaaaaaaaaaattagatgataacaaatagtgtaaaggatgtggagaaatcagttcccccacacattgttggcagaaatgtaaaatggtgctttggaaaatattctgacagttctgaaacaattaaatgtacagttactctatggcagggcatggtggctcacgcctgtaattccagcattttgggaggccaaggtgattggatcacctgaggtcaagagtttgagaccagtctggccaacgtggtaaaaccccgtctctactaaaaatacaaaaattagccaacatggtggtgcgcacctgtagtcccagttactcgggaggctgaagcaggaggatcgcttgaacctgggaggcagaggttgtggtgagctgagatctcgccactgcacccagcctgagtgacagagcgagactctgtctcaaaaaaaatatatatatatagatagatagatagatagatagatagatagatagatagatgatagatacgcagttactctgtgacccaacaattccactcctaggtgtatacccaaaagaaatgaggacacatgtctacccaaaaacttgtacataaatgtttacagtagcattatccatgatagccaaaaggtagaaagaacccaaatgtccatcaactgatgaatgaataatcaaaatgtggtatgtccataaatgaaatactattcaaccataaaaaggaatggagtactgataacatgctacaacacagacaaatcttgaaaacattatgctaagtgaaagaagccagtcacaaaatgccacatattatatgattctatttatacgaaatgtctagaacagggaggtctatagagacagaaagtagattttcagttgcttaaggctggagatggggtgacatggggatcttaagatgataccccaaatgttctaaaactgattgtggtgatgattgcatgtatctatgaatatactaaaaaccactgaaccatacactttattatttttattttttttgagatggagtttttgttcttgttgcccaggctggagtgcaatggcacaatctcagctcactgcaacctccgtcacctgggttcaagtgattctcttgcgctagcctcccgagtagctgggattacaggcatgtgccaccacacctggctaattttgtattttcagtagagacggggtttctccgtgttggtcaggctggtctcgaacttgtaaactcaggtgatccgcccacctcggcctcccaaagtgctgggattacaggcatgagccaccacactcagcctgaatcgtacactttaaatggtgaattgtgtggtgtgtgaattgtatctcaataaagctgttaaagggacagaagtctgggcacagtggctcgcgactgtaattccagcactttgggaggccgaggtgggcggatcacgagctcagttttttttgtttgtttgttttgagacggagtctccctctgtcgcccaggctggagtgcagtggcgcgatctctgctcactgcaagctccgcctcccgagttcacgccattctcctgcctcagcctccggagtgggattacaagcgaccgccaccacgcccggctaattttgtttttgtttttgtttttgtttttttggtatttttggtagagacggggtttcaccgtgttagccaggatgatctcggatctcctgacctcgtgatccgcccacctcgggcttccgaagtgctgggattacaggcgtgagccaccgcgcctggccacgaggtcaggatttcgagaccagcctggccaacacagtgaaaccccatctctactaaaaatacaaagattagccaggcatggtggcaggcgcctgtagtcccagctacttgggaggctgaggcaggagaatcgcttgaacccgggaggctgaggttgtggtgagccaagatcacgtcactgcactccagcctgggcaacagagcgagactccctctcaaaaaatagaaataaacgggacagaagccaggcgtggtggctcacgcctgtaatcccagcactttgggaggccgaggcgggtggatcacctgaggtcaggagttcgagaccagcctggccaaggtggtgaaacccccatctctactaaaaatacaaaaattagccaggcgtggttgtgggcacctttagtcccagctactcgggagtctgaggcaggagaattgctcaaacctgggaggctgaggcaggagaattgctcaaacccgggaggcagaggttgcagtgagctgagatcgcaccgcggcactccaacccggcgacagagggagactccgtctcaaaaaaaaaaaaaaaaaaaaaaacaaaatggacagaagatgtagcttagacttcatgagtgactagttatgggggctagagagaggaaggagacaaagagaacgtcaactattcagttcattatgacatggagaatgtgacggtaatcaccactgatagaaacaggacaatatgtggaaactgaaagaaataaaaatgcagtttggaggaagagatctaataaggttaaggaaaaatactagggccctgtaagttatttttgggttgattagaattttactagctttcccctacaaactccaagaaaatgtctttttcatatattttcatatctcatgggcctatattaagtcatgatcctggaccaaatgctgactccatctaggtatggcagagaagctaagcatccctcagtttccacactgtcctttttcctgttagcagagaaaccaatgctttcccccagttttcactgagaaaatggccacttcccagtttcctctgttggctggatatgtccatataactaagttcagcccaatgggatgggagggagagcgatgtgtgcaacttctagatcatcatcttaaagacaaaactttttgcagtgaatactctttttgctcttcctgaggactgaaacatgggctgagctagtctccatcacatgagcaggacagtgctttaggacaattggataaaagcgatccttattccttagtggcaggtggaagagaattgcttagctagccctggatatctgaccactagctgttttgtggtactcagaaatgaatttccattttatttaaaccactattttcaggtctctttgttaccatagttcggcctctaccgaaattaatacaccagtggggaatgggatgagcttgatgctagtgggccagggaaggtccctaaacgctggtgggaccacaaccctggctggtgtccaggctcttgacaccatcacaagaaggaattcaagaatgagtcagaaaatagtgaaagtgtggagatttattgcaaaatgaaaagtacacactcaagaaagtggagtgagggcgtactcaacagagagtcacgcaatggagtttggggtttctaaccttcatgggtttatttaaccgaggggtggaatattcatgaagattcctggaaaaaggtggagtttctcaaaactctggtgccactcatttttacaccaaatatgagtcctcctagaactgtcctggtgctggtaggtgtgtgattggtatgttaatgagtgtataatgaggtcctcagtgaaacctaggtcaaatccagtgccatgtttggtctggtaggtcttagccagctcagtccacatcctgtttttcagggttttatcagcccctcgcttctgtagctatttcatcagtttccttttgctagttatgtgaacctgcctcctggaattttctgttctcctgagaccaccctgtattaaggtgactgagtcaattcaatcagggtccacctctggggatggggccaggagaggggtcatcttccctgaagcacctgagttttatatggaacagtggacatctgaatgaaaactcaaggtgcttttccaaagaagaagggggaaaggatattgagcaatcaaaagcagaaaatgggccgggtgcagtgtctcacacctataatcccaacactttgggaggctgaggtgggcagatcacttgaggccaggagttcgagaccagcttggccaacatggccaaaccccgactctactaaaaacacaaaaattagccgggcatggtggtgcatgcctgttatctcagctacttgggaggctgaggcatgagaattgcttgaacctgggaggtggaggttgcagtgagccaagatcatgccactgcattatagtctgggcaaccgagtgagactcttttgcaaaagaaaaaaaaaaaagcagaaaaggttcactacaacctagaagagggtttctccacttaggcactactgtcatttggaactacataatattttgttgtaaggggctgtcttgtacattgtagaatgttggtagcatccctagtctctactgtatatactcccccccatcatgccaatcaaaaatatcttcagatcttgccaaatatcccctggagggcaaaaaatttcccatttgagaagcactgctctagaaagggcttggagctgccttttctgcctctcacttctagtctttttctcatatgattggcagattttcttttgtaacaaaaacatgccatgcttggaaataacaactgtattctgtgcactcatagagtcaaatctaaacccttaaatgagacttacaaaactcttctcaaaacaattacttgtctcacttctcaaaaaaattatttgtctcaactacaatcctatccccccatacagattgctctagtcatactgaatttttcccactattctcaaagtttccatgacttttttactcatatgcttttgtacatattcttctttctgcctgcagtacagacgctgctctacttgtgatgggggtaaatcttagtaagcgcattgtaagttgaaaatactggaagtcagccgggtacgggtggctcacgcctgtaatcccagcactttgggaggctgaggtgggcaaatcatgaggtcaggagattgagaccatcctggccaacatggtaataccccatctctactaaaaatgcaaaaattagctgggcgtggtggcgcatgcctgtaatcccagctactcaggaggctgaggcaggagaattgcttgaaccagggagtcagaggttgcggtgagctgagatcgtgctactgcattccagcctggcgacagagtgagactctgtctcaaaaaaaaaaaaaaaagaacgaaagaaaatactctaagtcaaaatgcatttactacacctaacctaccaaacattatagcctagtctaacctacctcaacgtgctcagaactcttacattagcctacagttggaaaaagtcatctaacacaaagcctattttatattaaagtgttgaatagttcatgtaatttattgactactgtactgaaagtggaaacagaacggttgtatgggtactcaaagtatgaattctactaaatttaaatcacttttgcaccactgtaaagtgaaaaaaaatcataagttggggaccatctgtacttttctccacttctctcttagggaaactcctatatactcttttttttttttttttgagacggagttttgctcttgttgcccaggctggagtgcaatggcacgatctcggctcaccacaacctccgcctcctgggttcaagcaattctcctgcctcagcctcccgagtagctgagattacaggcatgcaccactacgcctggctaattttgtatttttagtacagatggggtttctccatgttgaggctggtctcagactcctgacttcaggtgatctgcccgcctcagcctcccaaagtgctgggattacaggcgtgagccaccgcgcccagcctggaaacttctatatactctttaagactcaattcaaacaggacttcccctattaaaaaaaaaagtcctaacatttcctaagaaaacttggtgtctccatactaaactttgttcatacctatcgggtcatgcttggcacacttttttgttatttgtgtattaatcgcttttcagcccccgggggttctaacaaggtgcctaacacagagaagttgccccataaatgcttgttgaatgggtgagtgaaatgaaggaaaagtgccacagcagtgccttcaaatttcactgacaaaacttgtactttggccagagttcattggcttttattagcttagactgggtttacaacaggtgtctctgtcactaaactggaaagtaggtgaaaagctaacctcaggacaccaaattaaatactttcagcactgtgccatggtagcccttggatcacagagcatgaagtgtctgagcagtaatttccagctgctgctgccagagaaataataaatgatgttacacagaaagtatcacattatagtttattatacatgaacctctgtgagagtaagctgtaaatggttcgcaccctagagcatgggcttagtctttccaaacaaatccatttacttgttatctttataaagtcctgattaaaacatgttttggagatatagatatatctaacacatggaccatagtagtctcttgtgagtatctgaatcaaaattttagtatctagatagcaccaaacttagaaaagtatgcccttttacagaattacaggttcaatttcatttggctggactacatgtctttctactttagggtcctaatgtcagaatatggtcggacatggtagctcacacctgtaatcccaggactttgggaggccaagatgggaggattccttgaggccaggagtttgagaccaccctggacaacaaagtgagaccccatctctacagaaaataaaaaatttgccagggttggtgtatgtgcctgtagtcctagacgctcacaaggccaagatgggaggattgcttgaactcaggaagttgaggccgcagtgagccatgagtacatcactgcactccagcttgggtgacagagcaaaaccttgcctcaaaaaaaaaaaaaaaaaaaaaagaaatatatcagaataggcccactaccccctagaaaatgtccccaaacggcctctgctgcttcctactgctggctgtcttctcacatcactgacagaatcatctgtctattaacccagatatgtcatgcttggaactgtggagtctgtttaggacagcacaatcccgcagttgggtctgagaatagtaaaaatgtcacaaatgatccaccaactttggtggaatttttttttttttgagacagagtctcgctctgtcgcccaggctggagtgcagtggcgtgatctcggcttactgcaagctctgcctcccgggttctcaccattctcctgcctcagcctcccgagtagctgggactacaggcacacgccaccacgcccagctaattttttgtatttttagtagagacggggtttcaccatgttggccaggatggtctccatctcttgacctcgtgatccgcccaccttggcctcccaaagtgctgggattatagacgtgagccaccatgcccggctggtggagtttttttaacctaaaaattttacttctgtattaactttatagcacaaatattttcttcataatacggataatccagagggaagttcaaaagtgaaacagatggaggaagggcaggggaaaagatggtcccttgaattggggagagtagaaggtctcagggtccccatgtcatggcttccctgtgctggtccagtggatctcaactcggcggtctacacagcagcacacctggggaatttaaaaaatactgatgctccggccctgattgaaccagaatttcaggggacggcctatacagctactgcttaaatatccatccatgtatccagagtctgaaaaaaaccttcagattcataaacacagagcccatccccatgttggagaagcagagcacggtgatagcccccaccatgaataccaagaccggggagggactgggcttttccgccatctcctcactgtcccatacgctaccctcaacaaaaacacaggatagtgttaacagaagaaaggggaaggacactgggcaggtgcaaaaacatgacaaatatttattacagttagtataactgtgcctaaggcttaaagttccgtggtttgttttttttttgagacagagttttgcccttgttgcccaagctggagtacaatggcacgatctcagctcactgcaacctccacctcccgggttcaagcgattctcctgccttagcctcccgagtagctgggattacaggcgcatgccaccacacccggctaattttttgtattttttgtagaaacgggatttcaccatgttagccaagctgctcttgaactcctgacctcaggtgatctgcccacctcagcctcccaaagcactgggattacaggcatgagccgccgtgcccagtcaaggcttaaagttcatacaccaggcctgaacagcaattacttgctgcctaagtctttttttttttgagacagtcttgttctgtcgcccaagctagagtgccaatggcatgatctcagttcactgcaacctccacctcccagattcaggcgattctcctgcctcagcctcccaaggagctgggactacaggcatgtgccaccacacctggctactttttttatttttagtagagatggagtttcaccatgtttgtcaggctggtgttgaactcctgacctcaaatgatctgcccacctcggcctcccaaagtgctgggattacaggcatgagccattgtgtccagactttttttttttttttttttttttgagacagagtctccctttatcccccagtctggagtgcagtggcatgatctcggctcactgtagcttccgcctcccgtgtccaagcaattctcctgcctcagcctcccaagtagctgggattacaggcacatgccaccatgcccagctaatttttgtatttttagtagagatggggtttcaccatgttggccaggctggtcttgaacccctgacctcaggtgatctgcccgccttgccctcccaaagtgctgggattacaggcgtgagccactgcgcccagccgctgcctaagtcctattatagttcaggacctgggcaaagttgaacttgaacctataagtaaacaaggctagggaatgcaggatacaatacaggtagcagtaaaaggtgcgggcatgttttcttagctttgagtgaaggggaaaaaaattgagagggaaattcccccccccttttttttctgttaatgttgatatcttataatgttggacactttaaagtaaatacttataatcctcacccccacagaaaagtttcacttgtgttatataacatatacccaatagaattgagatatgattcataacctatatgtgtgactctgtttcttaatcataaaatgtgtggtatctgtcaatgttagaagatggagcagggactcctcttagggacctgccaggtgcccccacccccaccaccacaagcacgaaaataaaggacaagttttgagttccttcacaggagattccaggcacctagctagacttgagaagtaaatgagcaatccaagaagagagcagtaggtggggcgtggtgctcacgcctgtaatcccagcactttgggaggccgaggcgggtggatcacgaagtcaggagatcgagaccatcctggctaacacggtgaaaccccgtctctactaaaaatacaaaaaattagccaggcgtggtggcgggcgcctgtaatcccagctactcaggaggctgaggcaggagaatggcgtgaacctgggaggcggagctggcagtgagccgagatcaccccactgcactccagcctgggcgacagaatgagactctgtctcaaaaaaaaaaaaaaaagagagagcagtaacttaaaaaataagtcttctaagcaagttagagtcacaagctatttcagttgcctgtagaaactaaaagacaacatcttaatgtatgttcttgagttgttttttgtttgtttgtttgtttttgagatggagtctggctctgtcaccaggctggagtgcagtggcgtgatctcggctcattgcaacctctgcctcccgggttcaagccattctcctgcctcagcctcccaagtggctgggactacaggcacatgccaccacgcccgggtaatttttatatttttagtagagacagggaatcaccatgttggccaggatggtctcgatttcttgacctcatgatccgcccgccttggcctcccaaagtgctgggattacaggggtgagccaccgtgcctgttctttgagttgtttatcagaaagctggacccccaccagatgaaaaatgctgatcactgtcacatagacctcagataagggagaagtaaggactgaactctgactgttctgaatttctccctgagcagcctggagggagtcaggcccacaggccaaaccttaacattcctttccgatgacccccagtttttagacaaagccttgctccttaaccaactccaaatcaaagagtctctgaatccaattatgacctgtaagctcctgctttgagacatcccactttttggtggccaaatcaatgtataacctccatatattgatttactattttgcctgtaacttttgtttcctttttttgagacagagtctctctctgtcgcccaggctgcagtgcggtggtgcgatctcggctcactgcaactctgcctcccgggctcacgccattctcctgccttagcctcccaagtagctgggactacaggcacctgccaccatgcccggctaatttttttgtatttttggtagagacggagtttcaccgcattagccaggatggtcttgattttctgaccttgtgatccgcccacctcggcctccgaaagtgctggaattacaggcctgatccaccatgcccagcctctttttttttttttcccatttaaaaaatatttttggtcaggcacggtggctcatgcctataatcccagcactttgggaggctgaggtgggcagatcacctgaggtcaggagttcaaaaccagcctggccaacatggcaaaatcctgtctctactaaaaatacaaaaattagctgggcacggtggcacacacctgtattcacaactacttgggaagctgaggcaggagaatcacttgaacctgggaggcggaagctgcagtgagctgagatcatgccactgaaccccagtctgggcaacagaatatgactccgtctcaaaaaaaaaatatatatatatatatatatatattatatatatgtgtgtgtgtgtgtgtgtgtgtgtgtgtgtgtttgtgtgtgtatttatttatttatttttataaaaaatagagacagggtctcactatgtttcccaggctgatcttgaactgggctcaagctatcctcctgcttccgcttcccaaagtgctgggattacaggtgtgaaccacctggccaacttctgctttcttaaacatccttacctgtaagtcattagggagttcaagtcttcagcattagtttgctgcccagttctccttgcctggcaccaggcaataaatgcctcacttccgcttgctgtaaatcccagcgtcagtgtttgtttgtttgtttttcctgtgtgctgcgtaagcagacccaagttcagttgggtaacagctaggattctaaaggttaagggaagcaagtgaactttgttttggctttttcccactacaccagagataaaccagtacagggagtaaagtcccatttttacaggctgtatatgagaggacctgtgtgcagtgcagagcagctgctgctccgggtagaaaagtcttgcctaaagatcaaacaatcagtatgtcactatgagttctccttgacccaagagctcttgcaggcctggagggaacatctgtcccagagtggtctttatggagaatttctagggttggtccattagggaaaatgtccccaaggaacattgattcttacctatataagaatacatacacccaggccgggcgtggtggctcacgcctgtaatcccagcactttgggaggccaaggcgggcggatcacgaggtcaggagatcgagaccatcctggctaacacggtgaaagcctgtctctactaaaaatacaaaaaattagctgggcatggtggcgagcacctatagtcccagctacttgggaggctgaggcaggagaatggcgtgaacctgggaggcggagcttgcagtgagccgagactgcgccactgcactccagcctgggtgacagagtgagactctgtctcaaaaaaaaaaaaaaaaaagaatatatacacctcactccccatttttgtgagacctgagaaagcagtaaggacagtaatgacgatgaatagtgacttctttttatttctactatgcaggctctgtgctggatattttgcctgccatgatttatttaatcctgaacacaaccccgtgaggtagaaattagcaccagctcacttgggtgaactgagtctgtctgacctgcgtctttcagccatgtctctgaaacctactttttctgcagcaccccccaccctgaactagggtactgtaggctctaatttcttaatcgcctcagatcatccacaagttctgacacctgagattggagcccgtggtcttgcagacagatccccccggtaaccaagggctttctctttagccttcttccaatcacctgccaattgccttcccaatcctgcttggactgactctcagatgctacagtgacactgcttcagaggagtgacatatatatacatataattatatataaaataatatataaaaatagtatatataaacaagaaatatataaaaatatatatttcatttacttatttattttttgagatgaagtctcgctctgtcacccaggctggagtgcaatggtgcaatctcagctcactgcaacctccgccttctggattcaagtgattctcctgcctcagcctctcgagtagctgggactacagccatgcgccaccacgcccagctaatttttgtagttttagtagagacggggtttcaccatgttggccaggatggtctcgatctcttgacctcatgatctgcccaccttgtcctcccaaagtgctgggattataggcgtgagccagtgtgcccggcctatttcttttatttttatttttatttatttttattttttttagacagggtgttgctctgtcaccaaggctggagtgcagtgatgcaaacatgctcactgcagcctcaacctcctgggctcaaatgagcctcccaccttggcctcttgtgcagctgggactataggtgcgtgccaccatgcccagcaaattttcatatttttaattttatgtagaaacagagtctcactttgttgcccagctggtctcaaactcctggattcaagccatcctcccaccttggcctcccaaagtgctgagattcaggcatgagccactgcacctggcctcacaggcttatctcttggccttatcattttctccaaggtgaatgccaaagaaaattgactttgctatgcatttgagtcagtggcctctgcctgttcctgttggtatgcctgatttctggcctatcctggttgaagcttgggctctgtgattatgaaagagaagacttttcagacaccagacatatgattggatattaaaatagtggctagacaggattttatacctgtaagtgctatagcaaatgctccttctctcctgtcctcacacacaaaaaaagataaattatggatccttatcctttggaaggctggaagcttatgtgttaaaagtgtaaatgttagctgcgtgcaatggctcactgtaatcccagcatttaaaggccgaggtgggcgatagctttgagttcaggactttgagaccaacctgggcaacatggcaaaaccctgtctctacaaaaaatacaaaaattagctgggcgtgttggctacttggcccctatagtcccagctacttggaaggctcaggtgggaggtttgagcctgggaagcggagactgtagtgagatcgcgccactgcactccagcctgggtgacagagtgagagcttgtttcaaaaaaaaaaaaaatacacacacacacacacacacacacacacacacacacacacacacatatatatttggtgttataaatatttttaaagtaacttttatgttttttcgttttgtttttttgagacagagtcttgctcagtcgcccaggctggagtgcagtggcgcgatcttggctcactgcaagctccgcctcctgggttcacaccattctcctacctcagcctcccaagtagctgggactacaggcgtccgccaccacgcccagctaattttttgtgtatttttagtaaagatggggtttcaccgtgttagccaggatgatctcggtctcctgacctcgtgatccacccacctcggcctcccaaagtgctgggattacaggcgtgagccaccgcgcccggcctatgtttttctaattataaaaatatgtgagttttctgtagacagcatgtaaatacagaaaaatatcacccagagtccaataatccctaaatggagaatcactgggaacagtttagtgtatatagtatgtttaagctgtacatacacataaacacaaaattgtgagcattctcagtatggtttcatgtactgctatttcatttactattaccctgctagcatttcccctatcatcaaaattctttgaaaatatgtttattaactgtataatattttattttatgaatgtactgtgaattatttaatcctcttcagagactcaggttgattctactgataattgtgctgcaacgagcatactgtgcgttcatttctatgtggaattctatggccttaaaatagaatcctagcagtagaatcactgagataaagggtaagagtatctaaagcagtggctaatgaagttttagttttaggaccctttacattcttatgtgttttttcttttttttctttttttttgagactgagtcttgtttttttttcttttcttttttttgagactgaatcttgctctattgcccaggctggagtgcaatgacacgatctcagctcactgcaatctccaccttccgggttcacgccattcttgcgcctcagcctcccaagtagctgagattacaggtgcccgccaccatggcgggctaattttcatatttttagtagagacagggttttgccattcttggccaggctggtctcaggtgatctgaccacctcggcctctcaaagtgctgcccggccctttttcattctcaactattgttgaagacctaaagagattttgtttatgttggttacagctatcagtattcactatattagaaatttaaaataagaaattaaaaaaatatttattacttcatgttaaaatagcaataaggaacccattatttttgaataaacagaggaattaacgagaggttgaagtcaagtatgctagtttcctgcagaggcccaaagaaattcccgtttctggtgattccattcacagagactgaaaacagaggagcaggggagtgggcaggggtgggccttggtggagacagagatgggaaagagggtgagtctgtaagagtctggcattcctcctacaggacacgtgggcattttcaagactccagtccactaggtggatcttcaaaggcttatgccacattcttccatagcacacttctaaaatacctgttttatagggtttaaactatctgctttatagggaccaagtgtggtggctcacgcccgtaatcccagcactttgggaggccgaggcagatggatcacaaggtcaggtgttcgagaccagcctggccaagatggcaaaaccccgtctctactaaaaatacaaaaattagccggggccagatgcagtggctaacgcctgtaatctcagcactttgggaggccaaggcaggcggatcgcttgaggccagtagttcaagaccagcctggccaacacagtgaaacccagtctctactaaaaatacaaaaataagccaggcgtggtggcgtgaacctgtaattctagctactcgggatcctgaagcacgagaatcgctagaatccaggaggcagaggttgcagtgagccaagattgcaccactgcactccagcctgggcgacagagcaagactctatttcaaaaaaaaaaaaaatctgctttatagggtccttttacaaactattaggccacttatcctcaaaaccaaacaatgcaatagggtagacagataggaactcgcaggctgttcacaaggaaactgaggccctgagaggttatgtgacttgtcagtcttcccacctcccttttgcccatcttataatagactcatgtctggaactcaattgtcctgattgctagctcgttgtgcccagtgactcaagagagtgaaaattgttggttcagcagtctatcttctaaatttgcttcttctaaaagtatttaaaaggtataagaaatataaattactccctaggctgctaggcaggcacctggttttctcctggggtagtcagaaccctcctatctttaatttttcacggatgaatataccaacagtgaacaatggccagaccatggggaatagaactgagtctcacaaactttgtagcaaccagctggggaagccaaaccacttggcttccaactcagcaccgaccagagaaagccaaagatgctccccagactaatcaccgaagatgccctgcttcattttttttttttttttttttttgagacagagtttcgctttgtcacccaggctggagtgcagtggtgcgatcttggctcactgcaacctctgcctcccagattaaagcaattctcctgcctcagcctccctagcagctgggactacaggcacgcaccaccatgcccggcttatttatttatttatttatatttttagcagagacgaggtttccctatgttggccaggctggccttgaactcctgaccttgtgagcttcccacctcagcctcccaaattgctgggattacaggcgtgagccaccgcacccagcctgccctgcttctaagcagtccatctcccacttcctcgtgccaataagctccaatccagataaacctgaagccttccctttttgtcactgtaaattctctcactcctctgcctgctttgaccttctgccaaagtgatggaagctgactcccatagcatagcaagctctgagtaaatagcccctgtactcatttatttccacaccactgaatgaataatgaaagatgttataaagccaaattatgaaaagggcatcagttattaaacatttgtaaaatgttttacaaccatcttagtatgcctcataaacacctcgtgaagtgctgccatccccgtttcagagctgagaaaattgagaaggaaccatgagattaagtgacttgcccagagctatgatgagaacatgagccccccagggtttgaggtctgttgtttatccactgagcttgagctgcgctttggaatcattaccatcttaaagcattttaccctgtgttgggtgaatattaagaagtagatcacatttcagcctggcaggcgcgaaagtattgtttttagtttgtttttctaaattttagtagaggacatatgggctctattaactttactatgtagcacaatttgaaagatagtttcttttccagcaaatttttcaccgtaatttaacattttaaaattcagcacacaccgtcctccctggatacttgtttttctcagagttgggcctttttcctctccactgcagcttggaaggtcgtaaatccagccagggggattttattatgcctggggacagttttcaaagttaggtatgagtggaaggaagggagggcgggtgcaacagcgctggacaaagtccgtctaatgcaagactttcctttcttttttttttgtttttaaagataagaacttttttggctttctccccgcaaagcttgctgatgatgttgactgatgaggacatgaaaaaagctgagatttgcagaacataactggagcataagaacgcctgtctggaaggcaggggctgctgggaaaggatctctctggagctccttgctggctgcaaaaatgcagctgtccctattcctctctactctgggacatttaaaaaggaggctgtgtggcagtagcatttggcttgtgtgccactgtacctggtcagcctggcatggaatgccttagtggtttgttaggggtcactgactgaggctaaataaatttagcaccatgtatactttcattaaatattaaacaatgaggccaagcacggtggctcatgcctgtaatcccagcactttgggaggctgaggtgggaggatcgcttgtggccaggagtttgagaccagcctgggcgacatagcgaaaccctgtctctacaaaaaatttaaaaaattaactaggcatggtgatgcatacctgtagtcccagctacttgggaggctgaggcaggaggatcacttgaacccaggaggtcacggcagcattgagctctgatcatagcactgcctctggcctgggcaacagagcaatactctgtctctaaaagagaaaaacaaacaaacaacaacaaaaaaaaacacaaaaagacaataacattcaattgtttgctaatggttcatctgcccaatctctggaatcctgtctttcacctactcaccttcactcacttagaaacttatgcattggcttcaaatactatttcttctatattatcctttcacctttcttctttaaaaaaaaatttatttagagacagggtcttgctaggttgctcgggctggccttgaactcctggccttaagtgatcctcccacctctgccttccatctttttatcttcttcagcttatgaaaatggatccatctgcattaaaggcctaaaaatgtatgtagtcaggtgagtgttgtgatagttggtgtgatggttaatactgagtgtcaacttgattggattgagggatacaaagtatgaatcctgggtgtgtctgcgtggctattgccaaaagagattaatattggagtcagtgggctggggaaggcagatccacccttcatctggtgggcacaatgtaatcagctgccagtgaatataaggcaggcagaaaaacacgaaaaggagagagactggcctagcctcccagcctacatctttctcccatgctggatgcttcctgccctcaaacgtcggactccaggttcttcagttttgggacttggactggatctccttgctcctcagcttgcagacagcctattgtgggaccttgtgattgtggaggttaatacttaataaactccccttatgtctgtctgtctatctgtctgtctgtctatctatctatctatctatctatctatcataggatatatatatatatctatttatattagttctgtccctctaagagaaccctgactaacacagttggtgaaggtttccttttctcctctgatgatgtgagtgaagcaggctttcagggattatgagaacaggcgaagtcttcaaggagatgggcccctcaaacacagcctgcacatcccatccatctccccattctcctggaagccatgccttggaaggcagaggggatgctggagggatgcaggtctcagggcctgagaagttgagggtggttctagatagagtagagaatgaatgggataaggggcagtagaggcctgacctccgagagatctcaccactcctaactttgactattcctgtctggctgcatttgggtttccttttgtcccaagaaaagaaagacgaaaaaccttagagtgttgggagtctagatatgttaaaactaacagatgttagttcattgatcaccaagacaatgcacgggccagtaggacttctcacagcaaaaaagccaggatggagaggcggaagaccaggttgggcagatccttcagctttcagctgtttttctcatcctttatagcactgtaattaggactagatgaggaaaaaaagatgggcatgagctgtagctacagggggaaaacaataaatgactaacagataaaaaaaatgtaagtgaagtgctaatattccagtcatttaaaatattgctgggaagaccaattatccgtgtaaaaaaggtgaaaacaaatataacattgcttaggtaattctgtggacccttgatacacagtatttgcataaaatcagaattacagaatttagtgttttgtggtttttgtttgtttgttttttgagacacctgggtccggggaggtggaggctgcagtgagctgtcatgccactgcactccagcctgcacaacagagtgatgaaagaaaggaagggagggagggagggagggagggggaggggaggggaggggaaggggaagggagaagggagggggaggggaggagagggggaggggaggggagggggaggggaggaggggggggaggggggaggggaggagagggggaggggaggggggagggaggggagggagaaagaaaggaagggagggaggaggaggggagggggaggggagggggaggggaggggagggggaggggagggggaggggaagggagggggatgggaggggagaggagggggaggggagcgggatgggaggggaggggggagggaggggagggaagggagaaaggaaggaaggaaggaagggagagaaagcaagggaaagaaggaaagaaagaaagggaaaataatcaaaaatataagaacacaaacaaaagcacattctgtcagctcatcctctctataggctaaggaaactatactatctgaacccaaaggagagaaataaacaaaatcaaatacttatctacccatccctctgcacacggtcttagttgaagtgagagtatacacttcattactgtgtacctggattttatcccattctgctacaaaatgcacgtcagtgcgttcactttcactgcatgatatagaagctgttctgtatgcagccaaatcacattactgcccattgctgaaagaaatgaccttcaatgaacgggttataaaattcactcatgatcacttattgaatgcctatgtgccagacacactgttaagcatgatggaatcagagaaatgttgctgtctaacgtatcccagtctagtggggtaatatataacctgatacattatgattccatggaagtgtttcactaatggtataaatcacgagctgtgtcagaaacccaggaggaattgatacgtctcccgggagagtgtggggagactctggtggaggtgacgtgtgatcgtggtcttgaaggatgagcggaaatttgccaagtgaacaagggggaaaggaatttacaagtagagggaagaggatggctcgtcaaagtgtctggcaatactgagaaatgttgaaaagggtggtgtagctacagcccaggtttcacgggacagaggtagctgcagtgtggttaggttggggctagtgcatggggagccttggtacacctgccacgtgcaactggtaatcatccctagaggtactgggagcacagagtgtcatgcgtggagttacatgtactgtgtgctgtgcttttaatgtaacttgaagtcgtaaggagggaatatatgatgtgggagcagagcaaggagaagcaagttagggagaccaaacaggaggcagcagtggggacggctgactttgagaggcgtctttgaaagacaataggtaatatttggtagacattggatgtggaggctgaggcagcaggagaaacagagtatgactttgaagttgctcaatacaggagatactgggtggctggcggtactattaacccagatgacaggacacggaaacaggatgggttctctgctccggcgtgtccctgaggagtcactcttaactttggtacaggtgatcagcaactgggaaagtgtatgaagcccactccagaatgagaccactgacctcttcatttccatgctttcggctcaaggtatcattcggctcaacaccatttaaaagctatctaggctgggtgtagtggctcacacctgtaatcccagcactttgggaggccgaggcgggtggatcacttgaggtcaggagttcaagaccagcctggccaacatggtgaaaccccatctctacaaaaaaattaaaaaattagctgggtgtggtggtgggtgcctgtaatcccagctacttgggagtctgaggcaggagaattgcttgaacccgggaggcagaggttgcagtgagctgagatcgtgccactgcactccagcctgggtgacagagcaagatgccgtctaaaaaccaaaataaaaagctatctaggggcaggcttatgcctgtaatctcgacactttgggaggctgaggcgggcagatcacctgaggtctggagttcaagaccagcctggccaacatggtgaaaccccatctcctttactaaaaatacaaaattagctggccatggtagtgcacacccataatcccagctactcaggaggctgaggcaggagaatcgcttgaacccaggagcagaggttgcaatgagccaagatcatgccattgcactccagcctgggcgacaagagaaaactctgtctctaaataaataaataaaaataaaagctatttagggccaggcatggtggctcatgcctgtaatcccagcacttcagaaggctgaaatgggcagattgcttgagtccaggggtttgagaccagcctggccaacatggcaaaaccctgtatctacaaaaatacaaaaattagctgggcgtggtggcacatgcctgtagtcccagctacttggggggctgaggcaggaggattacttgagcccgagagttggaggctgcagtaagctgtgtttgcgccactacactccagcctgggtgacaaagcaaaattgtctcaaacaacaacaacaaaaacaacaacaaaaagctttctagaacatttccaatctagtgcaaacctctttttggttacaccgtgtatcattccagttataagaatgtaaaaagtggcaactccggagccaggctatctgggcaagtgacctctggaaaggcccttaaacttcgctgtgtctcagtttccttatctacagaataaggattaaaattattcaaaaggttgttgtggaattgaaatgagttagtatatgtaaaagtgaatctggcgcatagtgtaagtactttcttttgtggagtcttgctctgtcgctcaggctggagtgcaggggtgcaatcttggctcactacaaactctgcccccgccacgcccagctaatttttgtatttttagtagagatggggtttcgtcatgttggccaggctggtttcgaactcctgacctcaggtgatccacccgcctcggcctcccaaagtgctgggattacaggcgtgagccactgtgcccggcccatagtgtaagtactttctaagtgtttgctatcaataagtaataaatcatagaatactcgactgaaagtggtacaaatattagagatttattattacagaacaagatggaagttggcagttccagggtttgtcctgtcaattaaccaaggcatcccggagactggactcttcctgtacccactgccacgctcagtgtggcagtgccttctcccctcatcatggcagggaggccaccacagctccaacaaccaagtcttcacatggtcagcatcccaagcatgaaataaggggatgtggttagaaagggcttttctccttgtgcagccttccctttacaagcaagaaaatctctcctagaagtccctagtaggtttcctttcagctaaaacttgggtcacaggcccatccctgaacctggcacttccaacctgtaacaaatgaggcagaagtgggactagggctggctgctgggcagctgaccggtagtgcccaccacagtctgggagccaaagagttccaaaagttcctcactcaggccaggggtaattgagaaacaggcacataacagtattcatccaggagtcctcaggttttttaagagttttttagttttttttttgttgttgttgttttgtttttttttttgagatgggctctcgttctgtcgcccaggctggagtgcagtggcgtgatcatggctcactgcagcctcgacctcctgggctcaagtgatcctcccacctcagtctcccaaagggctgagattacagatgtgagccactatgtgcctggctaagagtagcttatttttattttattttattttatttttttgagatagagtcttgctctgtcgcctaggctggagtgcaatggagcgatcttggctcactgcaaccgccccctcccggcctcaagcaattatcctacctcagcctcccaagtagctgggattacaggtgtctgccaccatgcctggctaatttttgtatttctgtagagatggggtttcaccatgttggccaggctggtctagaactcctgacctcaggtgatccacccaccttggactcccaaagtgctgggattacaggcgtgagccaccacgcctggccaagagtagctttttaacctaggtcagtatcgtgttggtaaaatacggagagaggatgtttgagcagaaggacctacctcatcttctcacctgttctaggctgctaccttctctttctacaaaccaaaggagggggctcataactcaatgggccttgtgggaaaggctaaccagactagtcactgctgaattcctctaagggattcccctaccctgactgcccttgccacagttgcacccaccatcctaggggcagtaagtagagagagctgtgtgagaagagcactctttccactccagatgtcccctacaacctatatcctcacggccactaacagtttgggcccgtagcatcactcatctggaccgctcccatgtggtctccccatcacaacaaagactgcagcaaggtggacagagaactccaagagagccaggaaaatacctttataaaccatcacagaaagcctgatttccactcgctaaatccattaataaagagaggagaaattttaaaattccaaggcacctggttactaatctgattctggcctacatgtggatattcaataaatacttgttaagttaaattgactcaaggttttatttattcagcctacttaaagcttatgtaaaccccttggagatttgtgtcaagctgttaagttggaaaatataagaaaagtagtattttcaatagaccagctttcctcttaatgtactttatgaacttagtgtaaaccagggaaatgggggaggggtaccagaagagcagaggggaaggaggtgaggaggaaggaagaggtgaggaggaaggagaagaaaagccttttctgtcatttcctgcatttgtcttaattgctgtacttattaaccagctactgccctctagtgctcactgtattaagttcgcatctgaattccatttttatctttaaaaactctggtgacacttggaagggatcaaatttcctgttttgcagataagcaaattgaagtccagaggaaagaggtatcaaactgacccaggggacttctggactctttgttacctcacctataacttgtctggaaaactttattaaaagcctttctcagaaattttaattggtaaccagtaaaaattgtagcatcatgttagtgctagttattattattattatttttgagacggagtctggctctgttgcccaggctggagcgcaatggtgcaatctggctcaccgcaacctccgcctcctggattcaaactactctcctgcctcagcctcccaagtagctggaactacaggcgcccgccaccacgcccggctaattttttgtatttttagtagaggcggggtttcaccgtgttagccaggatggtctcgatctcctgacctcgtgatttgcccatctcggcctcccaaagtgctgggattacaggcgtgagccaccgcgcctggcctgtgctagttattatttccaatgttgttctaaattaagcttagactgattgctggtcaatttaagtaaggatataaaataatagtggtacatttttaacttagtacaagtttagaaaatgtctataatacttctttaaaaagttaactagaggccgggcacggtggctcacgcctgtaatcccagcactttgggaggccgaggcgggcggatcacaaggtcaggagatcgagaccatcctgactaacacagtgaaaccccgtctttactaaaaatataaaaaattagctgggcgtgttggcgggcgcctgtagtcccagctacttgggaggctgaggcaggagaatggcgggaacccaggaggcggagctggcagtgagccgagatcgcgccactgcactctagcctgggtgacagagcaagactctgtcacacacacacacacacacacacacacacacacacacacacaagttaactagaacagatcccaagtggatatggccatttatcagaactgacttatcattgtctccatgtgggctaacattccgctagattctcccaagtgaagctctttgctcactgatgggaaaaagggggggttgtcattttaacgtggaacgcatattttcaccacataatcattttgctagtggaaataaatggaaagttatccagctggacatgctacttatgagaacactactgagtaacaaaagatttattcaaatatttaattggaaggaactacatctggaataagttttaaaggaatccatataaaaagaaaagcaaatccattagaaattgatataaacagttgattttatctggaaccaagaatgtgaatgaattggaacctagatgtcctaacctgtttctttgcataaaagccagttgaattttgaaatttatatggcaattatactttattactttacatagagctttgtttttagctaatattttagagacagattacccaaaattacctaatttggttcccacttcattccttctcaaaaaccaaacataaaacagaagggggccagctgtggtggctcatgcctgtaatcccagcactttgggaggccgaggagggtggatcactaggtcaggagtttgagaccagcctgaccaacatggtgaaaccccgtctctactaaaaatacaaaaatcacccaggtgtggtggcacatgcctgtaatcccagatacttaggaggctgaggcaggagaatcgcttgaacccaggagacggaggttgcggtgagagccgagatcgtgctactgcactccagcctgggcaacaaagcaagactctgtctccaaaaaaaaaaaaggaaagcagaagggggcattttcctgtcttcaaaatacaacctcctgctaagactagcaagtcagcagaaactcattgcatttgggcttctggttactaaatgaattaagagacaccgagttccatccttagatgtccacatagatcccattgatcaaataatccagtcttgagtaacgtttcctgcggagtgattccgagaggattctacccaggaggacgaggcctatcaccaggaacaggacaccaaagagcagggacccgataagaagccatttttcaaatggaaggccgtactgattttctggaacactgccctgggaggaactgcctggactggcctccctaccttcccaggaagcagttttattcatagtggaagactccacatttgacatagaaagtgcagtagggttatacacattccctgtgttcaaagttaggttggagatttctgtaaacggtatggtttctaagctgcctttcgagtccgtaggtgcctgaaaggtggtagtcagaactgctgttgtagccattgcttggagtgtagccgcagcccgtgtaaaaactgtagaaatgagggtcgtgggaggctgagaagtgacagtggttacaggtggagctgtggtggccagctgtggctgggaagtcccagaaggtgtcactgaagcattggtgggtagaagggtggcgggctttggagtagccgaggtggtatgtggagaagcaactgccaccgtagctgggagcgcactcacattttcaggcagcagatgagctatttcttgatcagaggaaaattgtgaactctgagaatggcctttttccttataagcaaggagctgggcacttgcttcatccatcttaaatagtttctccaagtgatctgaggatccaaacttctgagaaagtgtgtctctccatgagatatcggtgggctttgaataatctgtgtgatgatgggctaggggagtgactgcttgtgaaaattggccatgtaagagagaatcttcctggggtaactcttggcttggcaaatttctggtcaaagatggaaaatctgaaaatgtatggaaaataaaaggaaggcttatgtaactccatgctacggtaggttaaaaaaatacaaacatatcagcttgttcaaaagatccctaaactggttggccatggtggctcacgcctataatcccagcactttgggaggctaaggcaggaggatggtttgaggccaggagttggagaccagcctggacaacatagggagatcctgtctcttaaacaaaaaaatctccaaactgttgatacttgacatttcattgaaatgtgtgcaaaatggaaaaacacaaattgctaaatgagaatctgataacgccgcctctctaccagatgctgtggtttatttctagcatgataggacagaagagaagagaaatgtgtggaggaggaccaggcaaattaaggaaaaggtgggaggtgcacagcagagaagccggaggggctcagcagggcagcaagaggcttacaaagatggaaagggttctccgtcttcctaaggggccaaggccagggaaaaaagtgggccggagggtgacctgagcaggaaaggttggcagggagaatgcgggggaaggtgtgggcttctgcaagacatgccacctaagactgagatgacaaatggggagcaagtaatcatcaggagagatttcagtgggggcatgaggcaggcaagaaaggtatgtggaagctgtgggaaatgaggcaatagagcaggagagagggagcagaatccctgtggtgtgtctctgacagggaggaggaggaggggccaggcagggtctggtctccgctctgagcactgaggccacagcagcagcagaacagcaacaacgacaacaaaaaaccagagatatatcgttccagcactgtgcgcagaggagggaggctatctgggagatttcatttggactctcaaagattagaattttggagccaatgtcataggtcatgaggatgatgggaccaatatttgaaatcatgatgaccacactgtagacacagagggcagaaaaaccatacagtcccgatgcctgctgaggagaaaccagccccagatcctgctcctgctccatgaagcttagaatttttctcctgatcacacaccccatttatcacagctcaaactggaaagacctgttcaagcaatcaagtgcagggaatgaccaggtgaattgccatgtatcactctgctgctaggctaaccatctcacattagaactgcagaaaacacaaggaaagaagcagaggaatgtcctggcatttctcagtccactcactcctgctctcttttcctttttcttcctcaattcacctccatgccagtttccaaactggtcctcagtctcctctttcctacagacggatccagaggcagctacggattcatgccatctcgtgactactctctaagccttacccctctgagaggttctttgcactgtcactctgtcacttattcgtccatctaggacagggctcagcaaactacggcctgatggacaaatctggcctgccatctgtctttgtatgacttgcaagctaagaatggtttttacgttttttaaaatttttatttgttttgagacagagtctcactctgtcgcccaggctggagtgcagtggtatgatctcgactcactgcaacctctgccttccagattcaggcgattctcctacctctgcctcctgagtagctgggattacaggcgcgtgccaccacacctgggtgattgttctatttttagtagaggtgaggtttcaccatgttggccaagctggtttcaaactcctgacctcaggtgatccacccccttcggtctcccaaagtgctgggattatagaggtgagccaccatgcctggccagtttttatatttcttttaatggctgaaaaataatcaaaagaaaattgtgtgacacaggaaaggtatacaaaattcaaatttctgtatttcaaaacctaaagtactggtgtgaaaagcctaaaatactatttggcccttggcagaaaaagttggtggacatctgctctaggatatagtattctactctaaagtagaatttgggtcaaatgaaatatatttgaaaatatatatatatatatttttgagacagggtcttgctctgtcacccaggctggagtgcagtggcacaaacacagctcactgcagcctcaacctcctgggttcaagcaatcctcccacctcagcctcttgagcagctggggccacaatgccatgccaccatgcccagctaatttttgtattttttgtagagacagaattttgccatgttgcccaggctggtcttgaactcctggaatcaagcaatccgcccacctcagcctcccaaagtgctggaattacaggtgtgagccatcatacttggcctataattcattttaaagttaaaaaagaaaaagactgtttaagtaaacactctgtgatgtgtgtgaaatcagaacttaaatatggccattgacaagaatggccaaaacagctgttttctttctcaagcatgcaagctcataaataaagcaaagctagggccagtcccacttcttgataagattcctctgttggcagaggtcctagaaccacaaagggatcctccacacctgctccattcgcctcacccactcatgtttgccattggggcatggtgcttcctctcagtcacgcagagatgagccacaaagggagctgcaaagcagctcagcgcccttaactcctctttggagttttattttcaaacgacttcactgagttgaaaaatgagagactgactattactgggaccccagctgagcaaacagactcccaatttattctatgtctgaattctcctattcttccagtccttggtaaaaatgacatgccatgaagctgccaacaacaacaataaaagattaaataccaaactgcaatggctttagagaatgaacagaatccactgtcatctttcaaactcttggtccgtaaatattagtcaatgggatataggaaatagaggctgggcacggtggctcatgcctgtaatcccagcactttgagaggccgaggcaggatgattgcttgaggccaggagtttgagaccagcctgggcaacatactgagacccccccattgctacaaaacattttaaaaaattagcctggcatggtggtgcattatctgtagtcccaaatacttgggaggctgaatggagaggactgcttgagctcaggaggtggaggctgcagtgagccatgatcgcgccgctgcagtgagccatgatcgcgccactgcactgcagcctgggcaacagagtgagatgctgccttaaaaaaaaagaaaaaaaaaaagagagagagagacagaaaagaaaaagaaatagagttcttccagaaacaaaccaccaaacagataatctgtatttaatttcactccaggcaggaggcagataattcatttttaatggggtaatatgaattcatcaacatggacagattcatacacagaattacaaacacaacttgcacacatcctgtagatataaacagtcctttgcatactatgtccggggttggtgccacgttgcccctaggtgtccatcaacctgctcaggggccggcaacgccccctggtggctgccacaagaacagtttaattctaatttcacttcattaccttcacactcgccctaaaaagatttatgcacatgccaagttcccttttttccgttcccattggcaaggaacttcatcccatacatgctcttttatatgtgcattacaaaagtaacaacactccagaagtattagaaaacaaattcagctgtaatttctatcatcgtatcctaacaacaattatttacacaatactctgtgcttcacgctcctgtttgagaggatgtttgacccatcaggcttccctggcacatgaacaaaactcagacacagcctcagctagggggcaaagcagtgtcaacacgcaggcaccctgggcagtatcattccccgaagcccctcatacttaatgcagtcaagagagaaccctagattccactccacctagattccattccacaaccctaaaactactcaagtttcccccagtgcagcaaatggtgtcaccattcatctggatgctcaaggcaaaaactaggacttggccttgatggttctttttttctggttccccagacccacaccaccagcaagtcctgtcaactctacttcggaatagcccatatgtccactactctctccatctcgcccgccactccctgtttcttcacccagatctcacctgcgcctcctaaccagtctttccatttccactttgctgctgtgtcactgtccattcccaagagggcggctacggtgagctttgagaaatcaccttttttttttcttctccccgagacagagtcttgctctgtcgtgcaggctagagtgcagtggcgcaatctcagctcactgcaacctctgcctcctgggttcaagcaattctcccgcctcagcctcctgagtagctgggattacaggcacgcaccagcacacccggctaatttttgtatttttagtagagacggggtttcaccatgttggccaggctggtctcgaattcctgacgttgtgatctgcccgcctcagcctcccaaagtgctgggattacatacatgagtcaggaggtcaggaatttgagaccagcctggccaacatggcgagaccatgtctactaaaaatacaaaaattagccaggcatggtgatgcttgcctgtagtcccagctactcaggaggctgaggcaggagaatcacttgaacttgggaggcagaggtggcactgaaccgacactgcatcactgaactccagcctgggtgaaaagagtgagactccatctcaaaaaaaaaataaaaataaaactcccaacagcttcccaccacacacctaaaaactcccggccgggcacggaggctcatgcctgtaatcccagcactttgagaggccgaggtgggtggattacccgacatcaggagttcgagaccagcctggccaatgtggtgaaaccctatctctactaaaaatacaaaaattagccacgtgtagtggcatatgcccctcctaaggcggaggttgcagtgagctgagatcgcgccactgcactccaccctgggcaacagagtgagactctgtctcaaaaacaacaacaacaaacaaaaaaactccctcctatgacttacaaggtgttatgtgatctggccctccccaccgttttgcatatcactctctgcgtatttcacaatgagtcaaccagctgggattggagtgttggtttttcaaacactccaaagcattctgcctgaggaccttggacttggaaggtcttcccctgatctcctcacatctggctcctcactattcagatctcagtttaggggttacaactttacttactgattgtctattataccgtcctgtctcaattctgtgcatagcacttgtgactatatttttcttgattatttatttattatggttattgtctctctcccctaaaacataagttccagaagggagaaccttgttttcctattttttttttagagatagtatctcactttgtcacccaggctagagtgtagtggcatgaacacagctcactgcagctttgacctcctggtctcaaggaattctcctgccttggcctcccaagtagctgggactacaagctcatgccaccatgcccggctaatttttttaattttttgtggatatgaggtctcatcatgttgcccaggctggtctctaacttctgggctcaagtgatcctcccacctcccagagtgctggaattataggcatgagctaccacatggccagaaccttgtttttcatgtttagtgttgtttccttagggcatagaaagtacttggcacataggagatgctaaataatatttgttatttattgaacaaatgaacaagtagaatattaaaaatcaagagtatgatgataactttctaaaacttaaataaaagaaaaattgaagctgggtgtagtggctcacgcctgtaatcccagcactttgggaggctaaggagggtggatcacctgaggtcaggaggtgagaccagcctggcccacatggtgaaaccccatctctactaaaaatacaaaaaaaaaaaaatagctgggcatggtagtgggtgcctgtaaccccagctacttgggaggctgaggcatgagaattgcttgaagccaggaggtggtggttgcagtgagctgagatcgcaccactgcactccagcctgggcgacagagtgagactctctctcaaaaaacaacaacactcatgcctgtaatcccagcactttgggaggccaaggcaggcggatcacgaggtcaggagattgagaccatcctggctaacacggtgaaaccccatctctactaaaagtacaaaaacaaaattagccgggcgtggtggcgggcacctgtagtcccagttactcaggaggctgaggcgggagaatggcctgaacccgggaggcggagcttgcagtgagccgagatcgcaccactgcactccatcctgggcaacagagtgagactccatctcggaaaaagcaaacaaacaagcaacaacaacaacaaaccccactaaattctgtaattctgattttatgcaaatactgtctatgaagggtccacagaattacctaagcaacattaatttgttttcaccttttttatatggataatctcaaaaaaaagaaaaattgatactgaaaccacttcaacttgaaaaattaacaagccaaagtctcagcaaaacatatcccaggaattatattaatttttttgctatttattttccattctgaattaatatgtaagttccatgaacatggagattgtagttctagtgctttggacagaatctggcacatggtaaatgtttaataaatatttcttgaatgaatttcctttccagtctagacaataaaatccagtgagtttgatttcagacgagattgggtgcgttcagggtggtatggccataaaaagtttgatttcagataatgtgattataatgggaacttaataacaaatatactagaactttctatattaacacaagtcttcaccctttcaaaacaatcaccctggagacctgtatacttattccagtgttgccgaccttgttctaaagaggtgcttcaaaaacgtttcatacaaggtttgtgtgtcttttatctcatgaaggtaaaaacagaaacaaaccagaacaaatactaccatggctttcattggaaatcaaattttggtttaataaattgaatttccagtcatgagattttctgatatgtctggtaccccttctggtagttttatttagactcttgtagaaaatctttcacatgaaccagtcttaaattattccaatcacaaaagaaaaagtataatgctttcattacctgtaattatcctgtaactcataagtccttttgctggtttcaatggacaggcttcctcgttgggacagaaaaataggtagcagttgggttgtctagctgtttttcgagtgtcgaagatcatcaagttacatgctttgtcccctgcaatgaaaggtttcataagcatgattttgaaatgcgattttctaaagagtagggcaagtaggaaaaacttcacttattatggagtccaacacaaacacctttgttcattttgttcacttgcttgctgaccgctgaatcatttccttttccttagcttagttgcttaaggcaattttaaaaaacattgggtttagctttttttttttcacaaggtggcaccgaaggcgaagaaggaagctcctgtccctcctaaagtcaaagccaaagcaaagtctttaaaggccaagaaggcagggctgaaaggcatccacaaccacacacacacaaacacacacacacacacacacacacacacccctaagacctgcatgtcacttacctccagcagctcaagacactgtggctccagaggcagcccgagtatcccgggaagagtgctcccacatgtttgaccactctgccatcatcaagccctgactactgatgtgctatgaagatagaagacaaccacacactggtgttcactgtggatgccagggccggcaagcaccaaagaggctgtgaagaggctctctgacactgatgtggccaaggttacaccctgagcaggcctgatggagagaaagaggcatgcgctctgctggcccctgcccacaatgctttgcatgttgcctacaaaactgggattatttattttttttattttttattttttgagataatgtcttgctctgtcgctcaagctgaagtgcaaatgcagtggcatgatttcagctcactgcaacctccacctcccaggttcaagagatcctcccacttcagcctcccgagtaactgggactacagatgcaagccaccacactcggattttttttggtattttttgtagagatggagtctctctatattgcccaggctagtcttgaactcctgggctcaagctgtttgccctagttggcctctgaaagtgctgggattacaggtgtaagccactgcacctggccatctcttggattctgaaagcatctcagatgcctaataaagccatgagtggagtcagtaaattatcatagatatcatggctccttccacacaggatctgagtagtatatggaatacagtctatcttttaatttttatctgtaccattctttgtgtttttcttccaattacccctctctccttgtcatatttgcttttctatgttccttccttccttacttttcactgttaactataatttctggtctcttttcttttcttttttgagtcagggtcttgctctgtcatccaagctgcagtgcagtggaacaatcatggctcacttcagccttgacctcctgggctcaaacaatcctcccacctcagcctccccagtagctgggacttcaagcgtgcaccaccatgcctggctaattttttgttttttgtagaggcggggtctcactatgttgcctaggctgatcttgaactcttgggctcaagcaatccatccccctcaacctcccaaagtactgggattacaggcatgagctaatgcacccagctgctggcttctttttctgttcctcttgtgtccaacagaaattaaaccctctattcatcatggcctagatttgattttgtcctccatttggtacagtctcacatctttgggaggtcagcgtatccctggtcaggctgaaggttaagagacacataggctaattgttaaaaacatacgctctgtcgaccatcaccaccactggtgctagtcaggcaatggtgagagatcaactccaactcccgagatgggaaggaagatttagttagcctctgcaggagttttatcacgtcatatccccattactcagataataacaggagtactcctgcttttcctttctcaacaatgtgataccagaaatacctttctttttagcacttaggtaaaggggagggtccataagctcaaaattgtatgcaagatattgtgcccatcgtgttatgtgcatttttctagagtatcatcgagttatcatagtgccttttgaaccctcggtggttaaaccatttctcaggaagtgaggaaaatgtttgagatccattaactgaggttccaagtacctctgcttgtagcaaagcagtaataggactttggcttctagaataaaacagcaaaccctcgtttcttagaattgaggagcagggctttgctgatgcctgtaaataccacacttacagtattcagtcctgcttgcaggtgatgtttctatttcacatacatgttgatgtcaacatttaaagaaaaactagaaatttaaattaaacctctgtcatttccataaattacttgcataaagtgtcccaaagcacactgctcaatgagaccatcgaagggatttttcctcctgaccccaagtatacggtgtcttctccacaccattttgcagcaataaccacatatcctactattgagttcaattctgacaccaactatccagagctggcatcagattccatggattatgggctcggtatcacaagactgccctcatttcagaagccagtagcaagtatcaggtctccaggtcacccacacttctgcctgactcggctactgctaattcagggattcccatgatcctaccccctcagatttgataatttgcaagaacaactaatagaactaaggaaaatgctgtatttactattacagtttataataagggatacaaatgaacagccaaaagaggctcctagagtcccaagtgcaggagactttgtccctggggaactgaggtgcataattctcttgacactgggatgtgttcaccaacttggatgcttcccgatcatctaggggtttttatgatggtctcattttacacaagcatgattgattaagtcatgggccactgtgactgaactcaatctccagtccctcccctgaggtgaagcctcactagcacaaactcaagtatagttgaaaggggctggttatgaataaccaaagacatgctcccatctcttgggaaattccaaggtttttaggagttctgtgccaggaactggagacaaagatcaaatatgtatcttttgagacaaggtcttgctttgtcacccaggctggagtgcagtggttcgatcaaagctcactgtaggctgggtgcggtggctcacacactttgggaggccagcactttgggaggccaaggtgggaggatcatttgaagtcaggagttcaagactagcctgaccaacatggtgaaaccacgtctctattgaaaatagtaaaaattagctggatgtggtggcgaacacctgtaatctcagctacccgggaggctgaggcaggagaatcacttgaacctgggaggcagagaatgcagtgagccaagattgcgccactgcgctccgtccggcctgggcaacagagtgagacatcatcacagacaaacaaacaaaaaagtccactgcagcctcaaccccctaggatcaagtgatcctcccacctcagcctcccaatagctgggactacatgcgtgcaccagcacgcctggctgattttttactttttacagagaacagggtcttgctatgttgcccaggctgctctcaaactcctgggctcaagcaatcctcctgccttggcctctcaaagttctgggattacaggaatgattcaccacacccggccattcactagcttttctaggcaacttgatggcaaggccttgtccatcttattcactgttttctctctggcaactaacaaagtgttaagtactcaagaaatttagtttttttcatttagagaactcggacagggtcataagtaaaattgaaaaaaggttttactaaaatacacagtatacttctcttttcagtacaaatacttaaatcctaaaatatgcaagtcctggttcaaacctatgggtctcagtttcctcctgtgtcatgaaaatgggccagactaattgattccccatcccattagagttctagaagctgtagttacctagtagtcagtgtttttttgttttttttttttttttttttttttgacttatcctatgccaccagctccaaggaaggagacgaagtggaggttttatgcttccaacttaaagatcaaatgctgattttcccaagagataagaattctattttttgtctcaaccccttttctctgtttacattttctttgtaatatcacactgtattccaatactccatgctgatggcagctaaccatttcaataggatttttgttttcaatattctagataccagttgggatataacaccagtgattctcaacctcttgtctacccagtcacctgagggatatatacatacattcatcaataactttgactcagcttaggagaggggagggcacacttgtagaaaattctccagtgattttgtcacttatattcataccctgtcgagaatcactggtataagttattcagccacatcccccagctcctgaagccacaaaacacatggaacaaaggattgccaagaaaccactatttacctgatatgttttttgttgaacagcaagaattaatgcagtcttcttgagttgaagtatatacgggctcattgcctctgattcccttagaaagagatgactggatgtcaatgacaacatcttctagactctttttgaggcaattctgactagcagacagccttagtgtcaggaagcaaattattaccaaagtgtaagtcaagctcccttctcccccgaagaacattttaaatttcagtttagttttggtcttcaaaggtcaaggataatcctccctctggtcttagtttgctttaagaaggctgcacagatgatgagatttctctctagaacaaaaatggaaaatcatcaatgagttttgtttctttaacaaacaagggaagaaacatttcatttccttaaagtcaatgaaaaggatccacatacaatttagagaagaaaagatacacgtattttttgtttcacttttagtaaatttaagacaacttttcattaaacatttggcaaagaactaataagcataaacaaacatactacctcaccaatgcttaaaagctgacaatgcttatgaaggaacaggtataaacagtaggcctgcctcggaattctacaatccttccctcttctaactcagagcggagagggcacacatttctagtcactgatgaagcagtagtaataggtttgagcatatttcctttctcagtaataacaatcagcattttaaaatcatctactaggggctaggcgtggtagctcatgcctgtaatctcagcactttggaaggctgaggtgggtggattgcttgagctcaggagttcaaaaccagcctgggcaacatggtgaaaccctgtctctactaaaaatacaaaaaattagctgggtgtggtggcgcatgcctgtggtcccagcgacttgggaggctgaggtgggaggatcgctggagcccaggaagttgaggctgcagtgagccgtgattacaccactgcactccagcctgggtgacaaagcgagaccatgtctcaaaaaaaacttaaaaagtaaaaataggtgacaatatactagatggtagacattgtgctaaggaatttaccactcttttgaattgttattctctttaatttattaccatctttaatctttataccaactgtaatggctaatactgagtgtcaacttgatttgattaaaggatacaaagtattgattccgggtgtgtctgtgagcatgttgccaaaggagattaacatttgagtcagtgggctgggaaaggcagacccaccctgaatctgggtgggcacaaccaaatctgctgccagtgcagttagaatataagcaggcagaaaatgcgaaaaagagagactggcctggcctcccagcctatatctttttttttttttttgagacagagtattgctgtcgccaggctggagtgcagtggcacaatctcggctcactgtaacctccacctcttgggttcgagtgattcccctgcctcagccttccgagtagctgggactacagacgcatgccaccacgcccggctggttttttgtatttttagtagagacggggtttcactgtgttggccaggatgatctcgatctcctgaccatgatccgcctgcctcggcctcccaaagtgctgggattacaggtgtgagccaccacgcccagccccagcctatatctttctcttgagctggatgcttcctgccttcaaacatcagactccaagttcttcagttttgaaactccttgctcctcagcctgcagatggcctattgtggggccttgtgatcatgtgagttaatacttaataaactcccatatatatatatatatatatatatatatatatatatatatatatatatatattacactagttctgtccttctagagaaccctgactaatacaacaaccttgcaaaaaagctattattggccgggtgcggtggctcatgcctgtaatcccagcactttgggaggtcaagtcacgtgggcggatcacctgaggtcaggagttcgacaccagcctggccaatgtggtgaaaccccatctctattaaaaatacaaaaattagttgggtgtgatggcgggcagctgtaatcccagctactcgggaggttgaggcaggagaatcacttgaacccgggaagtggaggttgcagcaagccacgattgcaccactgcactccagcctgggtgacaagagcaaaactccgtctcaaaaaaaaaaaaaaaagctattattttcctcattttataatgaagaaactgagatagtctttcctattgctgcttctccttaagaagtatcaaatcagagttagaaaactctaataatctaattctagaaattagccagtcagcaggaggaatacgctgcctcagttaaaggaaagtttaggggcaggttttctttttgacagccttaaaaatacaaaagtcacactatgtataatgccaactctattgagatgctggttcttttaggaaaaataaatgttaaactggcaagacaatacaagaaattatcctcacctatcaacctccacatttccttttaacatttcattaaacattttgttgaatacaaattgtttgctgaatgatagcttagagcagaattactacttctttaacctttgtttattaacccctttgatagtctgaggaagctcaggatctcttttgtgagacatatttaaaaatgcataaaatggaatatgtaggattccaaaggaagccagttatagtgaaatataattaccaaaatagattttagaatgtccctacaaaatcctggtgaaagaaatcaaagaggagctaataaatagagagatataacatgttcatggataggaagactttattttgttaacatatcagtgcttcctggccaggcgccatggctcaagcctgtaatcccagcactttgggaggccgaggcaggcagatcatgaggtcaggagatcacaaccatcctggctaacacggtgaaaccccgtctctactaaaaatacaaaaagttagctgggcgtggtggcggccgcctgtagtcccagctactcgggaggctgaggcaggagaatggcatgaaccccaggcggagcttgcagcaagccgagattgcgccactgcactgcagcctgggcgacagagcgagactccgtctcaaaaaaaaaaaggtatcagtgcttcccaacttgagctacagattaaatacagtcttaatcaaaagcccaaagttattttttggatatcaaccaactgattttaaaatttacatggaaatgcagaaaagaccaagaacagtccagaatactaaagaacaaagttggaagactgatactacctgacttcaacacttaccgtaaagctacaataatcaaaaaagtatggtattagaaaaagaatagacaaacagatcaatggaatggaatagtaaacccagaaatagaccctcacaaagagagtcaactgatctttgacaaaggagcaaaggggattcaatggagaaaggacagtcttttccaaaaatggtactggaacaactggatatccatttgcaaaaatgaataaataaataaatctagccacatactttacacctttcacaaaatttagctctaaatggatcacagacctaaatgtaaaatataaaaccataaaatttctagaaaataacagaagaaaatccttgtgaccttagattaggtgatgagtttttaaatacaataccaaaagcacactccatgaaagaaaaatttgatgttggacttcattaaatttaaaaacttctgctctacaaaagataccgttaaagagaatgaaaagataaaccacagacttggaggaaatatttgaggtggtttttttttttttggaggaaatatttgtgaaacacacatctgataaagcagcagtccatagcctttctcgcaccagggaccagtttcatggaagacaatttttccatggacggcgttgtgggggtatggttcaggatgattcaagtgcattgtatttattgtgcactttatttctattattacattataatatataacgacataattatacaactcaacataatgtagaatcagtgggagccctgagcttgtcttcctgcaactagacagtaccatctgggggtgatgggagacagtgacagatcatcaggcattagattctcataaggagtgtgcagcctagatccctcacatgtgcagttcacaacagggttcgtgcgccgatgagaatctacggccaccactgatctgacaggaggtggagctcaggcagtaatgcataatgtaaatacagaggaagctttgctctctggcccactgctcacctcctgctgtgtggcccatttcctaataggtactggtctgcggcccaggggttggggaaccctgtgataaaggactggtatccaaaatatacaaagaactcaagtcagcaataagaaaagaaactcaatggacagaagatctgagcagacaccttatcaaagaagatatacagatgacaaataagcatatgaaaaggtatctaacatcatatgtcattaggggattgcaaattcaaacaagataccactacccacctatgagaatggctaaaatccaaaaaatggacaataccaaatacaaggacatggagcaacagaaattctcgcctgggcgcggtggctcacatctgtaatcccagcactttgggaggccaaggtgggcagatcacttgaggtcaggagtttgagatcagcctgaccaacatggtgaaaccccatctctactaaaaaaaaatacaaaaattagccagatatggtggcaggtgcctgtaatcccagctacttgggaggctgaggcagaagaatcgcttgaacccgggacgtggaggttgcagtgagccgagatcatgccactgcactccagcctgggcaacagagtgagaccctatctcaaaaaagaaaaaaaaaaaaggaaaaattctcattcattgctgttggggaatgcaaaatggtacagccactttgggagaagtttggcagtttcttaccaagctaaatgcagccttaccatacaattcagcaattgtcctcctatgtattcactcaaatgaattgaaaacttatgtccacacaaaaatctgcaatagaatatttgtagtagctttattcataattgccaaaaactaaaagcaaccaagatgcccatcaatagatgaataaacaaaatgagatacatccatacattggaatattactcagtaataaaaataaatgaactatcaagccacaaaaagacatggaggaatcttaactgcatattcctaagtcaaagaagccagtctgaacagatatgaatctaactgtatgacgttctaaaaaaggcaaactacagcggcagtaagaaggccagtggtcaccaggagaacaggagtgggaggatgaatcggtggagtgcaagggatatttggggcattgagactattctgtataacactgtaatggaggatacatgttattgaacatctgtcaaaacccatagaaatgtaaaacacacagagtgaacattatgtgaactatggacttttagttttaaaaaaaggtaaaaccaaaaaaaaaaaaaaacccagaaacaaaccagtatatggtaataaaacacaagtctaatacttttcttgctgtttgtcaaaattctgtatacagtaaaatagtaacatttattgcgtctaaaatgccagtttctatgctaagcactttatatatatcatgtcatttaatctttacagatcccattattatcctcattttagttaaaacttacaaaaagttgtgggacataatatgtgcttctttattaacctattaagtaacaagtggtcatctaataactgccataattttgacgtggtattgagtatagataatattttgaaacgtgcaacaagtcatgtgatataaagatatcggcaatatttacagggggcaaatcatagctactgctaatactactgtggcttttgcctacattccatttcagaagtcggtgaaataataattttttccactcaagttcacagacatcctgaattctatccatggataccttatcgtggactccccaggttaataattctggccaaggtacttaatacgctgccatattttgcaagcctctagggaatcaagagaaaaccaggccaatactttattttgaatggattctaatgtagcctcttttcaagcttttgcaaagaaacctgaactatgtaaggagatggggcaggagttgttttcagtatgcagcattgagagaagtgtttaagagttttatatcattaaagaggctcagcaatattaggttagcgacgttttctaatccattattatttaggctttaagggcctgaagtcgagttgaatcttgttgaaagacggggtaaaaggatacaggcgggtgagagaggatgcccctgagttttaacgtctgcatacaagagtcgctaaaacttactcgcacgtaattagttcaaatattggaaatcgtcttacagcacactataatttaccaagatgcttataactgtatacacacacacactctacagagaattagacaattagcagtttcaataatgaatacagagtcaacgacaagaaaacagggaacattttctcttcctttgaggaaatgcatgttgcctactgagctattcttctgcctctccttctgatgtcaacgcagagccagagccatttatggcaggtgccttgagcccgcctagaggtcccctttggaatactgcagcgactcaaggatcctggtcagcccttattggccccagctggtcctttggatgctcgggtgtgggtgaaggagcctcggcccctggaaaggaggggaccgactctctccgcaggtagcgacgtcgcctgcggccggtcgggggtgggtattggggagacccctttacctggcgtcgagaggaccccggcgcccctgctgccatccaggtgcgaggacagctctgtcgcgcccgcgggaaggaccggcgaatccgcgcgggggtctcggcgaggaccgcagcggatgctccgcagctcccgcaccggcctggcgggttttgtggttagcaagttcctgcttccgtcgcagcgacggcaagtttgccgcgggggaagggcacgttcctgccctgcaacccggagctgcttcccggcaacattagcgcgtccctccccgcggaggctccgggctcccggccccagcgctgagccccgcagggaggtggctccccccaccgccccgcgctcccccccagctcagccacaccgctgaccccgggctgggcgcgctgcgagggggagtgcgtgcctccctgctggtggcccgagggtctgcaggtgagccttgcctcgcggcccgcgcaagttaaaataaatgcacatggggaaaatgtcaaacagtacaaaaatagacacagagacaagtctacccctcacccccgtgccccagtctcctagtctccctcctcagaggcaaccactgagagcagttttttgatgttcaagggcttatagtgcatcctattgggggcatagttctgagaatcctctttccataattggaggatggagtcctcaattaaagatggcaattcttgagttaaatattatctgcaagacaaacttcagggaaggtatttggctttctgcgggatttattgtttgtagataggataataatggtgaaaatgctggtgtctgtaacatatattaaaactgtatccctaacacttagcatagtgcctggtacacaataggtgctcagtaaatatttaactaaaatatttttgttgactgaatgaatggaaaagaactgcatagggcataggttgtggaagtttctaaattactgctggccccatccccacctccataaacacacacacaaatgcaacgttactaaaccattgacacttagtttgccatatggtctaacctttgacagtatcttcacctctgttttgaaagagcttgcagacctgaagcgctatgcaattgcaagttaagtctaggcctgtacggccaacagctacacaccctagtcttaaccaataactacaggaggattaggttgactgagaatgcttgtgaacaaaggtccattgtgtgaaactaactctacttgtaaccaaaggatgactcttgaattacaatgttgctaaagctaggtttgaaagagttaccaaagaaaagtaaacaccagagtaatttcccattgcagtgattttcctgatgcaacaagggactgatctgcaagtgtgttttatcttttatcatctgatacacttcagggttcagggtgtagagctatcacagtttttgaatctctctacatggggtaatccatgctagttacaaagtagacctttccattattagaaacttcgtattcggtgctttaatacaatgaacctgtttctttttttgttttgttttgtgttttgtttgtttttagagacggagtctcgctgtgttgcccaggctggagtgcagtggtgtgatctcggctcactgcaacctccacctcccgggttatagcaattcttttgcctcagactcctgagtagctgggactacaggcacatgccgccacgcccagctaatttttttctattttagtagagatggggtttcaccgtgttgcccaggctggtctcgaactcctgagctcaggcaatccgcccgcctcggcgtcccaaagtgctaggattacaggcgtgagccactgtgcccggcctgaacctgttttcattgaagtgatatgttattttttcagttatgacagtgaacaaaggatattgattaaaataatgattaaagaaatattttctattatatatgtttaatttataaatatcattgtttatttattcatttttttagacagggtctcgctctgttgcccacactggagtgcaatggcacaatcacgactcactgcagctttgaccacctgggctcaagtgattcttttgcctcagtctcttgagtagctgggaccacaaacgcacaccacacccagctaatgttcttaattttttttttttttttaattttgagatggagtctcgctctgttgcccaggctggagtgcagtggcacgatctcagctcactgcaacttctgcctcccaggttcaagcaattctcctgcttcagtctcctgagtagctgagattacaggctcatgccaccatgcccagctaatttttgtatttttagtagagtcggggtttcaccatgttggtcaggctggtcttgaactcctgacatcaagtgatctgcccaccttggcctcccaaagtgctgggattataggcgtgacccaccgtacccggtgttttaaattatttgtatagatgaggtcttgctacattgcccaggctagtctcaaactcctgggctcaagcaatcctcctgctttggcctcccaaagtgctgggattacaggtgtgagccactgcacttggcttacttaaaaataaaataaaaactttaatttctggcctgagtcataacttagaaattatatccattgtcacttcatttcctgaagagattcttgacactcttctctgagggttagaagtcccatctatgtggagaaagatttctttaaaagtaatcggaaaacatgtattaagcagccaggcgcagtggctcacgcctgtaatcccagcactttgggaggccgaggcgggtggatcacgaggtcaggagatcgagaccatcctggctaacatggtgaaaccctgtctctaataaaaatacaaaaaattagctgggtatggtggcgcgcgcctgtagtcccagctattggggaggctgaggcagaagaatggtgtgaacccaggaggtggagcttgtagtgagccgagatcgagccactgcactccagcctgggtgaaagagtgagactctgtctcaaaaaacaaacaaacaaacaaacaaacaaacaaaaaaaaaaacatgtattaagcacctgcaggggaaactaaagaccagtaataccaatgagatctacctttaagatgttcatagttcagaaggagaaaaagtaaatcaatggctgtgtaaacagttaagtgtgatgaaggccaggtgtagtggctcatgcctgtaattccagtgctttgggaagccaaggcaggaggatcacttaagcccaggagtttgaggccagcctgagcagcatagcaagactccatctctacaaaaaataaaaattagcatggtgtggtggtacacgtctgtagtttcagctacttgggaggctgagacaggaggatctcctaagagcctaggaggctcttaggaggctgtagtgagccatgatagcatcactgcactccagcctgggcaacagagtgagaccctgtccctgccctccccaagaaaagaataaatgttatgatagaagatggcaactaaaaaggctcagagaagggacatctgatcccaatttctgggaagaggtgttaattattgaagaatgaagttattagcagatgaggaggaaaaggctgaatatttcaggaataggaaactgcatgaccacaggaaattcagcctgttaggaaggttaccagtgtacacagaagaatagagagagaggctggggtcagagcaggaaggttttcatatgttaaatcttaaactttatcctaaaggcatggggagttcctgaaggctttttgtagggcagtgacaggtccagagacctaattaatattctagaaaattatctctacctgccacaggagggatggattgagggacgtgaggccagaggcctctcttccaagaaacggaagtgataaggccctgaaatgggcatgcagatagaggagaaattaagaggagaggctctccaggacacaacgattggttggatgcagtgctgacagtaagcaggcttctggcttgggagcctggttgggtgggagtaccaggtcatataaagacacgggaagaggagtcagtctggagtggacagaggcatgatgagttttgaaaacgtgaatcctggttttatcactcactagttgtgtgaccaagaataaatcacttaacttttctgtaaaattaggaaagtggtatctactttacacgcaggtcataatatagacctttttatgcaggtctaacatatagacctgcagacctgtaaactcaaaaaggctgttcaattgctagttattacatatacaataacacagtttgctgctcatgtagaagggattttaaaggtgctaaaagacatcaatctgaaatgtttcctagctataaagctcttccagcagactccttatgttatataaatgctcatttaattttcttgccaccagactgtaagcttcctaagtacagggattgggccttgttgaattttttatttttaacgtgtagcaagtgcctagaacatttcaggttcccaagaaatgttaagccagtgaaggaaggaattttatcttcatatgttcttttactgaatatagctttatggatatggaatttgtataccatacaatttaccctggtaaagtgtactctacagtggtttttaatatattcagagttgtgcattcatcattacaattttagaacattttcatcaaccccagaaagaaaccccatacccaataatagtctacatttcccttccacccgtacccctcctcggccttaggcaacactaacatatttctctctctgtagtgcttctcctggacatttcatataaatgaaatctacaatatgtggtcttttgtgatacgctttgttttttttttttttgagacggagtcttcgctctgtcgcccaggctggagtgcagtggtgcgatctctgctcactgcaagctccgccttctgggttcaagcgattctcctgcctcagcctcctgagtagctggaaatacaggcgcccgccaccacgcccggctaattttttttgtatttttagtagagacaggatttcagtttgtcagccaggatggtctcaatctcctgaccccgtgatccgcccgcctcggcctcccaaagtgctgggattacaggcgtgagccaccgcacccggcctgacaggcctttttcatattgaataatgttgtcaaggttactctatgttgtagcatgtatcagtatgatttcatccttccctcattttggctgaataaatattccatgattaccacactttatttatccattcatcagttgatgcgacagactatccttttaagaatgaaatgtttattcaaaaggaagcataaaaaacaccatcacatcagtatggactggtgtatggaacacaagacaaatatacttttatgtggaaaaggggaaacaagaaccagaatgagttattctccattcctcaccccttttacctcctctctcaccttcccctcaaagaggaaatctgggaggggatgcaaggactctccaaaagggaatggtctcactgcttagtgggcccttcccagtcccatcagcctggtgtggtttatgtaaacctcaagactagttagacacaactttctagaagcctgccctgatctctcaggcagtttttagttctatcttcatattcccagagaacactgtacttagattcatttgcatttttctcattgtattgcaatggtgagcagaggaaagagcatcagatagtcctaaatagttcgaccactgaccacctgctgaccatggaggagtcacctacttacaggctgcagggttgttgtgaaaattaaataaggtaaaataggggaaattattgtgatatagtagagtggaagggacttaaaaatcatttagtcaacttgacacttcttctgagacttttttttttttttttttttttgagacggagtctcgctctgtcgcccaggctggagtgcagtggcgcgatctcggctcactgcaagctctgcctcccgggttcacaccattctcctgtctcagcctcccgagtagctgggactacaggcgcccaccatcatgcccggctaattttttgtattttttagtagagacggggtttcaccatgttagccaggatggtcttgatctcctgacatcgtgatctactcgcctcagcctcccaaagtgctgggattacaggcgtgagccaccccgcctggccagagactacattttatacatataaaatctcaaggcatttacttgaaatttcttgacgcagacaatgtaatataaaatgagttgcaaagttcggagaacgctagagccagctaactccttgatggcattgcattgctaggtctactttcttgccctagcaaaaatggcagtttcctttctggattactccctcctcaccttctgttagtttcagagtgacttgttgataactgccaaggtccccagaaagcgcctagccaaaaaggttcttcacttctctttaaagatgtgcactccctaatacatgaaacagcattttctatttcttaatttttctctcatttccagctgctgctttcaccgtcttctggtatttttttgtttggtcgtccactgctaaactcccagctcttcagaattcaaaatgagctttgcatccaagctgttgtgggttcgaatcctgggtctatctagcgtttctttctccatctgtaaaacagggttaaaaatacctattttgtaaagttgttctcacatgtgggtattgaagagcttaatagtgtgggtggtgttttaaaggtgacgcatccttacaacaggaaagggcttaccctcttccgcagttctggcttcgaggaggtcaagccctttaaggtggcatcgccctaagtcgcaggagcgggtctctccgcccctccctcgggccggggggcggggcctcctaatccggaactgaaggtcttgcgtagccggcaccgcccatctgcgtcccggaaggagcgagcttgcggagcgtgaaccagtgagtgaaagcggcgccgcccgccggccgcaggtgcggcaaagccagtgtcatctgccggttctcttagggctcccggaaagaaggagggctagccgcgtgcgttcgcgccgcgcctccttgcgtttctgttccccaaatagggcctctccttctcccgccgcccaggcccctgcgtgggctggacgcgtcagccccacacattagcctcgctgcggcgcccagactctgctttgcctccccgtcccggtccctggcccctgccctgtcgcccgccgccggagcggtgaccgcccggcccgccgttcttctgctgccaccgctgtcggcaccatgggcagtgagcagagctccgaggccgagagccgacccaacgatctgaactcctcaggtcggtgtcctaacctcccaccctcctccagcccgccctgtccccttgcagagcgggctgcctcccagactagggtcagggactgcggacgggaacgcacagaaaaagccttcaccgtgctagtaggaaaaaaaaaaagtcaccatctgtcctggcctcgattcccctgatggaagtgcgtgtgactgcaagctaagccagcgtgggcgccagtgcccttatttattttcaaaacagccgtttctcccagctacagcctcctgtttaaaagacgagctaattaatttttggctctagtgctcatggctgatgtagtgagatttggctcacacagtggatggattataggacctctaagaacagtctgtttcttaaaaacgggtgttagaggttccttttctgaagggatatgtgataggtgtccacttgctttgaaccctttagtgcaaaggtctccagaaacagctttttcttctcagaaggtgtcttggtccgttttctaatcttgtagaggttggccagacagcaggcactggtgttttccattgttgttctctgtccatgatttttagacttctctaagcgtttgagacaagaatgggaggattattgtgtttgcaatacagtgagtgttcaataaatagataaagcagctgatgtttaattgaggaccatttgctgctttttttgttacccacacgctaggacagctgggagtgctttggttaagctccggggttgctaacgcaaattggttaaatctggggcctaaaaagagtcgccgattttagaagttctctgttcttgataggagctgtaattcagaaataggcaagctaatagatctaagggtgtttcactttaaggtgtgactttcaagactagttcagacctacattctggggactggattggggcagctttgaatggtgagcagcatctactagctttgctacgtttttctatttccttggaagggccagagtgtcatatctgttataagaaatataataattgccacctttgacattcttgcctctatggcagggcagaaacatattttagggggaagcggtgtggcatctttttaatttgttttcttgcccatgaaccaacagcattcgagcatttccgatgttagaatttgcctattcccctgtgcccggtactttacatacatttacatataatttttgcagtaatcccattttacagataaagtagtagaggttagctagagtgttttgaagtcccctttcctctggtatctggggaaggaggaatcacaatttatagcaggaaagatttctggcatggcttttgtaaaatgttaggtaaattaccaaaacaggtaaataaatatttcttgaaaagaaataaaagcagcagagatttttctagaagagtgaatgccaagcctccggagacgagcttctaggaggcagaacagttctatggcatccctggattaacctttgagatatgactataatgagcctgggaatattaccttctagagcataaaacactttaaagattcattcttgtcccagtctggaagatatttgggggagaggatgatttcttggtctagggagtcctttataatttgaatcacttccctccaaatggattactttctcccaaggaacctgaattgatctccctctttgtcctccaaatttctgatttttgcctcagcctagaatggacttactggctatttttgccctggactaatgctataattttaagagtgagggggctgtagtcctagctactcaggcccaggtgggaggattgctggagcccaggagtttaaatccagcctgggcgatgtagtgagacttgactctttttttttttttttttttgagacagtctcactgtcacctaggctggagtgctgtggcatgatcttggctcactgcaacctccgcctcccggattcaagcaattttcctgcctcagcctcccaagtagctgggattacagggacatgccaccacgcctggataatttttgtatttttagtagagatagggtttcaccatgttggccaggctgatctcgaactcctgacctcaagtgatccacctggcttggcctcccaaagtgctgggattacaggcgtgagccaccgtgcccagccgccttgacttaaaaaaaaaaaaaaaagagtgaggaggctgaagcctcgggaataggccagtcattcgggggttgagaacaggtttttttcctggacttactaaacatagctggcttgatgtggtagggtggatagacagctttgcaactccagtgtcgcagagatgggccttgtgtaccaataacttgtagatgtctaattcctttcctaactgtctagcactgctgactttgggcaagtcacagttaaattttgtaccctttatttctcattttagaaatagggagatatatatatatatctcaagatagcaggagaattaaagagaaagtaaaaacaatctgcctatacttttgtgtgctgaaaaagaaaatatttagttatgaaagaagttcattcatgttatataatcctgtaatgggctgggcgtgatggctcacacccgtaattctagcactttgggaggccgaggtgggtggatcacgaggtcaggagttcgagaccagcctggccaatatggtgaaaccccatctctactaaaaatacaaaaattagccagatgtggtggtgcatgcctgttgtcctagctactcaggaagctgaggcaagagaattacttgaacccaggaggcggaggttgcagtgagccgagattgcaccactgtactccaacctggcgacagagcgaggctctgcctcaaaataaaataaaatcctgtaatgtctgagggtttttgttgttgttgttgttttgttttttgagactcttgctgtcttacccatgcagtggtgtgatcatggctcactgtggtcttgacctcctgggctcaagtgatcctcccatctcagcttcctgagtagctgggactacagtgtgcaccaccacatctgactaattaaaagaaattttttttttttttttttttttttttagagatagggtctcactatgttgcccaggttggtcttgaactcctggactctggtgatcctcccactcagcctttcaaagtgctgagattacaggcatgagccaccacacccagcctgaggtggcgtttttgtttgtttgtttttgagacagagtctcactctgttgcccaggctcaagtgcagtggcacgatcttggcacaccgcaacctccgcctctcgggctcaagtgattctcctgcctcagcctcctgagtagctgggattacaggcacccgccaccatgccccgctaatttttgtgtttttagtagagacagggtttcgccatgttggccaggctggtcttgaactgctgacctcaggtgatctgcccacctcggcttcccaaagtgctaagattacatgcatgagccaccgtgcctggctccagcctgagcttttaaaaatactatagaaaacagtttctataattcatccctgccaccccaaccccaactgcaagatagctacattttataaaattattctttttaatcactacaccaaaaactgctttggtgaggcagagatgcctaatatgcatctcctaagcagtgtaactttattttcagtgactccttcaccagccaagcatagagccaagatggatgatattgtggttgtagctcagggctcccaggcctcacggaacgtcagcaacgatcccgatgtcatcaagttgcaagagattccaaccttccagccccttttgaaaggtaaaggattgcgttttgttttatctgaacttgctggagacgtttgtgtagccctactactttccctctacttatccatgtatcttgctctctcatctcctttaggtctttgcttaaatggcatcttctcagtgaagcctttcttgatttccttaattaaaactgcagcccctttgcctacctgtttttctctatagcacttaattatcattgacctattgcaaatatctttatctgtctatatttctctgctagaatgtgagctccatgatggcaggtattttctcttttgctcactgttgaattcccagcacgtgaaatataatctggtataagatagggactaagtgaatgaatgaggttggaaatggcccttccctgttatattcccatggaaagattttcattcttatttgtgatctggacagtgggtggactagttcagatccatagagaaaaatctccatcactactgatacactcgtaattaatcctggcggcagttttatatgagagtgtgtgtttgagaagagagattacccacccaattagcatatactgtggtagttaccttttgaacgaaggccacaactttattatttttgtatctctattaagtagtggagattattttatattaactggtgtttctgctgtaagagtccttcagttctctcctccctcacccccaccaaagattaggaaataatgaacataaggccctggtttacttaacttggtataatacagtgtaaaacatcttacatttacatagctatttgaattaaaatgcccctcctcatacacatatcatccctttaattcttacatcattaaatgtgtttcaatgattggggtaagataagcttcttataagccttttataaggcagctggcatacacagaggttgtacttgaaccttcttcattgatgtcaaatcctatattacactgttccacactatttagaaaacaaaaacaaatggtgctttatagatgatccatatattgtcttattcttaccagtgcttcatctgtttcataaataaggaaatacaagctttcagtttcttttttattattatttaagttttagtgtacatgtgcacaacatgcaggtttgttacatatgtatacatatgctatgttggtgtgctgcacccattaactcgtcattcacattaggtatatctcctaatcaatttcttccctacaggcctgagagttagactttggtaaacattctggctcttatgtaaaacaacacattatatcatgttactcatcttttttttttttttttttttttttttagagttttgctctgtcacccaggctggagtgcaatggcttgatcttggcttactgcaacctccacctcccaggttcaagtgattctcctgcctcagcctcctgaagtagctgtgattacagatgcctgccaccacgccaagctaaatgtttttattattattatttttagttgagatggggtttcaccatgttggccaggctggtctcgaactcctgacctcaggtgatccacccacctcggcctcccaaagtgctgggattacaggcgtgaggcaccttgcatggcctactcatcttcttagttttcatgattttgaggaataatgtgattctctaaagaagttaacaatagtagggcatggtggctcacacctgtaattccagcactttgggtggctgaggcaggaggatcacttgagtccaacagttcaagaccagcctgggcaacacaatgagactctgtctcaacagataatacaaaaaattagccaggcatggtggcacatacctgtcgtcccagctagttgggaagctgttgtagaaggatcgcttgagcccaggaggtcaagggtgcagtgagcagtagtcatgtcagtacacttcagcctaggtgacagagtgagatcctgcctcaaaagaaaaaaaaaaaaagccggccaggcgctgcggctcatgcctataatcccagcactttgggaggccgaggtgggtggatcacctgaggttaggagatcaataccagcctggccaacatggtgaaaccccatttctactaaaaatacaaaaaattaggccgggcgcagtggcttacgcctgtaaaacagcactttgggaggccaaggcgggtggatcatgaggtcaggagatcgagaccatcctggctaacacggtgaaaccctgtctctactgaaagtacaaaaaaaattagccgggtgtggtggcgggtgcctgtagtcccagctacttgggagggtgaggtaggagaatggcatgaacctgggaggcagagcttgcattgagccaagattgtgccactgcactccagcctgggtgacagagcaagactccatctcaaaaaaaaaaaattagctgggtgtggtggtgtgcacctgtaaacccagctactcaggaggctgaggcaggagaattgctagaaccaggagatggaggttgcagtgagctgagactaccacttcattccagcttgggcaacaacagtgaaactccatctcagaaaaaaaaaaaatatctgcatataactttcaacttagccaaaacttaactactaatagccttctgtttactagaggccttactgatagcataaacagttgattaacacatcttttgtgttatatgttattatatactatattattacaataaagtaaactagagaaaagaaaatgtattaagaaaattataaggaaggccaggcacagtggctcatgcctgtaatcctagtactttgggaggccgaggaggatggatcacttcaggtcaggaattcgagatcagcctggccaccatggtgacaccccatctctactaaaaatacaaaaattagttgggtgtggtggcgtgcagctgtagtcccagctacttgggaggctgaggcacaagaatcgcttgaacccgggaggcagaggttgcagtgagccaagatcatgccactgcactccagcctgggtgacagagtgagacttggtctcaaagaaaaatataaggaagagaaagtatattaactattcattaagtggaagtagatcatcagaaagatcttcatcattgtcttcacgttgagtaggccgagaaggaggaaaaggaggggttagttttgctgtcttaggggtggcagaggcagaagaaaatctacgtataagtggacccacgtggttcagacccatgttgttgttcaagggtcagctgtaattcgttttatgattaatcactagtaggggaaatatctagaagacttggtgttaagggaagctaacctcagatttgaagtcatcactgagggctggccatggtggctcacgcctgtaatcctagcactttggaaggccaaggcggttggatcacctgagcacaggagtttgagactagcctggccaacatggcaaaaccctgtctctacaaaagatacaaaacttagccgggcatggtggtgggcacctgtagttccagctactcaggaggctgaggtgggagtatcacttgagccctagaggtggaggttgcagtgagccaagattgcatcactgcactccaatctgggcaacagagcaagactctgtctcaaaataaataaatcatcactgagtgccctgaaagtgaataattaatgtgatgcagttaatgcaatgcaactggacctggttgcattgataaatgagttttaactgggactttgccaccaactattatgttgtctggctttgtttttccacctttttgagccttggttattaagaacattgagaataggtgaggaaggaggaaggctagtaaggagcagattataggaagaggttatcggggatttggttaaggaaggtagagatgagatcatggctcactccagcctccacctcctgggctcaagcgatccacccatctcagcttccagagtagctgggactacagtgtgcaccaccacacccggctaattaaaatacatttttttttttttttgtagagacagggtttcactatgttgcccatgttggtcttgagctcctggactccagtgctcctcccaccttagcctcccaaagtgctgagactacaggcatgagccaccatgcccggcccgagtttcaaaaaatactatagaaaatagtttgtataattcatcccccccaccccaacccccacttgatgagagtggcgtgaatctagaaatgacaacatgtggctgtggccagactatagcaaacaaaaagccagtgagcattgaaggtgatgctcatgtttcacttgtgaagacgaaacatcttgggccgtgattaggaaagataggcaaagggggtggaaatgataagtttaattatgataatagtatcttatcccccatgcttctacataatagctattgttctttctgtttttatagattaaaatattgaggcctagagagcttaaattaattgcctaaagtcacatggctgtaagtgatagcacattttaagattgcatcaggacatagaataagacttagtttccaattctagcaaagcccattatagaaatcactaggatatacaggaactagcgtggtgggtatgaggttgtttgggttttgaggtgcagcatttgttgcagagcctcctgctttgacgttgttctgcctgataattaaaagccctaccctctgcctgctgggctgctgcaggggccaggcatcactgtcgcctttatactctgactcttttttccccctttcctgctttcaggatgaggccattcctcaaaatagtaaaaaggccacacagtgaagcctgtaccccccaggtttgatttcagaaagcttttattcaacttaatgacagtttattctttcaaaacaatatattgaagtattacacagagttcactattgtttcataatgtcatatgatgtaatgctaatgctggtgggtgatctgcagaggcagtggctgggcgagtttggggctatttgtatgactgaggtaatgtttgcatttttaataagcaagcagattctttctttggccttaacccttttgcataaatataccagagtataatttatgctccataatccaaatatctgttcctttttttatcaaagggatttctgtttttcatagcaatgtctgaattagtaatttattttgacatgtaaagcattttataggaaatgaaagattagaaaattagaaagtagctacaaatggctgtgacagaacacaaaggcaaaatagtagatttgatgtaagttagcaagattccaagaagttaacaaaccctgtatagatttcttacttgaaattcaaccactcatattttttaatgaatcccactctattgtatgtcattctaaagaaatgaaatatttgcaagagaaaagtaatatggttggtgttttatatataaagttacaaaaataattattcactcttagtagatgaatatgtgcatatttacacacatgcatgcatgtgacattctttccaaccgatctgtcatttttgttactgaccttggatacaacgtaagagattgtattgctgcctatggaaggggctgtttttgttaataacaaggatgatcaaacatatacagtgtagatactgaagtgatactaagcagctttgttgggagtttggtgtttggttgttaagaacatgatgcatgtgaagtagattttgataattaaaaggagcctggggcttttcatagtggagcgaaatctcatggaacagcagtgaaagctttcaaatcacatggaacattgagaactggaacctgaaagtgtagctagggaagaatgaagcaatggaaaaagggcgataaggagagcatgatggagctagatttcaaatgaccagtttcttcacattcttctgtcatctggacaaataaaagtctttgcattcatcagatgtctgcctctaccagctgtcagaccttatcattgcattggaaaatggcagccaaaggaggggacaagagaatggatcttaatcagagccacagtcttctctgaatggcttaaaggtaatctctaaacccaggggtaatcctaagtatattttctcccaaataccatattggaaagattgatgacttattcctgattactttatgggtttgtatttgtaatagctcttcagttaagcttttaaacatggctattcagagaagtgtgagttgtgtgtaaaaacaaaaacaaaaataaacatagctgtttaccagcattgggttagccttactcagaagagtgggaagtaccaggtgaatggttgctttcaaccgattgagaaagtgaagctgtctcaccagaacaccctcatcttttcccttactcccataaatctctgtgtgcctgcatccattcttgtttctttccattaagtctcagatgaggtattcatgcctttctctgaaacttaatgccattctgtttcactctttccatttgctgggactttgctcctgtccttttctctttttgtctcgcaactagcttagtggacctctttcctcttgttcagatatacagctcttcccatcttaaaaacagaagacgaacactttctttcaattcagttgccctcttggctaccacgctttctctgttctcatttctgctgccaaacttactgactccatgggtgctacatgctgtccctgcttccttgatacctctgccatttgggaagttcccctggacaggctctcatatacataacttcatccatatttgctgctttggaggattactagtgttttcttttcatgcttgaagtttttttctcagtccacatcctcctcttcttttccgtatttaacataggtttctatcccacttgttaaaactcccttcctttagtttatgatacctccccacccagtggtattctgttttgtttttttttttttaatctactggttagtctctattcctctctgcacagcattttgcctagtgctcttttggaaaaacaagattctaaggcgctttaagtattctgaaatgtagccattaagatgattttaagtctctgtcatcaacttcaacttttttttcttttccttcttcttttttttgagatggggtcttgatctgtcatccaggctggagtgcagtggcacaatcatagctcactgcagccttgacctcccgggcacaaatgatcttccaacctcagcctcccaaggagctgggaccacagatgtaccacacctggctaattttttttttttttttaatttagagatggggtgtcactctgttgtccaagctggtctcaagccctgggctcaagcagacctcccatcctggcctcccagagcactgagattacaggtgtgacccactgcacctggccagcttcaactccttgttctgtttgtccatcatcttgctctgtttgtctatacagtcgctttaaattcagcgtattccatcttccacttgtgtattatgtatttattcattttatttattcaacaaacactggatcttcttaggcaagtagtgtacacttgaaaagaatgtgttctgtagttaatgggtatagtgttctataaatatcacttaggtcaagaaatggtgatgttcaaatcttgtgtgtgcatattgatttatttcattaatttgatcacttaatgaaagagaggtattcaaatatccagctatttttgttaatttgtctattctggttattccattggtttctactttgtgtgttttgaaagtctattattaggcatatatgcattaaatattattatattgatccttccgtctttatgaaaatgtgctacctatgtgttattacccctgtcttgtagtctaatttgttttctatcaatatagccactccagctttcttacacttactatttgcatagtataccttttactattctttacttatttttatcgatttatgtctttatatttaaagggcatctcttgtagacagcatatagtagggtcttgcttttgtatttaggctatcgtctgctttttaattggtgtgtaaattgatatggttggatttaggtctcccattttgctcttcattttctatttgtgctgtgtgcttttggttactttcatactcctttcctgcttccttgcattacaaaaatttttttttagtatgtattccattttagtttcttttctggctctttaagttatactcctttgcattatttttttagtggttgctctagaggttacaatatagtcttgatatttattatagttcatttagaattactattgtatcacttcatgtaaaatgtaggaaactttcaatggtgtggtttcattcaccccccacttcttttttttttttttttttttttttttttttgagaaaaagtcttgctctgtggcccaggagggagtgcactggcacaatctcagctcactacaacctctgcctctccagttcaagtgattcttgtgcctcagcctcccgagtagctgggactacaggtgtgcgtcaccatgcctgtctaatttttttatttttagtagagatggggtgtcaccatgttggtcaggctggtctcgaactcctgacctcagttgatctgcctgcctcagcctcccaaaatgctggaattacaggcatgagccaccacgcccggcccaccttcacttctttgtgctattgctttcatatatattgcatctacatacgttagaaatcccatagtggttttatacacacacacacacacacacacacacacacacacacgtttttgttttaataatatattttttgaagtgattaagagaagaaaataactatatatagaatgtgatgtttacccacatagttaacatttccagaattcctaatccctttctccagtttccatttgatgtcatttatttttagtttaaaggacttcttttagcatatcttgcagtacaggtcagctggaaaaaagtcctgtttttatctatctgaacttttttttgcccacttttgttataaagtcattttttggtgtaattactaagtttttgaagacatattgtgagactccatgaaatctcattttttaatctacctttatttcatcagttataatatctattgatgattcttgcttgaattaattatgctgtgatggctaccaaataactgttttctaaatttttcattccttctacatttattagtttatattctattggaaggaataggtttctcatctccccatttatttattcaaatcagtgcgggaacagtcagctcctattttatccaatgagttgtatgtaatctgttattatcattatttctttttcaatctcaaaatgttccaaaattggccagtgacagcatcttcaatctaacttcctgtgtccttttttttttggagatggagtctcgctctgtggcccaggctggagtgcagtggtgcgatcttggctcactgcaagctctgcctcctgggttcacgccattctcctgcctcagcctgccgagtagctgggactacaggcgcccaccatcatgcccagctaatttttctgtatttttagcagagacgggatttcactgtgttagccagggtggtctcgatctcctgaccttgtgatccgcccacctcggcctcccaaagtgctgggattacaggcgtgagccactgcgcctggcctactgtgtccttttaacatattccccttatactttgaaaatgtctttattttctggcacaatataatgttccagacttattttgttcttccatgtctccagctctagaatcgggtatttcttaaaggaaccctggttcttttagtgaagggtcttatttagaatccatttctggaccttctcagaagatttagctagggaatccatagatacacacccacacatttacacctatgtttattttttatatgttcgtgtatttggcaacacgatcttgccctttcaccctggctggagtgcagtggcacaatcacggctcactgcagctttgacctcctgggctcaaggaatcctcctacctcagcctcctgagcagctgggactactctgcgtgccaccacgcccaactaatctttttgtattttttgtagagatggggtttcccaatgttgcctaggctagtctcaaactcctgggcacaagcgatccacctgcctcagcctcccaaagtgctgggattgcaggcatgagccaccatgcctggcctatattttctatatattgaaaatgacaagttcacactaatatgttctctatgttctttgatctgcaggtttgtacttttaatcgaaaactttggtcattatgtcttccaatatttttctgctccccccacctgctttttgtgggacgccaattcgatgttagaccgcttgatattttcttacacatcactgacacacctttcaatttttatttttagtcttttcctttctgtccttactttggataatttttactgctgtgtttccatgttcagtggtctttttttctgtcatgtctgtactgcttttaatctcatccaaggtgttcttaatttcagatgctggtatttttcagctttagattctcccccttaaatgtctttgatctctctgcttatcatgcttatgttttcctctactttttgaacgtatgagtacttcaattttattttaattttatttttaagagggagtttcgcccttgtcgcccaggctggagtgcaatggcacgatgtcagctcactgcaacctctgcctctagggttcaagcaattctcatgccttagtctcctgagtagctgggatttcagccacccgccaccatgcccagctaatttctgtacttttagtagagacggggtttcgccatgttggccaggctggtcttgaactcctgacctcaggtgatccacctgcctcggcttcctaaagtgctgggagtagagtgcatttcttttaaaatttacttactaattttttttttccttttagagacaggatctcgctctgttgcccaggctagagtgcagtggcaccaccgtggctcactgcagcctcaacccccctgggctcaagcaaaccgcctgcttcagtccaccaaattgttgggattacaggcatgcaccaccacacctggcctggatttcattttattcctttaaggataccagactttattctggcatatacatatggttaagttacttgtagtcatttggacccttcccatgttttcttttaaataccgttggggctcatctagtgcagtctttgcctagtttaatttcatctcactactaaggtgaaatccttctgagtactctacctgttgccttatgtattatgaagtctctccactgtggctaatgggaacatgagctcttcagaaaatatttggcctactgcttctctctagttttctccagtctctggaatttcaccttacaaatttacagatgatgttttcagagatttaagggtaccctgtgcagatctcaaggctgcccccttctctcccatattctgttgtgtaaatcctacccactttagtttctgcaaactttgctctctctctaactcagtgaggctgctgggctttttttgatgtccattctgctatggactgaatgattatgtctccccccaattcacaggttgaaattgtaatccccaatatgctgtattaggagatggggccttgggaagtgatttgatcatgagggtggagccctcatgtcatgggagtcacgcccttacaagaagagaggggagagaggttccttcttccttctgttcttagccatgtgaggacacaaggagaagacagccatttgcaaaccaggaagagtgccctcaccaaatatccaatgtgctagcacctaaatcttgtacttcccagcctccagaactgtgagaaataaatgtatgttgtttaagccatccagtttatggtattcttgttgtagcagcctgtaccgaccaagacacctccctggtctgcctcttggaaactgcctttaggtaataagctgggaaaatggtagggcttgttttccttctttcagggatcaaagtcctgtgctgcctgttatacagtatcggaaatgagtgtttcatatatttttgtctggttttctagttgtttattattgcataatagcagttaatccttcatgtgcagaggcagaaatccttaaaaaaatgctttttaatccatatttttctgtccgataccagtttttccattttacttataagaccctcctgccaacagcctttaattggtcattcatttctgcaacatattgataagcacctgctaagtgcctgatgtggtcagacagtgcaggtacaaaaaatagaagacatagttgctgccctttaggaccttattgttttgtgagcgatttagacaggtaagtattcacaataatatcatattagtaacactggccacatgtcccaaagagtagataaacatggaggagataattattaatttggcctgggaatttggggcaggcttcctagaggaagtagaattcagctgagctttgagggatgaatagcaggtagctacatagagaaggcagggttgcagagagtattcttttttttttttttttttttttttgagacggagtctcgctctgtcgcccaggcttgagtgcagtggtgcaatctcggctcactgcaagctctgcctcccgggttcacgccattctcctgccttagcctcccgagtagctgggactacaggtgcccgccaccacgtctggctaattttttttttgtatttttagtagagatggggtttcactgtgttagccaggatggtctcgatctcctgacctcgtgatccgcccgcctcagcctcccaaagtgctgggattgcaggtgtgagccaccgcacccggccaagggtattcttagtttaaaagtcttctatatatattttaaaacatatttaaaagatgctggccagtcacagtggctcatgcttctaattccagcactttgggaggccgaggtgggaggattacttgagcccagaagtttgagaccagcctgaacaacatggtgagaccctgtctgtactacagaaaaaaaaaaaaaagtttatctaggtgtggtggtgtgcacctgtactcccagctacttgggaggctgaagtgggaggatcacttgaccctgggaggtcgagcggtgttcatagcgctgtactccagcctgggtggcagaatgagaccctgtctcaaataaaataaaataaaataaaagatgccaaaaagaattcttaaccaggtcgggcactgtagttcatgcctgtaatgccagcactttgggaggctgaggtgggtggatcacttgaggtcaggagtttgagaccaccctggccaacatggtgaaaccccatctccactaaagacaaaaaaattaaccgggcgtggtggcgcacagctgtaatcagctactggggaggctgaggtgggacaatcgtttgaatgcaggaggcagaggttgcagtgagctgagattgcgtcactgcatccagcctgggtgacagagtgagactgtctcaaaaaaaaaaaaaaaaattattaaccaagtttgtatttggaatatactgcttttcttttcttttctttttctttttcttttgagctggagtctctgttgcccaggctggagtgcaatggcgccatcttggctcactgcaacctctgcctcctgggttgaagcagttctcctgactcagcctcctgagtagctgatattacaggtgcctgccaccatgcccggctaatttttgtatttttttatagagacaatgttttaccatgttggccaagctggtctcaaattcctgacctcaggtgatccatccgcctcggcctcccaaagtgctgggattataggcgtgagccactgtgtccggcctgtagaggaatcttaaaactgtcatagttggcctggtgcagtggctgatgcctgtgatcatagcactttggaaagctgaggcaggaggattgcttgaggccaggagtttgagaccagcctgggcaacatagacctcatttctacaaaaaatttgaaaattagctggtcatggtggcatgtgctggtaatcccagctacttaggaggctgagatgggaagctctcttgattccaggagtttgaggctcagtgagctccagtcataccacggcactccagcatgggcaacagagtgagaccctgtctctgaaacaacagcaacaacacagtcataggtatttaataacgtttaaatattttttccatcaaaattcagtttcacagaaagccagtgaaatgcaaagtgacattttaaagaatgcacttggatagataatcatttgcttctaccaactggtgaaaatcatcagcaaaagttagtaatcatggttttttttgtttgttgttgttgttgtttttgagatggagtccagcccaggctggagtgcaatggtgcaatctcagctcgctgcaacctctgcctcctgggttcaagtgattctcctgcctcagcctcccgagtagctgggattctaggcgtccaccaccgcgcacagctaatttctgtatttttagtggagatggggtttcgccatgttggccaggctggtctcaaactcctgacctcatgatccgcccacctcggcctcccaaagtgttgggattacaggtgtgagccaccatgcctggtctgtaatcctgtctctaaacatttttagcagtatatgaaagtgtcagtaagtaaatatttatgaacaaaaagtctgttttgatttgcaggattttcggaacaggtgacaattgggattgctttgctcttcagtcttttttttttttttttgagacagagtctcactctgttgcccaggctggagtgcagtggcaccatctcagctcactgcaagctctgcctcctgggttcacgccattctcctgcctcagcctcctgagtagctgggactacaggcgcccgccaccacgcccggctaattttttgtatttttagtagagagggggtttcacagtgttagccaggatagtctctatctcctgacctcgtgatccacctgcctcggcctcccaaagtgctgggattacaggcgtgagccactgcacctggcctgctcttcaatcttttttaattgagggcttttctctaacttaaagaatcagtatctttttatttcagtaaatcttatgttatgtcaaaattaatttttctcagccataggagaaggaaaaaataaatccaacagagagttaacagttacataggccaaaggcaaattaataataaatgccataggtctttctcatattttgccatttttaaaataagatggccttcctttagtgtagtaattaaatttatagcagtcctgtgtttaacaacacttttaccactagatgtcactagactaaaacaattggtaagcttgttgaaactgctgcaacctggtgcagtcttttcaaaggcctttggttaataaggcttcctctgtagcacctgcatttctcataaaactaagtcacagcttgcttcaagcacaagctgattgggaaatatacatgttctgtgacacgttagtaatctagaattacttattttagtgtttatcaggacagaaaaggacaaatcttactaccggaggaaactttttagtgaccttaattttttggagagaaaacgattttcagtctatctctgtactcagagaagcatttatcgtcacacctcaggtttctcaagagttgagattttgtccttttttttttttttttctcgagacggagtcttgctctgttgcccaggctggagtgcagtggtgtgatcttggctcactgcaagccccgccccgccaggctcaagcaattcttctgcctcggcctcccgagtagttgggactacaggcgcgcaccaccatgcctggctaattttgtgtatttttagtagagatggttttcaccatgttggccaggctggtctcaaactcctgacctcaggtggtctgtctgcctcagcctcccaaagtcctgagattacaggcatgagctaccatgcccagccaagagttgggattttgtcttagacatcgtggatttcttagggcccagcacaaagcttggcacttggtaggtactcagtaaatgcaattaagcattagggtagtatactagatgtcatgggggaaaagatagctcacaggtcctctgctctcaagaagtctcatttgggagataatacatgcccacagcacagggtattgtatgtaaaccaaatgagtagtgcattcactagcttctgtagtatttcaggggatcagtagctcttgagagctagcggtagtgatcaaaggtgtccttaagagaaagcatatttagagatgcaaaagtaggacagttacaagtgaagaaagcaatgagccaaggtttaaggataggaaaatgcaggcagtaaagatttagaaagataaaaactcaagggccctgaatttaaagcatacatttaggtttaata

SEQ ID NO: 91 - DNA, 342842 bp, Homo sapiens
  source 1..342842: mol_type = genomic DNA
catccagtcagtcttgttttgtcacactaaaaatttcaagataagtccataacaggagcataagtaagatactgcaaggttctgaccttggcctcaaccttactcaagatcatatcacttagcttggttcctgccatacttagcaaaggaccctatacatgctagatacttattgaagatttgtggactggacttaaataaagaggtagaggcatatcaatcacattggtaggtggtaaagtgttggacagaatatctgacacaatggatgacagaatcaagggtcaaaatgacctttttttttgagacagagtctagctctgtcacctaggctggagtgcagtggcatgatctcggctcacttcaacctccaccacctgagttcaaaccattctcctgcctcagtctcccaagtcgctgggactacaggtgcacgccaccatgcccggctaatttttttgtatttttagtagagacagggtttcaccatgttggccaggctggtctcgaactcctgacctcaaatgatgcgcccgccttggcctccgaaagtgctgggattgcagacgtgagccaccacgcctggcacaaaatgatcttaacagactgaaaagatggtctgaaaccacaatgacatttaaaagcaatacagctgggtgcagtggctcatgcctgtaatctcagcactttgggaggccaaggtgggcagatcgcttgagctcaggagttcaagaccagcctggccgacatggtgaaaccccgtcactaaaaaaaaaaaaaaaaaaaacgctaaaaatttaggcaggcatgggggtttgctcctgtagtcccagctactcaggaggttgaggcatgagaatcacttgaacccaggaggcagaggttgcagtgagccaagattgcaccacagcactccagcctgggcaatggagtgagacttcatttcaaaaaaaaaaaaaaaaaaaaatagagacaaagctaaaatggtgcagctctaagtccaacgatcataattgtttaagttaaagggatttctgcacacagcaattatttgttgagtccccaatatgtaacaaatacacactactcaaataaattaatcctcccaataaccttctgaggtagaggtattagtgtcccttttagagatgaggaaaatgtgatccaaagaggttaggtgacttgaccaagatcctaaggccaatatacgacgttttcgatctctgaattatctccaaagtctgtgctttttcctatcatgccacactgcccctctgcactctcatgaattgcaggaatttattccaagttacaaagaatcattccagttctgcttaaacatttctagtaattaagatagtttaatactatgcaaggcagcaaaaaggttacagacatagacttttgagaacagtcagatccagattaagaacagctgctcagccacttcttagctgcacaacactggacaaatccttatctctaaacaacagtatccttatctataaattgagactaaaaagtacccacatgacaaggatgctgtgagaattaaatgtgagacgctgtctgaaaagtgcttagctcactgtgtgacgtattgcaattgcccaataaaaattaccattcaaattattatagaaagttctttttatcaaaccaaactctacctcccaataatttctgtccactgatctcagttctgatcactgggactttataaaattagatcaaatcctgtatctatttggcacccatgtaatattagaagagggttatattctgagtcgtctcttctgcaaaccaaaactgtaatctgcttcaaatctccttcataaaaaaaggtcggccaggtgtggtggctcatgcctataatgcaatgccagcactttaggaggctgaggtgggcggactgcttgagcccaagagttcaagaccagcctggacaatatggcaaaactccgtctctacaaaaaatacaaaaaaattagaccagcacagtggtgcatgcctgtagtcccagctacttgggaggctggggcgggaggatccttgagctcaggaggcagaggttgcagtgagccgagattgtgctgctgcactccagcctgggtgacagagtgagaccttatctccaaaaaataataataagacaaggtttctggacaatgacttctatcactcaactcaggatgtaccctagtttaaaaatctcttcttaaacatgacacccagaatactctcgcaggtgtacagtaaccattgccaggtgcctgggactactgcttccactttctgaacttgagatcaaaaaagcccccactgaattgctgttgagccagttttcccacaccctatccttatacaactggttatttttcatctaaatgcaggactttacaggtactgcttttaagtgtttttgttttttgttttttcagatagggtctcactctgtcactcaggctggaatgcagtggcatgatcttggctcactgcaacctctgcctcctgggttcaagtgattctcgtgcctcaacctcctgagtagctgggactacaggagcacaccaccatgcctgcctaaattttgtatttttagtagaggcggggtttcaccatgttggccaggctgttcttgaactcctgacttcaggtagatctgcccgccttggccttccaaagtgctgggattataggtgtgagccatcgcgcccggcctttgtctctatttttgaacattagaattacattatctctcatataatacatgctaatataccaattagaacagaagttttgattgctagacttgattttgtttacaatttggtacagatcaggtgtgtatgtttactttttatggtttttctttcattccccttgctgatagcaagtagcagctactgtcagcttggaaaccaaaataaaatcaatagccctcggccgggtgcggtggctcatgcctgtaattccagcactttgggaggctgaggtgggtggatcacttgaggtcaggagttctagactacactggccaacatggtgaaaccctgtctctactaaaaatacaaaaatgagcctggtatggtagtgcacacctgtaatcccagctactcgggaggctgaggcaggagaatcacttgaacccaggaggcagaggttgcagtgagctgagatcatgccactgcaccccagcttgggtgacagattgagactctatctcaaaaaacaaacaaacaaaagacaaaccaataggcctctgaggcagtctgaagggcttcctgttattaaaatacacaggaattaatacatgggatttaactattttggtgacctgtaggccatttttggttttccctgtttcttggctgttcagggagttggaattattaaataagtaagatataactggatgtcacataatttttgccgccctttaaaaaaaaaaaatttaaagagacagagtacgttgcctgggctgaactcaaactcctgggctcaagtgtctgccttggcctcctgagtagctgggactacagatgtattccatcttgccaggctgatttttgctcctgaggattacaatctagtatagaaaacaaacctcatggttgacttaaagtgtaggattttacaagcatagtgttcatttagtagtgtataatggtatcataccttctgtgtggagtgcctgtttcccatgtgccaagtgctacactggttgtacttcatacaggacctttgcaagtcttcaaaaacaatcctatgagggaaatattaacatcatccacatatagataatgctgagctacagagaggttagacaacttgctcatcttccaaaaagatttaaactcaggtctgtcatagtccaaaggccggatggtttttaccacaggggaagaggtggaccatagtcataggaaacaactgtatatagagaggaatgattaattgagctgaacctaaaaggacaggtggggttttggtgtgatgtgttaggttgggttgggaaggtggatgaaggagttctgggctggcaagagagtctgagcaaagtgggtctgaatatcctgcattgaggagatggggtggtggcagagtgatcactctgtgaccaaagagaaggctgcaatttgagagggagtaagaggatgagacaattattattattattattattttgagaaagagtctctctctgtcacccaggctggagtgcagtggtgtgatctctgccactgcagcctccgcttcccaggttcaaatgattctcttgtctcagcctcccaagtagctgggaatacaggtgcgtaccaccacacccagctaatttttttttttttttttttttttgtatttttagtagagatggggtttcaccatgttggccaggctgatctcgaactcccgacctcaagtgatccacctgccttggcctcccagcgtgccgggattacaggggtgagctaccatgcccggcaaggtgggaaaattaggttagggccagatttggaggctcctaaaggatagggaaaggaatttgaagttgatgccataagaacgtgattgtagttttgtttgttgcagtagggagcagggtattaacatgttgacagctgcgctttttgaatgaattggtatgacagtggccaaagatggacaatgcagttaggagattgttgtagtttcctagtgatgagctgatgaaagcctgggctggggtggggatagtggaaggaggagcaaacttgagaggcattttcaaggaagaaatgacaggatttggcaaattgggtgccaggaataaaaagacggggaaatagccatagggttgcttgattgagggagcagaataatggcagaatggggaagggagattaattttgtttgtttgtttgtttcttttggagatggagtctggctctgttgcccaggctggagtgcagtggcaccatctcggctcactccgccccctgggttcaagcgattctcctgcctcagcctcccgtgtagctgagattacaggcccacattaccacgcccagctaatttttgtatttttagtagagatgggtttcatcatgttggccaggctggtttcaaactcctgacctcaagtgatctgcccgcctcggcctcccgaagtgctaggattacaggtgtgagcaaccgtgcccagtgggagattaattttgaattttggccttgtggccttgcaaaaccacaactagtaggagccgtttcactgatgcatactcaatgctccctagcctagcatccgcacaatgccttttctggccatggcggagagcacttcaaaaggaggccctgcggagggtggggtgggtagaggagcatggtagggaatgggaggggcaggtgtcttccaaagtttgcagttctcctaacttgttttgccctaggtccgctgaatgcagtattacagtcatggcaaatgtcaccgtactgatgtgcttaacatagatgtaatgttttctagagggtacgctaaaactcttggagggagtggggggtgggggttataaatctttatgttatttttctgttaatgtcaaggaacagttcatccttctgggtctgtatgtttaaactgagagtgaatattaataggaatttacggtactcatgttggaaattgctaccctcatttagaaaccattaacctttatgttaataaaataatgtttttaaatgagcatatgaaatctgtgttgaacagctgcggtctttccggaacactaacttaaaaaatgctcagcatactttttgaaaatcaaaagcatgtgggtgggatgaagtcacctgagcaattttctataattacaactttcaaggccttttcctttgtctttttccagctaacctaaaatacacatgcacgcatgtgcaccctcacacagacagcagcacaaacctgtgattttcttctttctctctatggactttttggccttgtttttgttaaatagttgcagttccctaggaggatatgtgttgtcttgttccttctctagtttatttgaaaccttatatctttgagaactttggaactccccagaacaggctagatgtccacctagactcccaagctttgaatgccctgtcctaaagtatttctaggtgcgttggatctaaactgattcccctagggtgacagtggaaaccccaaaatgccgacatcctagagaatgaccaggaacatgctcaagttgttacacagttttttgtacgtgctgaggttcctcagtgccatcctggtcagccagtactggaatgtgacagaactggcatttgtgcccaggaacagcctacgctgggaattcgcttctgcattctgataattaagtctgctgtgctgctaatattgttccctgaaggaaggagagctagggaataatatcattcccacttgtaccttttaattaacagaggagtggaatggaaagagttttaaagaagactttgatgagagaagatcggtacctgacatagtctggtaattccatcattgtcgaacacattttaagaataccaccgccagttttttcagtgagctaactgaaaataattctaaactttggcttattttatgtgtagaataaaattattgattttccaagagcattcattaagaagtgccttgctaagaagtgttaagcgtgaagtagtgtaatatgtctgtcctactattttaggggtcactccttcttcatcttcctcttctctttcctctaagtaaccaaagctcttcacctagaatggaatttggggcttacattttccttactatcatatagctgtttcttgttaccgaaagcagagagagctttttcagggaggttaaaattatcgttatcttgttatagtgttattttttccttcttagtaagttaggagcaatgctttgtcttcctgaagctgtctgaaaagatgcttgtatacatgtgtatagcgctttgggtcatagaaattaggtgttatgtcatctgtttcagaagatgcactaatgcatcaaaaacaagtgacagggaaaacaatgcagtgagtaatcttgttgcctcaaaactgagcaaacgttttgggagagcaagttcttgcgggacatcactaaataagaatgagttgatgtcacacttggcaagaagcaactctttaaaattttttttttccatacaaatagtacaacatgactgggaggagggattgtgggcaaagggtaaagaattatggagggaaaatgagcaggagaaggaatgtgagaatgagctgcttgctacaaaaataattaatatgtaatcaaagccatgtttgttttgtcaggaaaaatctgagtcagaacatgagctgatgaaggggagagatgtttaccatgtcctcccccacaccctcagagggccgttgtgtgcagatccctgcggagggttgtgtaaccatcttgactcattttcagggaagaatggcccctgtagctcttttggctcaatataatgctgcatcaaggatgagtgaagaagtctctggaatacagtgctatcaaactcaaaatatggtcattttaatgagaatttccaaacactaggaggcaatactgtgcagaccttgtgccaccacctgcctcccccttcccagatatctgtgcgatattgggaattcaggcagcccaatcgatagctgattttaccttttcctacaaggcagaaaatgtcaagattagccaactatttattgaaattagttggagttatctggctacatgagtgtctgtggtccagtgtatcataataagagtgggagagacggttggggtgctactggcatcttgggtgggccagcctttattgtgtgtcactgccgtgtattggcaatttttgtccctgcccactgaattgccagtggtgccccagtctctgcgatggccaggagaggccttccttcttccagattacctctgtgtgtttcaggggggctaaaacagtatgtgttttacagtattactaagcagcacagttttctttgttgttccttagcataaagatcttggaaagttttaagaagttgtgtgtttatactgtagcataggtttcattcaacctatcactcctattcactcctcagagtgaatttcagggaaaaacaacagtattgggggaaaaagtttggaaaaattggatggagggaaggaaaaaaaaaggtgaattgcaaaagggtttcttacgtagcccactattgttccccaaatcaacactcactctccagctctttgggtggttgctctgcattttcaagaggcagcctggggtggaggtcagggttgcaggtaaggtagaggggaaataagagaggacagggaagaggcaggcatgaataaaagatttggattggaatataaagatggaatacaatggagataatgaaagaccataacaaagaaacaggagattttacatggcattgttaagcttacaatgttggcattttggggacaattctgagtaccacagatctagaacttctaaaagaaaaaccctctgagataattacagcagttaaagaccttcacatacatgttgaattaatagtatttaatgtccctttgtaggtttcaatcttttaagcctgtcctgccaaagactgtgtccttctaggtgcttagccagtaatttaggtgtactgtcaccagttgtttccgtcatgacttctaagtctcagcagccattttcccttaggttttattaactgagtcagtaactcaaagtgtcattgttttccactcatctggactttctgaaaataacacagtgctttattggaaaagctaagcatagacattagccaaatgtttgctaaaaattaaccaaattaaatgttattaaataagatgtgcaaatagaggaaaattttgagaagtatgaacaaatcccactaatctttgttgtcagtcactacttagaaccttggcttcgcaccaaggctgaattaagttgaagaatgttttccgtaatgcttcccctaccttttaagttggtttgaaaacattcagttgcatgtgtaccactggatttttagctttttcactagttgttaccctggcagccttgattcagtgaaaatcttgtttttatcacaggctatttctctgagcagccaatgtttcacgctctctccctgtctaattgtctggccttggtaactcttagcaagagttgaaattacctcggtcaaccacatgacaaaagagtgggcatgggttttcctgaatgtctcctgaggtgaccaagggtggagtggtggtagcataataaaccccatgggaagtggagccatagattccatcagctttgcagaggggccttagacccagcagggtttaagaaactgctgtggataggatgccttgtcctccatagagattatcagctgctacctagaatttctttttcatttgcagtatgtcagcatacagaaaaaaaaaaaaaaatagcaaacacctgtgtattcatcaaatttgtcatattttaatattttgccatgtttgcttcagatctctttccctgcaggaagaaaaatacacgtttcaaataaacaacgccccctccccatcctttatatccttccctgatattccctcctcctcccactccacagggaattattgatctgattttggcattcatcatgcccatgtgttttcttcgtggcttgtctttttcctacatgtttttgtatatctaagcggtgtagaatattctttcacttgttttgactttatataagttgtgttctatatgtatccttcagctacttgtgtaactttcttttttcttttccttataattttgagatttatccatgttgatatatgtctcacttattttcactgctgcgtagtattccatcaaatgaatatttcacagtgtatccattgacttattagtgaatatttgagttgtttccagttgttttactattaaacagttttgcagtggacatctttgtacatgtctccttttgcacatgtatgagagttttctctagggtatgtaactaggaacaaattgctgtctagtagggcacatgtattttcagctttactagatacagtcaatttactcttcaaagtagttatgctcttttatcgccttactagctatatattagagttcctgttgttccacatcctcagtaaaaccggatattgtcccagctgttccttgcttattgattaatttaaagacaacatcgtgcttagcaaccatctcaaacatagggtcagatgcaaacttaattttcttataccatgcttcttccttttaaaagaattgttttgatttctgagttacaaatccaagataactataacatagcttttttgccatatttatttttttaataattttttttctgatcacgaaatgaatatatgattattttaaggaacttggaaaacaaaatgacaaaaaagaaaattaaaaattctacctagacatagccattgttaataacttgctatatttttccttctagtgtagacctatgtaaagtatacatttactttataattaaaatttgtcattttatatcacaattttacttaaaattctattgtggcatttcccatgtcattggatattgtttgaaaacatcatctaaggccaggagcggtggttcacgcctgtaatcccagcactttgggaggccaaggcgggcggatcacgaggtcagaagatcgagaccatcctggttaacatggtgaaaccctgtctctactaaaaaaaaaaaatacaaaaaaattagctgggcttggtggtgggcgcctgtagtcccagctactcaggaggctgaggcaggagaatggcgtgaacccgggaggcggagcttgcagtgagccaagatggcgccactgcacttcagcctgggctacagagcgagactccgtctcaaaaaaaaaaaaaaaaaaagtgtaaacagctggataacatttctttttgtaaatataaatatagtttaatcattctcccattggaggacattttgggtattaaaatgatactggagtacaaaatcttggtgcataaatttcatctgagtttgtttctttgggatagatttctagaagccagtaactattcatggaattagattggatagctgataaaagcagggcatcaagggagaaaaaagagttgagagagcaaaacaacatgcttaaggatcatgagattcgtgaattcagcttctgtcatatttgaattgagtggcaaatttgtctcttacctgaatttggagacccttctctaattagggatgattattagagggaaattctgccctactgtggacaccagagagttggttgtgtgttgtagtgttcaagagttttatccaatattctgcttcctgcagagttcctgaattgagggtcttttgtggaatatctcattgaagtagacttttaaccttgacttgctcaacatctgatcagaagcagctcgttgtcatataaggaaatctgctctgttatggaacatctttgagtagttgagttcccctttttcccataagtccaaatttgattccctgtcaccttcaattgttctttaacttgtttttaaacaaaagtctccctaaaaataattccagaagtatttgaactttatttctctattagcttctactgtaattaacatgaaaacaaacatgttttaaagtctttgtttccttctaaggtataatttagctttatcacgtcttcatagtgaaagttgtatacgtgaacgttggtaggatagaaaaactttccacatagttttatacttggtgcccagaaaacttccaaagtgtttaggtactactcattattatttcttagaaattgaatagaagcagtggcttgagtatacacagtcccactttttcgttaataataaccacatttccctttttttttttgcacaaaagtgttacatgtattttctcgtttaatccttgtacaacctattagggtaggtattttcctcatttggcagatgagggtgctgaggctcagagagatgaaagacctttcctgtcacacagctattaagggcagagctaggatttaaactcagatctaattctaaaacctgtatatttaactagtttgcacatctgtctccctgacttaattgcatcataaaatcaaagatatttctcttcaaaatatgttcatgttggattatttggctgtttcactgttagaggtctgttgcttctgctggcttttctgtggcaatcccagctgctcttccccgtggcttgggcacaccaaggatttcctttctgtgattgccccatatctccctagtccgctgtggggggcaccttcctgcttctgaggaaactgaagcaggagatgaggaaagggtaacaattaattacatacttttttttcccgagtattatcaactaacatgttccataaaggagcatgttttcacagctgtgtgctttagaaacagggagaaaggtttgagtttttatgactgaggtatcttcaacaaaggctgtgatgtacacgcttgatggacttggaacgtggaaacccattccctccctcagccctgggattggaatctttgtgtttatggtcacatgagtattcagatatgttatctctgaatgtgatgccctggtcagagaaccaaggagtggacttgctagattatatgatttaattaccctagatcaatcaagctttgacttactgatggcaggatatattgtgtattttttcctagttgctagaggaaaggaacaaagtttaatccttggctttgttgacctttggtatcacttttatcttgtagttccgtataactgcctttgtagactcttcaaaaggctgaaggcaagtgatttatagataagggctcattcagtacttgcacaagaagagcccatatcttcaaatatgggtgacgtaaatttacttcagaaacagaaatgagctcatttatttggagagatgtgaacagaatgtgcgtcttttgctccgggtgagaaataaatttaaattcagaactttgcttgggggaaatgaaatggaggaactaggcacttgagcctcttggaaattagagatctttagccaaggcccaagggagcactgtcttggtccatttataacaaaatactggagactgggtaatttataaagaacagaaatttatttctcactgttctggaggctgggaagttcaagattaaggtttgttgagtgctgcgtcttctagagtggatgaacactctgccctcaactggcagaaggagaatgggcaaaaaacaggagtaactcccctgctgagcccttttgtaagggcagctaatcccatttacccagagaggagccctcatggcctaaccacctcttaaaagccccacctcctattactgtcattggcaacacctgcattttggaagggacccattcaaaccatagcaagcaccaatagtatgtttcagaactcatccacataggagcactcctcagcatgtccaacagcagtctgtggagaactacttttttgttttggtttggttttttgttttcttttttgtgacacagtctctgttgcccaggctggaatgcagtggcatcatctcagcccactgaaatctctgcctcctgggttcaagtgattctcctgcctcagcctcccaagtagctgggattacaggtgcccgccaccacacctggctaatttttttgtatttttattacagatgggctttcaccatgttggccaggctggtctcaaactcctggcctcaagtgatccacccacctcggcctcctaaagtgctggcattacaggcatgagccaccgcgcccggccagagaactactttgtgtaagtctacgaggcaccatacacactttttcccttaaggaccttactgagtaactgggaagagagagcaggaatgtcaacaataatacagaagaagggttctatggtaaatgccgaaagtgaaccttcaacgaagtgagttccagagagacaacccataaaggtaaagatttagtcataaatgagctgtgttgctactgaaaacatcttgattctaaagtataaccacatctcaaccaagcaaaaactgtcttaagcctgaattaagaggaaaatgatattttaaatgaactcctcaagtaagttgccaaatcattgacactagaattttaagaattggtgactctagagctttcatggtttggctactgtattatctccctcaaggtgcagtaatatttctgtcaccaaaaatcattaattgataacattattctttctgttagttctagcacttatttccatcactgtgatttttttattatgatgattatttttactttacttacttagtataggggattacctgccttttaatgtcatcctgacaattaagacaaaatacagaacatgcttagcacagtgcttggctgagagagtgccatcattaatattaggcattatttttcttattcttgaaatacagtgttttatatagtgcctggcatgtagttaaattttagtaaattataataatgttgtttattgttttccaaaggatttttaacatgtattatcaattaatactctgagctacattcaaggtatatagtgctattcctcttttactaatacagaaactgaagttaagtacattggtcagatttttctggctgatttaagcagataaagaaattattaaaaggaatgtggatagctcacagaatcagcagaagagctctagaatcgtgttttgggctacctagccaagtaaaatggccaagatcatgccacagaactgagccactgccaagtacctgccgtgccttgcacggcaaacaatgctggctggcattggtgaccggactttgccacagggattgcttctactgctcccttggaaactgttttacagaaactgctgtcaccaaggaatgtacttcatggaaggccctattttgcaacatttgccccctatttacagtctggagtgggtggcaatttgctttattgccaactcattgtgtcttaactctctgtgaaagaaatacttcgtttatattttcttttaattggatataaactgagtagaagttgagattattttccttattagtagacttcgtgtgtggaaaagttagttttttctgaaattgatcttgttcttagcaattatctgctataagtattgcctcaactttttaggctactactaaatgagaactttccatctgatcagggcgtcttctccagtgtaaacaatcctgtttcccattacccattggagctaaggaacccatgatgagttaacacgtgcaagaagggttacccctttgagcaagaaaagtcctggcattagtatttcagatttttttcttgcatccttttctgatattttatttattttcatttaaagtggacctatggtttatcttgctgaaaatctcaaaaaaccaaaaaacaaacaaacaaaaaaaaaacgtgtcaggtccctaatgtgattgctgttaaccatataaaaataacctcccctcttttataatcagtcttggtgcgccttgcaaagcctacatttctaacctgtgtatacttcaaactactgtgagcatgtgttaaacacctttttttttttaaataaaaagaacactttcagctccttaaagcaagctcttttgggaaggaaagaatccctgagtgctgcagccatccatcctgctttgtctggaaagctaaggtttttgggttattgatgtttcaacaagtggagagcacctaggtctggtgagcaccagctgctgaagtgtggggggcacccaagtggcctgttcttccaggatggcattcattcttccaggcaagtgggacaaagtgggctttctgccttcactcagtgagagctgttgaaagattttctcatctgaattgtgaatgtttgtaatgtttattttcacagtaagagtgagggccttctcactttgaatatattcctttttgcaaataattttgaagtagtcctgatcctgtgttaaaagaaacatggtatgtcattatagaagaatccttcatcccccttcccttacaaacataaaattttcagagtttacatttggaagaaaacctggttcaattctctccattttcagggaaggaaatggaatttattctttcctttgtttatccttttatagttttcattttgttccctgttggtcacatttttttttttggccttcttattagaggggtattgtggaatatttttgcttagcaaaaattaaaatcaacatacctgactttgtaattgtaaaatatgtataacatacaatttatcattttaatcctttttgagtgtacaattcagtggcattaagtatattcacattgttgtgcagtatcatgaccttccatctccggaacttctccgttatcccaaattgaagtctattaaatagtaatttcccaatctctaccctcagccctgacaaacattattattctacttattttcgccatgaattttactattctttttgtttttttttttttttgagacagggcctcacgctgtcacccaggctagagtgcagtggcacgatcttggctcactgcgacctccctctaccttacaggctcaagtgatcctcccgcctcagcctcctgagtagctgggacctcaggtgcacaccaccacgcctggctaatttttgtatattttgtagagacggggtttcaccatgttgcccaggctggtctcaaactcctaggctcaagggatccttccacctcggcctcccaaatgctggggttacaggtgtgagccaccgcgcctggccaaatattactattctgtatgtttcttgtaaattgaatcatacagtttttgtccttttgtgtctggcatacttcagtttaccacaattttttcaggttccatctgtattctagcatgtaccagaatttcattctcttttttaaggctgaattctattatgtgtatataccacattttgtttatcctttcatccattgatggacatttgggttgtttctactttggccattgtgaataatgctgctgtgaacattgatacataaatatctgtatgagtccctgctttcagttcttttgggtgcatacccagaggtggaattgctgggtcatgtggtaattctatgtttattttttttcctcccttgtaattacccacaatgtggtaaaatacacttgacatgaaatttaccactgtaactatttttaagtataagttcagtggtattaagtacattgagattgttgtgtgaccatcaccactgtccatttcctgaatgtttttcatcttgcaaacctgaaactctatatccgttaaacagcaacttcctatcctctcttcctcccagccctggtaaccactgttctactttctttctctatgattttgacttttctgtgtacttcatataaatggaatcattcagtgtttgcttgtgactggcttacttcacttagtgtaatgtcctcaagattcacccatgttgttgcataggtcagaattttcttttaaaggctgaataccacatgtgtatatatatagaaaaatattattcagtcttaaaagggaattcctttttaaggaatgcctcattttgcttatccattcttctattgatggaaatttgaattgtttccatgttttggctattgtaaatcatgttctttgaaaatgagtgtacaaatgtctctttgagaccctgcttttgattcttttgggtatatactcagaagtggaattgctggatcatatagtaattttacatttaattttttgaggaaccaccacacccctttcgccagcggctatgctataccatgttacgtctccaccaatagtgagtaagggttctacatctttgccatcatttttttttgtttgtttttgatactagccatcttaatgggtgtgagggggcatctcattttagttttgaattgcccttccctaatgattagggatgtcaggaattctttttatctatttatttattttttattttattattattatactttaagttttagggtacatgtgcacaacgtgcaggtttgttacatatgtatacatgtgccatgttggtgtgctgtacccattaactcgtcatttagcattaggtatatctccaaatgctatccctccctcctccccccaccccacaacagtccccggtgtgtgatgtttcccttcctgtgtccatgaacacatggacacttattgttcaattcccacctgtgagtgagaacatatggtgtttggttttttgtccttgcaatagtttgctgagaatgatggtttccagcttcatccatgtccctacaaaggacatgaactcatcattttttatggctgcatagtattccatggtatatatgtgccacattttcttaatccagtctatcattgttggacatttgggttggttccaagtctttgctattgtgaatagtgctgcaataaacatacgtgttcatgtgtctttatagcagcatgatttataatcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacaccctctccagcacctgttgtttcctgactttttaatgattgccattctaactggtgtgagatggtatctcattgtggttttgattttcatttctctgatggccagtgatgatgagcattttttcatgtgttttttggctgcataaatgtcttcttttgagaagtgtctgttcatatccttcacccactttttgatggggttgtttttttcttgtaaatttgtttgagttcattgtagattctggatattagccctttgtcagatgagtaggttgcaaacattttctcccattctgtaggttgcctgttcactctgatggtagtttcttttgctgtgcagaagctcttgagtttaattagatcccatttgtcaattttggcttttgttgccattgcttttggtgtttttgacatgaagtccttgcccatgcctatgtcctgaatggtattgcctaggttttcttctagggtttttatggttttaggtctaacattgaagtctttaatccatcttgaattagtttttgtataaggtgtaaggaagggatccagtttcagctttctacatatggctagctagttttcccagcaccatttattaaatagggaatcctttccccattgcttgtttttctcaggtttgtcaaagatcagatagttgtagatatgcggcattatttctgagggctctgttctgttccattggtctatatctctgttttggtaccagtaccatgctgttttggttactgtagccttgtagtatagtttgaagtcaggtagtatgatgcctccagctttgttcttttggcttaggattgacttggcaacacgggctcttttttggttccatatgaactttcaagtagttttttccaattctgtgaagaaagtcattggtagcttgatggggatggcattgaatctataaattaccttgggcagtatggccattttcatgatactgattcttcctacccatgagcatggaatgttcttccatttgtttgtgtgttcttttattttattgagcagtggtttgtacttctccttgaagaggtccttcacatccctttaagttggatccctaggtattttattctctttgaaggaattgtgaatgggagttcattcatgatttagctctgtttgtctgttattggtgtataggaatgcttatgatttttgcacatggattttgtaccctgagactttgctgaagttgcttatcagcttaaggaggttttgggctgagaccatggggttttctagatatacaatcatgtcatctgcaaacagggacaatttgacttcctcttttcctaactgaatgcccttgatttccttctcctgcctgattgccctggccggaacttccaacactatgttgaataggagtggtgagagagggcatccctgtcttgtgcccgttttcaaagggaatgcttccagtttttgtccattccgtatcacattggttctttcatgtgcttattggccatttgtatctcttatttggagaaatgtcggttcaagtcctttgcccatttatgaattgggttgtttgaggttttttgttgggttttaggaattctctatatattctggatataatatacatgtatataataaatgtatataataaaatatacatgatttgaaagtattttctgcattttgtgggctgcctttttactctgttgatagtatcttttcatgcataaagttttaaaattttcattgtccaatctatctttttttgttgttgccagtgcctttggtgtcatacttaaaacattgttgcccaattcagtgtcatgaaacttttgcctgcgttttctcactataggaaactatagtaaaaaacattaaacgttttattgttttagatcttacatttaggtcatggattcattgttaattaacttttgtatatggtagtaggtaagggtccaacctcattcttttgcatgtggatagccagctttcctagcagcatttgttgaaaaaactgtcctttcccaactgaatggtcttggtgcccccaacaatcatatgactttatatgtgagggtttgttctgggccctctgctcatttctgtggtccatttgtctgtctttatgtcaatgctgcactgttttgattactgtaattttaagttttgaaatcaggaagagtgagtcctccagctttgttcttcttttcaggattgttttggctattcaggatctcttgagattccatatgaatttttggatggatctttctatttctgaaaaaaagtcactgggattttgatagggattgcattgaacctgtaaatcacttttggtaatattgacatcttaatattaaatcttccaatcaatgactatggggtgtcttaacatttgtatgtgtcctctttaattcctttcagctgtattttatggttttttttattgtacaagtctttcatctccttggttaagtttattcctaagtgttttattctttttgatgctattggaaatggaattgttttcttaatttcctttttggattgttcattagtgaatagaaatgcaactgatttttgcatgttgactttgtatcctgccactttggtgaatttatttatttattagttctgatagtatttttgtggaacattcaggttttctatatatgagatcatatcatccgtgaacagacataatttaacttctttctttctaatttcgatgccttttatttcttctcttgtcttattgctcttgacagaacttccattattatgttgaatagaagtggtgaaaacaggcatccttgctttattcctgatcttagagggaaagctttcaggtcatcaccattgaatatgaagtttgcttgcatttcttttatatggcttttattatgttgaggtagtctccttccattccttgtttgttgagtgttttatttgtttgtttttatcaagaaagggtgttgaattttctcaaatgctttctctgcatcagttgaaatgattttgtggttttctttttttttttttttttttttttttattgataattcttgggtgtttctcacagagggggatttggcagggtcatgggacaatagtggagggaaggtcagcagataaacaagtgaacaaaggtctctggttttcctaggcagaggaccctgcggccttccgcagtgtttgtgtccctgattacttgagattggggattggtgatgactctttttttttttttttttttattgatcattcttgggtgtttctcgcagagggggatttggcagggtcataggacaatagtggagggaaggtctggttttcctaggcagaggaccctgcggccttccgcagtgtttgtgtccctgggtacttaagattagggagtggtgatgactcttaaggagcatgctgccttcaagcatctgtttaacaaagcacatcttgcaccgcccttaatccatttaaccctgagtggacacagcacatgtttcagagagcacagggttggggataaggtcacagatcaacaggatcccaaggcagaagaatttttcttagtacagaacaaaatgaaaagtctcccatgtctacctccatccacacagacccggcaaccatctgatttctcagttttttccccacccttcctgcctttctattccacaaaaccgccattgtcatcatggcccatccccaatgagccgctgggcacacctcccagacgggtcgtggccgggcagaggggctcctcacttcccagtaggggcggccgggcagaagcgcccctcacctcccggatggggcggctggccgggcggggggctgacccccccaccatcctcccggacggggcggctggccaggcagaggggctcctcacttcccagtaggggcggccgggcagaggcgcccctcacctcccggacggggcggctggccaggcggggggctggcccccccacctccctcccggacggggtggctggtcaggcggggggctgacccccccacctccctcccggactgggcggctggccgggcggggggctgacccccccacctccctcccggacggggcggctggccgggcagaggggtcctcacttcccagtaggggcggccgggcagaggcccccctcacctcctggacggggcggctggccaggcggggggctgatccccccacatccctcccggacggggcggctggccgggcggggggctgaccccccccacctccctcctggacggggcggctggccgggcggggggctgacccccccacctccctcccggatggggcggctggccaggcggggggctgacccccccacctccctcccggacggggcggctggccgggcagaggggctcctcacttcccagtaggggcggccaggcagaggcgcccctcacctcccggacggggcggctggccaggcggggggctggcccccccacctccctcccggacggggtggctggtcaggcggggggctgacccccccacctccctcccggactgggcggctggccgggcggggggctgacccccccacctccctcccggacggggcggctggctgggcagaggggctcctcacttcccagtaggggcggccgggcagaggagcccctcacctcccagactgggcggctggccgggcggggggctgacccccccacctccctcctggacggggcgactggctgggcagaggggctcctcacttcccagtaggggcggccgggcagaggagcccctcacctcccggacggggcggctggccgggcggggggctgaccccccccacctccctcccggatggggtggctgccgggcggagacgctcctcacttcccagacggggtggctgccggacggaggggctcctcacttctcagacggggcggttgccaggcagagggtttcctcacttctcagacggggcggccgggcagagacgctcctcacctcccagacagggttgtggccagcagaggcgctcctcacatcccagacagggcggcggggcagaggtgctccccacatctcagacgatgggcggccgggcagagacgctcctcacttcctagatgggatgggggtggggaagaggcgctcctcgcttcctagatgggatggcggccgggcggagacgctcctcactttccagactgggcagccaggcagagaggctcctcatatcccagacgatggggggccaggcagagacgctcctcacttcccagacggggtggcggctgggcagaggctgcaatctcggcactttgggggtccaaggcaggcggctgggaggtggaggttgtagcgagccgagatcacgccactgcactccagcctgggcaccattgagcactgagtgaacgagactccgtctgcaatcccggcacctcgggaggccgaggctggcggatcactcgcggttaggagctggagaccagcccggccaacacagcaaaaccccgtctccaccaaaaaaaaaacgaaaaccagtcaggcgtggcggcgtgcgcctgcaatcgcaggcactcggcaggctgaggcaggagaatcaggcagggaggttgcagtgagccgagatggcagcagtactgtccagctttggctcggcatcagagggagaccgtggaaggagaccgtggagagagggggagggggagggggaggggcgattttgtggttttcttccctttagtcttctaatataggctgttacgtggattgattttcgtgtgttgaatcatccttgtgttccaggaataaatctcacttggtcatggtgtataatccttttatatgctcctgaatttggtttactaggattttgtttgggatttttgcatcaatgtttgtaaggtaaattggtctacagttttcttttcttgtagtgtttttgtcttgctttggaatcagggtaatgctgccctcatagatgagttagggagtgttttctctgcttcaattttttgggaaagtctaaaaagggtttatgttagttcttttaaatggttggtggaactcacctgtgaaactatcagttccagggcttttctttatcaggagatttttttattatgtattcaatctccttactaattataggtctattcagagtttctatgtggcttagccttggtaggttctagttctgtgtttctaggaatttgtccatttcacctaggttatctaatttattgctgtacaattactcatagtaccttgtaaagtcatttttattcccatagaatcggtattaatgtacacactttctcgttttagtatttgagttgtctctcttttttcttagttcctctactctagcaaaaggtttgtcaattttgtttatctttttaaagaatcaacttttggtgctggtgattttctctatttttttttctattctctattttatttatctttggtctaatctttcttatttctatccttctgctaactttgggtttagtttgtttttctagttccttaagttgtaaagttagattgctggtgtgagatctttctttttattttttattttattttattttttagagatgggtatcactctgttgccaaggctagagtgcagtggtgcaatcatagctcattgtagcctcgaactcctggactcaagtgattcttctacctcagcctcccagtaactgagactacagacacacaccattatgcctggctaatttttaatttttatttatttacttatttttttaaagagacagagtctcactaggttgcccaagctcttctcgaactcctgggctcaagcgatccttccacctccgcctactgagtagatgggattatagatttgagtcaccgcacccaactcttgttttttaatgtaaacttttttttttttttttttttgagatggagtcttgctttgttgcccaggctggagtgcagtggcacagtctcagctcactgcagcctctgcctctcgggttcaagcaattctcctgcctcagcctccagagcagctgggattacaggcaggcgccaccatgcctggctactttttgtattttttttttttttagtagaggtggtgtttcaccatgttggccaggctggtcttgaacacttgacctcaagtgatccacccgccttggcctcccaaagtgctgggattacaggtgtgagtcatcctgcccagcctaatgtaaacattgataaatttcccccttagcattgctttcactgcatttcataagttttggtatattgtgtttttgttttaattcacctttaggtttttttcagtgtcctttgtgttttcttcattgatctgttggttgttttagtatgttctttaccgtccacaaattgtggattttccagtttttcttctgttgtagatttctaacttcattctattgtggtggaagaagattctttgtataatatctatcttttgaaatcttttgagacttaatctgtgacctaacatatggcctatcctgaaaaatgtcccatgtacacttgagaagaatgtgtattctgttgttaggtacattattctgtctgtctgtgaagttgagtcagtttgttgtgtgttcaagtcctctactttattacttatcttctgtttggtggttctagtcattattgtgagtgggatattgagacttccagctattattgaagtatttttcccttcaattttgtcagtgtttgcttgacaaattttgatggtctctcattaggtgtataaatgtttataatttttaaatctttttttgagacagggtctaactctgtcacccaggctgcagtgcagtagcgagatcttggctcactgcaacctctgcctcctcattgatcctccatctcagcctcctgagtaggtaggactagtaccatcatacccagttaatttttatatttttagtagagatggggtttcaccatgttggctgggctggtctcgaactcctgagctcaagcagtccacctgccttagcctctcacagtgctgggagtacaggcatgagccaccacacttgatttgaatatttataattctttttttttatcttcttgctatatcaaaccatttatttatttatttatttatttatttatttatttatttatttatttatttttgagacggagcctcactctgtcgcccaggctggagtgcagtgacgcaatctcagctcactgcaaggtctgcctcccaggttcacaccattttcctgcctcagcttcctgagtagctgggactataggtgcctgccgccatgcctggctaattttttttttgtttttttttttgtttttttagtggagatggggtttcactgtgttgccaggatggtctcaatctcctgacctcgtgatctgcccaccttggcctcccaaagtgctgagattacaggcgtgagccaccacacccggcctgaaccttttattaatatatgatgtcctttgtctcttgtaaccgctttcagtttaaggtctattttggtcagctacagtaactcactcctataatcccagcactttgagaggctgagacaggaggatcacttgaggcagaagtttgagactagcctgggcaacatagttagacccccatctctacaaaaaaatttaaaaattagccaggtgtgatagcgcatgtctgtagtcccagctacttgggagtctaaggcaggaggattgtttgagcccaggaattcgaagatacagtgagctatcatcatgccattgcactacagcctgggtaacagcgtgagactctctttcagtatagctcttttggttactatttggatgaatatctttttcatccattttcagcctgtttgtgtatttagatgtaaattgagtctctagtagacaagcatatagttggatcaggtttttaatccattctgtcaatccctgtcttttgattggagagtttaatccatatacatttaaagtacttaactgatacagtggcacttacttctgtcattttgctattagttttctagatgccttatagcttttttttgtttgtcattttctgtattgctgtcgtcttctgtgttgattttttgcagtgaaacatttatattcctttctcattcccttttgtgtatgttatatagctgttttctttttttaaaattattatactttaagttctagggtacatgtgcacaaagtgtaggtttgataaataggtatatatgtgccatgttggtttgctgcacccaccaactcgtcatttacattagatatttctcctaatgctatccctccgccagctcctcactccctgacaggccccggtgtatgatgttccccgccctgtgtccaagtgatctcattgttcagttcctacctatgagtgagaacatgcagtgtttggttttctgtccttgtgatagtttgctgagaatgatggtttccagcttcatccatgtccctgcaaaggacatgaactcatccttttttatggctgcatagtattccatggtgtatatgtgccacattttcttaatccagtctatcattgatggacatttgggttggttccaagtctttgctgttgtgaatagtgccataataaacatatgtgtgcatgtgtctttatagcagcatgatttataatcctttgggtatatacccagtaatgggatggctgggtcaaatgttatttctagttctagatccttgaggaattgccacattgtcttccacaatggttggactaaattacactcccaccaacggtgtaaaagtgttcctgtttctccgcatcctctccagcacatgttgtttcatgactttttaatgattgccattctaattggcatgagatggtatctcattgtggttttgattcgcatttctctgatgaccagtgatgatgagcattttttcatgtgttttttggcagcttagatgtcttcttttgaggagtgtctgttcatatcttttgcccacttgttgatggggttgtttgtttttttcttgtaaatttgtttgaattctttgtagattttggacattagctctttgtctgatggatagattgcaaaaattttctcccattctgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttatggttttaggtctaacatgtaagtctttaatccattttgaattaatttttgtataaggtgtaaggaagggatccagtttcagctttctacatatggctagccagttttcccagcactatttattaaatagggaatcctttccccatttcttgtttttatcaggtttgtcaaaaatcagatggttgtagatgtgtggtgttatttctgagggctctgttctgttccattggtctatatctctgttttggtaccagtaccatgctgttttggttactgtagccttgtagtatagttgaagtcaggtagtatgatgcctccagctttgttctttttgcttaggattgtcttggcaatgcgggctcttttttggttccatatgaactttcaagtagttttttccaattctgtgaagaaagtcattggtagcttaatggggatggcattgaatctataaattactttgggcagtatggccattttcatgatattgattctttgtatccgtgagcatggaatattcttccatttgtttgtgtcctcttttatctcgttatttcatcgagcagtggtttatagctctccttgaagaggtacttcacatcccttgtaagttggatccctaggtattttattctctttgaagcaattgtgaatgggagttcactcataatttggctgtttgtctgttattggtgtataggaatgattgtgatttttgcacactgattttgtatcctgagactttgctgaagttgcttatcagcttaaggagatttggggctgagatgatggagttttctaaatatacaatcatgtcatctgcaaacagggacaatttgacttcctcatttcctaattgaatatcctttatttctttttcttgcctgattgccctggccagaacttccaacactgtgttgaataggagtggtgagagggagcattcttgtcttgtgccgattttcaaagggaatgcttccagtttttgcccattcggtatgatactggctgtgggtttgtcattaatagctcttattattttgagatacgttccatcaatacccagtttattgagagtttttagcatgaagcgctgttgaattttgttgaaggccttttctgcatctattgagataatcatgtgttttttgtggtcggttctgtttatgtgatggattacgtttattgatttgtgtatgttgaaccagccttgcatcccagggatgaagccgacttgatcgtggtaggtaagctttttgatgtgctcctggattcggtttgccagtattttattgaggattttcgcatcgatgttcatcagggatattggtctaaaattctcttctttttgttatgtctctgccaggctttggtatcaggatgctgctggcctcataaaatgagttagggaggattccctctttttctattgattggaatagtttcagaaggaatggtaccagctcctctttgtacctctggtagaatttggctgtgaatccttctggttctggactttttttggttggtaggctattaattattgcctcaatttcagagcctattattggtgtattaagagattcatcttcttcctggtttagtcttgggagggggtatgtgtccaggaatttatccatttcttctagattttctagtttatttgtgtagaagtgtttatagtgttctctgatgatagtttgtatttctgtgggatcggtgatgatattccctttatcatttgttattgtgtctatttgattcttctctcttttcttctttgttagtcttgctagtggtttatcaattttgttgatcttttcaaaaaaccagctcctggactcattgattttttttaagggtttttatgtctctgtctctttcagttctgctctgatcttagttatttcttgccttctgctagcttttgaatttgtttgttcttgcttcttttaattgtgatattagggtgtcgattttagatctttcctgctttctcttgtgggcatttagtgcttatgctgttttctttgcacttatcatgaggattatatttaagatcctaacgtggtaacacaataatttgaatttataccagcttagctttcttttcttttatttttttttttaagtgaaaacaagtttattaagaaagtgaaggaggccggatgcggtggctcacgcatgtaactccagcactttggaaggcccaggcaggcagatcacctgaggtcaggcgttcaagaccagcctgaccaacatggtgaaaccccatctctactaaaaattcaaaaattagccaggcgtggtggcacatgcctgtagtctcagctacttggaagaatcgtttgaacccaggaggcagaggttgcagtgagccgagatcgtggcactgcactccagcctgggtaacagagtgagtcttcatctcaaaagaaaaaaaaaaagtaaaagaataaggaatgacctccagaggcagagcagtgacagcttaactttcataacatagaaaaactctgctcctttccagcttagtttccatccctttcagttgttaatgtcacaagataatatctttatacagggtgtgtccaaaatataaactaatacttttttaatgcagtaatctctcaaattatgtaaaaaaacaaaatatggagttataaactaaagttacaataacattagcttttagactaattttttttaatgtatcagtctcttaacgcagaaagccaaaagtggagctacaaaccatggttacaaaagagttacgaaccatggttacaaaaacccctgtaaatacatgggcttttttttttttattttttatttatttttttattttttgagatggagtctcactctgtcacctaggctggagtgcagtggcgtgatctcgactcactgcaagctccgcctcccggcttcacgccattctcctgcctcagcctcccaagtagctgggactaaaggcgcccgccaccacgcctggctaatttttttgtatttttagtagagacggggtcccaccgtgttagccaggatggtctcaatctcctgacctcgtgatccaccctccttggcatcccaaagtgctgggattacaggcatgaacagtacatgggcttttataatttgccatatatttacctttactgagatctttatttcttcactcaactctctagtgtgctttcatttcaacctgcaggaccccctttagcatttcttgcagggcaggtctagtattaagaaactccctcagcttttttttttttttttttttttttttttcctgactgatacgcttaatttctccctcatttttgaaggatagttttactggatataaaattcttggttgacaggttttttgttttttgtttttttttcttttagcagtttaccaccttatggccccctaggtttctgatgagaaatctgttgataatcttattaaggttcccttttatgtgataaggtgtttttcttttgctgctttcaaatttctcgttgtctttttgtttgttttttgagacagagtctcagtctgtcacccaggctagagtgcagtagtgcaatctcagctcactgcaacctctgcatcccaggctcagatgatcctcctgccttagcctcccaagtagctgggactacaggcatctgccaccacgcctggctaatttttatatttttttgtagagatggggttttgccatgttgcccaggctggtgtcaaactcctgacctcaagtgatctgcccaccttggcctcccaaagtgctgggattacaggcgtgagccagtgtgcctggccctttctaaaggttgattataatgtgtcctggtgtgggtctctgaatcctgttttgagtttgttgagcttcttggatgtttgtattcatctctttcatcaaatttgggatgtttttggccattgtttcttcagatgttttctctccctttctctttctgttttccttttgggactcccacaatgcatacggttatccacttgatggtgtctcatcaatcccttagatcagttcacttttccttaatcttttttctttctgttcctcagactagatagtattcattgtactcattattcactcattctttcttctgcctgctcaaatctgcctttgaatccctgcattgaatttttcgtatcagttatttcagttccagaacttatttttcatttctttttaggttttctgtctctttattgatattttccatttgtttatacattgttttcttggctttctccatgtctcctttagctctttgagcatctttaagacagttgttttaaagtctttgtctagtggatttgccattgtcttttttcagggacagtatctgttggtttatatttttcctttgaatgagccatacttttctgtttctttgtatgactggtgatttttttttttttgaaaattggacatttaaatccagtaatatggtaactgtggaaacagattctcccccttctctgggtttactgttttttgggtttatttttggtattttgattgttacaggatgtgtctgtgccaagaatcagccagaggtatacatgttaggtctcctcagatcttttctgagcctgtgctcttccctgggcatgcatagcaactttctaatttcccctatatatgtggttgcttttgaatatcctggtctttaatgtccgggtcccagagagggaaaaagaaaaaagtgaaggagggtgaaaaaaatgctgccccctttaatcctctgaaagtcacttcagcgtgagtgggaagaccttgcagcagtgtggtggaggtgcaacaacagtgattaccgtctgtgtctctgtctgcacctttgtgatcagaagcagccaacattgatcagagcatagattcatatttagaggacagggtccttttctcccctgctgtctcccacaaactgtgtgcaagccactccaggaataagtgcgtagctgcctgcagtggggatgggagctttgagatggctggtgctattatgatgacagctgaaatagactgaaagtaattataattcatcatccaggccttcctctggatgttgcaagccttcaatagactctagagctacaaaatagttacatcagacagagtgcaccagtgcaattatttagttgggaagataaattcctggtgcttcctaccacagtcttccccaaattccctttttagttactttttttaggaacccccatactgttttccccagcaggtgcaccattttacattgtcaccagcaatgcacaagggttccaaggatatggagaacatccttgccaacacttgttattttccattgtttggataatagccatcctaatgattaagtggtatctcattgtgttttgtatttccctcatgattagtgatgtcgagcatccttcatatgcttattggctgtttgtatatctcctttggagaaatgcctatttaaatcctttgcccaattgtgtggtttgttgttttatctttttaaatttagctccttttcatatttgccttccttataaataactcctgcttcttctggtaatctgcttgaggaatgagatcatttctttgctatttcctacagtgctagtacatagtagtgtgtgcctggtaaacacttatagtggtaggataggccagtcatacagccagcttttgaaagcctgcttaattgactactacagttggtgactggggactttgagacagtgaggaaattaacacgaattgtgtgcctcctctttgctaggtgctgtggtaggcataactttatatagttcccataatactcctttaatatgtcacacttacagatgaaggatttgaattaagggaagttaaatttagactccctcaacatcacacaggttttaaatggcaatccttggattccaattccgggtctacctgactccaaactttttcattataccatgtggtctcccttccctagtctggtaagttcaaacagagagcaagcctgcgaacctggaaattgtttagggcagatgagcagttgaacatttacttaataggagacagagaatcgtgctatattgccgaggctggctttgaacttctaggcttaagcagtcctctcacctctgcataccaagtagttggtaactacagcctattccattttacttaattattcaagaggaaaaggtagagattgtgaaatgctaattttatagcagtgaacaggattcctcgaagacactgaggtgtgtcgtttgtggatactgatgacctttggaaatactgtgtctacttttgggtgtgacatcctctgttcttgtttctttggtaccataaattagggccactggccatggccaaatgggtgcctaacacagaaggatgaagtgcttttcattgcttaccacaaattcccttgaaccctttacttctctgagacttaagaaatgcaagaataaagggaacagagttttatcaaaatcctattgtgtgctaggcaaaccctagaagggacatgattattatcttgcttttacatatgagaaaattgaggctcaaagatgtaagataaattgtccagattcacacagctaataaataagggagctgaattcagctttttccatgctgcctccattaaaaagttcctctgtcttgccctctggtgggtttcggaggtcctgggagaaatgtttgtatcctcaccaaacattgtggtgggtggcatcttacatggggcttgttctgcacttgcagtttcttctgccacatggtttaaccagagcaatgatgactgccgttgccccctcgaggttagcactcctctgaggtcacagggtggggataaatgttctgaaggaatcagccttagaaagcacactttttctaagtatcccgaaggaatcaatcactaacgcacatcacaaaattctctccaagttgggaagatggttttagactttctctttcttttctttttttttttttttttttttttttgaggtgggagtctcgcactctcgtccaggctggagtttggtggcacaatctcggctcactgcaagctccaccttccaggttcacgcctttcttctgcctcagcctcccaagtagctgggactacaggcacccgccaccacgcccagctaattttttgtatttttactagagatggggtttcaccgtgttagccaggatggtctcgatatcctgaccttgtgatgggcccgcctcggcctcccaaagtgctgggattacaggcgtgagccaccgcgcccggccagactttccctttctttaagaagagaagggagtgcctttgagaactagagtttaagtaaaggatacatatagcttaagtgcttttatctttgaaatatactatgaccaatagactcgaaaatttcttattgtttttgggggtatcatagtcaatttgggctcctataacagaataccataaaccgggtggcttaaacagcaagcatttatctctgatagttctggtggctgggaaatccaaggtcaaggtgccggcagatttgcctctgccgaggacctgctccctggtttgcagatggctatcttcttgctgtggcctcacatggctgggaacagaaagagtgaggggaggctctcacatctcttcttctagtgacactagtcccattcatgaagcctctatactcatgatctactcacccactaaggtccccacctcctaataccattacactggggattaggatttcaacataggaaatttggggaaacacaaacattcagtccatacgggggaattttcttttttcagaatctgttgtttaattataccttcacagtaacttttgtcaaagttatatttaatttctacttcctggattctgtagcagtaaatggagctcgttatgtgtcccaatatttgtaatactgatttctagtcctagaagtatctaagcctctcagagttaaggaattcggtttggtaataggctaagctaatagccatatggctctgcactgtgctatagagaaactgtgggtttccccccacctgacatctcagaatgaaaaagatcactctgcagaatatttcccacacttctaaccctgatgatttttccactcaacattttacacaaagaggtaggtacagatggtagtttgctggatctctggaatattcagtcttggtcttcactcactccctggagcctactcctcatttttgtataagcaaagtggtttaaacagggtcttaggaaatatctccagtatttaccatttgcaaacctaacccttaatatatggaatctgttagatcaggtttttaactcagtaaacatctttgggtgcatccccgtattaaactaaagaagaagtagaaaactgaaggcaatggccctgttgcttaactgtaaggaacatgtaatttagaaacttcttctctttaacatggaaaactaaccataagtatgtggatcaacgttcttctttatggagtattaggagtgaagtgtcatgatgttatggtgtttttaacggctcagcaaaagaaaaaaaattatatagtgagatgaagtagatatgacaaaatattagttgttgaatctaggtggtgggtatttgggtatacatttttcccctacttttctacatttaaaaattttcataataaagggtaaagcagaaaaatcctaagtgtaaaaaacatttataaaactatacaaaaaataatttcaaggttcattctctattaatggtattggagttggtaggaaataattaaaataggagtataaatccagaagcccgcagaggccaggcaggtaatgtgggtgagtggagctgccgggcattggacaggagggagatggtggggactgagcaaacaggcaagtgcacaactcattgaaagcattccaaaaatttaaaaaatcttaatgctcattcagaatgaaacacttcagaggactggaagtttgtggtctcctaaaaatgacaaaatttaccgtctctaaatttgcccagctttctgtccttctccctcttttcagaagatccaggagaggcgtagctatcaatacgagagggagatggtttcctggcacaagagggtgatgggaaaacattgtgttcaatgcctctagaatttgcctgggttgccacaactttgttgcttcaggaatggaaaatgtggcccatcttcttattttctctgtcctgtcttgctcctgctatgacccggggcaggatttgcggtgggtttatggagattcctatgagtcaaggaagcacattctgaggatagagtcatgcacctgggttttgtttttagatggttagagggaggctgcaattgtgatttataagaatgacttaaagtgtaattcctttgattttgaagttggctaggcaacttaatttgaacatcctagtgtgcctattagacctggcaaccttctcaaaatccccctcctacttccctcgtttccctcaccctccacctttttctcaagaggtagaagtgagagttttgttttgtgagctaaggttgggttctgggccctctgcttcagccacctggcagcttgggctggccctgtagccttcctccacttcattctgcgattcaggctcccaatagtcttctgaagcaccggagagcttcctcatgcaccttagaagagcagattcagactgagacaaggactcgctcttaggcatatatgcagcctacagagatcctgggaagcctttttcctcctaatatcttcctagacttatgctttccttggaattccagcaatagaactgcatactcgtaccctaatcaagaaccttttatgtactaggtgctctactagacatgagataaaaagataagcaaaacgtggtccctgtcttcaaccagctcaccatttgttataccactttaatcaccttagagaaaatttttttttttttttttgagacagagtcttgctctgtcacccaggctggagtgcagtggcaagatctcggctcactgcaagctctgcctcctgggttcacgccattctcctgcctcagcctcccgagtagctgggactacaggcgcctgccaccacgcctggctaatttttttatatttttagtagagacggggtttcaccatgttagccagggtggtctcgatctcctgacctcgtgattcgcctgccttggcctcccaaagtgctgggattacaggcgtgagccactgtgcctggccgataaaatgttttaagatgtgttcggccatatgaactttggtgagaattaaagatgaggtttttacttatggagtagggggcacttgggatgggtgaagaagggagaactgccctgaagttcttactcatagatgaggaaaaacctcagctttttgttaaaatgagtttatttatttaaaaaatatttaagggggaaatgcattcatttggttaaaaaaagttctgttaaaagtatactatgaaattccccctctttaccccttgcctccatctaattcttatatatcatttcagagtttatttatgtaaatataagtaaatctgaacatatactcttgtttacttgcaccccaacccccatttttatgcaatgatagcacactctatgcatctatataccttttaaaaattttatcttatggaggtttttttccatgtaagtacatagagagcgccctcattcttttctttgttcatgtaatactatttatagatataccctgatttaattaacaggccctctattcagggacattgtggtgtttgctgacctttgctgttacagtcactgctgcaatgaatactcttgtatatacatcatttagcttgtgtgctactgtgtgtgtaaattcctagtggtgaagctgttgcatcagaggctatgcatttgtaattttgttatccatgccaaattgccctcctccatagggtgttaacaacttacacactaagcagcaaaacctctttcctcacagctccacctacaaagtatttttcatgcttttcgtttttaccaatttgacaggtgaaaaatgggcttgtggtaaagtttcaatttgtttttcttattataagtgaggttgtgcatcttttcttatagttgaggtattggtatttccttttctgtgaaatatcttttcataacttttgttcatctttcttttgctaattcttttttttttttttttttgagacggagtcttgctctgtcggcaggctggagtgtggtggcatgatcgcggctcactgcaagctccgcctccgggttcaagcgattctcctgcctcagcctcctgagtagctgggaatacaggtgcctgccaccatgcccaactaatttttgtatttttagtagagacggggtttcaccatgttggccaggatggtcttgatctcttgacctcgtgatctgcccgcctcggcttcccaaagtgctgggattacaggcgtgagccactgcgcctggcccttttgctagtttttaatttgccaatttcttttcttgtttttttagagatggagttggatcttggctcacttcagcctttgcctcccgggttcgagagattcttctgcctcagcctctcaagtagctgggactacaggtgcatgccaccacacccacctactttttgtatttttagtagagatggggtttcaccgtgttagccaggctggtcttgaactcctgacctcaggtgatctgcccgcctcagcctcccaaagtgctggaattataggcatgagccactgtgcccagccttatttgcaatttctaggcactctttatatattaggaagtttaccctatgtgatatgagttatcacaataggaggaaaaaggcttcctggggtctctgcaggttttttattttcctcagattttgggtattctttttgtattttaaattttaacttgtgtttgttgtcatgaggagtcttggtttttgtattgttgaatttatcagtgtttcctttatggcttttgcattatcctggtccactgttaatggcacaaaatcgttcattcctttttccatggtgcctccttcctcttttcctctttcaatttcggattgacagcaaaatgcttttggtatcttctcccaagtttgcgttcctggaaatgtatttcttgtcagtgatagggtagcccttgatagttttgttaggagattttagtggtctgtagcattcccattttcttggtacaggcactctgggaaactgacagtttcttataaaactaaacatgcaattaccatatgacccagcaattgcattcttgggcatttatcccagagaaatgaaaacttatgtttacacaaaaacctgtacatgactgctcacagcagacttgtttgtaatagccccaaactggaaacagtccaaatgtcctccaatgggtgaatggtttaacaaactctgatacatatataccatggaatactactcagaaataaaaaaagaattaaccattgatatatcaacaacatagacacatctctaaagttttatgttgggcaactaaaaagattcaatcctaaaagcttacatcatgtattatttcatttatataacacttttgaaaggacaaaattttagaaatgttgaatggattaatggttgccagtgttttaaagatggaaagggggatgagagaaagagtggggtaggtatagttacaaaagcagcacaagaactctttgtggtgatggaacttttcagcatctgaccatggtgatgaatacatgaacttgtgtataggaaaaaaaactaaatacagacacaaatcagtgcaaataaaatgaggaaatctgggctgggcacagtggctcatgcctgtaatcccagcactttggaaggctgaggcagctggatcaccttaggtcaagagtttgagatcagcctggccaacatggtgaaaccctgtctctactaaaaaatgcaaaaattaggcaggaatggtggcacatgcctgtaatcccagctactcaggggccttgttcaattgcttgaacaaggtttcagtgagctgaggagatcattccactgtgctccagcctggaagacagagcgagactgtgtctcaaaaaaaaaaaaaaaaaaaaaaaaaaggaaatctgcccgggtgcagcggcatactcctgtagtcccagctacttgggaagccaaggtgggaggatctcttgagcttaggagtttgaggccagcctcagcaacagagggagataccatctctaaaccaaaaaagggagggatgggtaggatctgaataaggtcagattatatctatgtcaatatcctggttgtgatattgtaccatagttttacaagatgtttccattgagggaaattgggtaaaggggacacgggatcctatacataggatctcaataaaaatttcaattaaaaaattcccaatttctgctaatactggattcaccaaaacatactgcctggaagcaggttcaggtcaagtaactggtgctctcctgtgttaggacttgtagtgcagcagctgagcagtggaatgtggaggagcctagcagtgcctcgggttccagccctgtatgctgctctgtctcagaagatctgagagcatcgaccagcatttcccaggattctctgggacaacctagctgggtagcccttcatacagcctgtctggagggagagaatactggcttcagctctaatatatcagaacagtgtggtgtggatgttggtggttggggacagtgaggggtggacattggtggttggggtcggtgaggaagggttcccaagatgagctttggccaggtgaggtggcttacactgaggcgggaggatcgcttgagcccagaagttcgagaccaacctgggcagcaaaaccctgtctctactaaaaatacaaaaactagctggctgtggtaacaagtgcctgtggcctcagctactctggaggctgaggtaggaagattgcttgggtccaggaggtcgaggttgcagtgagctaagatcacgccactgcactccagatgggcaacagagcaagactctgtctcaaaaaaaaaaaaaaaaaaaaaaagctttgctgtgccctgcacgtgacctactgtcatatgtattctgtgttccttgtgctgtagcattggctctgctgtgagacagaatggtctggcatgtggtagggcgatcactgggatccccaagaccctgctagggaatctctgaggtcaaaactatgtttgtaataatacttagacattatttgcaaaacatgctcattctcttacagaagtgtccagtggagttttccagaggctaaatgatgtgaaatagcaacagattaaatgcagaagcagctatgatattccagctgttttctattaaggcagacattaaaaagacattaataaaaataaaccagtggcatcatttcacttttttggtttggaagaatattttccttaaaatgttatttttgttaatgtataaaggggttatcattatatttaaatgatttaatatttaagaatgttctcagttttaatttttataggtgaatatcaaaagataaaactcacataaaagctctttggggtccttggtaatttttgagagtgtagaggttctgataattgagaactgttgatttggcagaaagcaataggcttaatttctagactgggctttgctttgtgaatgtgggcatcatttggcctcttcaattgatttcttctcctgcaaatgctattaattgccctgctacatacctataaaaatataatcccctatgcaaatacaggggagattaatggttacctggctaagctggtgttgaaagaaaatgtaaagaatgagtttctggcctgttagctgacagtctgtttacttgttaaatgtctccattttagcatctcctagcagtttctgtatacatttgatttctttttctcagtttttcagacaaccattttaattatttttaaaaattatattcccacattttcaattaataagggatttatattcctagtaccttgaagtgatgtgataaggtcaggagctctgttcttggagaaaccacttactagctatgtgacgtttggaaagttacttaacttctctgtgtcttggcttcctcctgtgtaaatggagctaataatacctcactttccagggcagctgtgaatacgaaaaatcgtgcacaagaagcacttagcaaaagtgcttggcacataacagatgccccataaataataattgcaacgattgtcattaacatataacaaaagatgcaagattaaattgaagtcttaccctgtcttcagtgaacttgttaaactactttattcacaagtttattagcagtaattttaatttcatttcatttttttctcctttgaagggctattgagtggccagacttccccaacaaatgccaaattggagaaactggactctcagcaggtgttgcagctctgcctccgatatcaagatcacctgcatcagtgtgcagaggccgttgcttttgaccagaatgctttggttaaacgaatcaaagaggtaatgtgctgcgggaaaataacattgctgactggttgttgtgattctctgcaactctggatgccatcttaagacttgacatttgtcactattgctttgaggagattgctttttcccagcagtaaaatgtgatgatgaaaaaagtggtccacagagctgggctaatttagagtttgaattctgatcaccactgatttgcttggccaagttgcttaacttctctgtctcagtttcctcatgtgaaaaatggggctaatagtagtaacttaccccaagggttgagtgacagattgcttagtaagtgttagctattattagtgcatgtaaagtcctgccatactaatttgctctagccaccattctgtctttgaattgactttaattgtttcctgtgtataatttatattttgtttcccagtagattaaaatttctttcaaagcaggagctttgatacgaaaagctccagtgattcttaatggttttatggaaacaattacgcctatttaacccgcaaagtttttaaaggaaagaagcaatgtaattcatgtgaaagtacttagtaaactgaagcacatgatgcaaatgttgtgtaattatcaatctcagtaaataggtacttcctttaagcacttaaatgtatcattgaccagctgctgcacagcacagttctaggggcataaaggaataagtaagtacattttccaaagtttccagtcaagaaaaactttatattcctgataccttgatgtactgtaatatcaaggaaatgttaggagctgtttactggagaaaccacttctgtgaatggcactcccagatttgtttaacaaagtggccctttaactctggtgagagaagatggacatggagaaacaagtgatggagcaagaatcactgcagattaacaatttgtatttagcaatggaggtagtgtatccttgagattacaaagcagtcattagttatattgacagatttaaatttgccaacacctccaacattttagtgcttagctttcataaaatgttgcatgcatatactcttctctcatgggttaaatactattatttggaaaactattaaacatgacctttgatattgcttttcattgatgtggctttgcaaatattataaacttattttactatattatggtctaccaagctttactttccaaacatgactattcattggcatcatgtgagttttttgtttgttttaatactgagttctcccctcctcccagtaagtctaggtgtggtctgtgaatcattattttaataagatgttatggtttggctgtgtccctacccaaatctcctcttgaattgtagcttccataattcccacatgtcatgggagggacccagtgggaggtaattgagtcatgggggcaggtctttcccatgctgttcgcatgatagtgaataagtctcatgagacctgatagttttgtaaaggggagttcccctacacaagctctcttgcctgccgccatgtaagatgtgactttgctcctcattcacttttagctgtgattgtgatgcctccccagccatgtggaactgtgagtcaactaaacctctttcctttataaattacccagtcttggatatgtctttattagcaatgtgagaacagactaatacataagtttaccaaatgatacaatgccaccctctattacccaggatttgggaaccagtggtcttaagcactatttctaaaataagttctacaaaactagtcccatataaagaggtcaaacgatttgcatattccctcaccaccccttggaaagtcacaaagcgtattatctcacttaaagttcttaggagtctcacaataaagaaagccagacttttgaaacttagttgacctcagaacacttatcttaggtaacatttattaatgtcccataaagtagtgattttagaacattctttgggaaatgctattgtagacataagactttacctttttaatttttttagaaacagagtcttatgctgtcaccgaggctggagtttagtgataacattcatagctcgttgcaacctctaactgctgggcagaagcgattctccaacctcagcttcctgagtagcttaggactacaggtgtatgccatcacgcctggctatgttgcctaggatgttttcaaactcctcagctcaagcgatcctcccgcctctgcctcccaaagcactgggattacaggtgtgagccactgcccctagccagactctaccattttttacagttgtgctagaagttaattaactatgacattaactctcagagaggagatcttagaattataataaattggctttttgatgcttattctttttaaaaagtcctttaagttcaagaccagcctggccaacatggtgaaactccatctctactaaaaatacaaaaattagccaggtgtgatggtgcatgcctgtagtcccagctcctcgggaggctgaggcacaagaatcgcttgaacctgggaggtggaggttacagtgagcccagatcatgtcactgcactccaaccagggcgacagagccagatttcatctcaaaaaaaaaaaaaaaaaaaacgaaaaacaacaacaaaaacctctaatccatatctgttgttttgcagtttagtaaagtgtggtacggagagattaactgactagctctatatcagagagctggggaaagtgttttgtagctggaagtaccagacagagcttctcattatagcacattttcaagacttcagagcagtgtttgtcagccctggttacatgttaaaattactcggaagttttttcctccaatatatatgatgggaaattttacacatatactgaagaagacagggtaaaagaaggcggagtaacacagtgaaccttaatgtactcattaccagccactacaatcatcagcttgcaaatactcctgttttatccatatccccactccctgccaccctcaactgtatattttatagtaaatccccagacattatttcattcataaatatttaagtatatatctttaaaagtgaaggattcttttaaaaaataacttttaaatttgaattaattttagacttggaggaaagtcacagaaataatttgagagtacctatataccctgccccatgcagcttcccctaaagttaacactttacataaccttcgtacaatgatcaaaaccaggaaattagcttggtacaatactagcaattaaatggaggccttattttgaattttaccagtaattccacgaatgaatgactgagtcgttttgaaagatgtagttataatgctgttatacctaaaatatttaacaatgataccttaattcattcagcatagctgaggtgctgttaagaaaattctgatgtctgggtctcactccgaaccgattagatcaaaatctttgaagggtgatagggttagggcggtgggatgttgggtattggtatttatgaaggtgctctaggtgattctagtatgtaaccaggggagaaccagtgttttggagcattcatttaaaaataaactgactttggcgggcgacatggctcatgcctgtaatcccagcactttcggaggccaaggcaggtggattgtttgagcccaggagttcaagaccagcctgggcaacatggtgaaaccccatctctacaaaaaagaccaagaaaaaaaacaaacaggcatggtggtgcgtgcctgtagtcccagctacttgggaggtgagaagatggtttgagctcaggaggcagaggttgcggtgagccgagatctccactccagtctgggctacagagcaagaccctgtctcaaaaaataaaataaacagtttaaaattctgtttgaagaactttgggattcactttgaatagtcagtaattacccaggattattgcaaaacagagaccagcactcacagtactgagcaatacctcagcagcgtgctcgggcagaggaggtgagtgcagttttggggctttcattggtggcgtaatgtgtccgtcttatctctgttggtgagtgttagcaaactcctgaatcatatccgtccgtctatgttcacctcagacctaagggttgaaattagtcacttccaaatgagtaaagcagaggatgtcattttgatcaaacaccaactctctgatattattccagatgtttcctggaaatttggttggaaagatgaggaagtaacataatgctatgtgttgacaagtgagggaacttaataaccatggagaatatgtgttagtggaagtatataaccgggatcaactagaggtccctaagattacagtacctgtgatcacttaagtctggatcaaagggaaacatggctataactatttctgattcagataaaggaaaatcagagagttagctcagctttccttatgttaaatttggatgatgctcttgaatgaaaagcttatgtttatagatttgtgtatgtgagggagaagaacggaggtaatttactttgcaatcagggagtctagtgacataccttaactactagtttctttaatggcgataggctgacccctcagccagcactgttgagcagctattgcagacccacctagtggggaggtcctttgggggttccagagacatgtaacatggtccttgctctttgagagtttagcctcgctgagggaatgaagatatacagaacagaaatatgaaaaaggcactgttgaaggggaatgctcatttgttatttataactaaagttctgtaagagttaaagattgggatatcctggagcagacggggtttaagctaggtctttgaaaaaaaaaaaaaaaccaggatttgggaaatgagaggaagaggggggcattgctgcaggggaacagcttgacagtcttagaagaaaattaactttggggcttcagggacactgaagaaactggcctgagtttcagtgagcttgctcagagaaatctctgcattaagaaccacagaatgttggaattggaaggaccttagagaccctctggtccagtgctctcattattcagatgcagaaattaaaggcttttacagaaagtaagcacttcgcccaggtcacacagtgaggtagtggccaaaattaagttaaaagtggatgaagatcaaaggggattttttgttatgcaggtggtgcacttgaacatgtttacaggatgagggggaagaggcagatgagacaagatcaaagatgaaggagaaagggggattcttagagcaagatccctgaggaggcaagagttggagccttgtgggacatctgttctgagagaacagggaggacgcaggcaagtttatgacaggagggtccctggcacagatcggtcacacccagcagcttgtatcctctgtggagaagagggaggtcatttgttgagtggtcatggtgactgggtacagtaatgagtgccattaggcattgagggctcagctgaggcagggcaacttgtatttgctctttgtatttgcagacaatttggcagaatggttctgagcgtaaactccagagccacactgccaaggttcaatcctggctccatctctgactacctgtgtgacctcaggcaagtcccttaattcttctgagcctcagtttccttttctgttcagtgagaacagaatgacatccacctcaggttttcgtgagggttcaatgagttattcttggtacagttctagggaccacgcctgccatgtagtagacactgtagtgttagctctttgttattgctttaaatataaatgatgactaaggagaaaggcctatcctaattgccatgaattggcccatttgaaattacttgataccagcagctgtctaaatattgccccattttaagttctgctcttaacaacccaagtataagcactaaatagaggcaaggcaaaaaaaaaatttttttttttttaagcccactgtggtttccttcaaaccctgcaggatttctttcatgccatgaatatgtagtttttggaatttctgtagtgaatttaactgtttattctgctttgtggatagcatactcgtgcctggggaacatgggtcttgagaaatgtgaagctggatggtggcaaaccattagtccttggcttctaggctgtggatacatggctgcctctgatttgggggatttcctgtatattgcctcatttctagttaaggattcaagttgacagacacttagttttaggttacatctatcattgaaatgtggggtaactgaaaagccaaccagaaaggagtgtgcttcctccccaggtgtggtttccctgggggcgagggatgaggctggtggcaaatacgcagccccaggaagatgcagcacagacttttggagcttctcttgtcacttccctgggtcttacttctgcctcattctagttgctgtcagtgggtaaatgtgttcatagattagaacaagttgcagcacagacttttggagcttctcttgtcactgccctgggtcttatttctgcctcattctagttgctgtcagtgggtaaatgtgtcatagattagaacgcctttgtaactaagataaagccacaagctttattttgttacagttcctgtgtgcttgcttgaaggccttgagagtacattcatgatatgattctagtaactcctgttttaattcttagatgtgttgataagcatagtgtattgacataaaccagtatgaagcatggagggggttcagatgaactggtaagaaaaacttgcaatccttggaaagccatatgattacacaggattatgaagaggccctaaggtttctctaatttagccctttcattgtgcaaataaagaaaccaaggatcttcgagtgtatatgggatttgctgggtatctttccattagataatgactaagatggtattagaaggtgagtcatcttttccactgcaccatactacttatgttctgcctctttggagtccttcatttcatttttggttattcctttttttacatggtaggtcctcaactggtgtttgaaggaatgcacgagagttgccattcatgggcctgcacacagggctgggcagggatttctttctgtcatcggtaccgtaatgtttaagacccagctggagtcattttccaagtatttgacctgacttcctgtactgtgtgtcctcccagggagagagactgatccagattaaatgagtagttccgagtgttgcacagagcatcactgtctgaactggcattagcattcactttgagctcctttggttaaaagcctggttagcgtgagctgttggccaggtgaaactgttgctatcgccctgacactgtgaaccgaatctcctttaaatgacaacattgttagagtcctgtggccgcttttaaatatattttggcttcagttgcttctttcttgacctgaaattataaaatgagttgggagtacctattgcaaagctgcaaattttgacaagaacattgagatgtcggcttctttttgctgaaatcctgaggcaagacatttcaagaaaattttatgttcccatagaatgtcacaagttactctggcatcaattccaggttgaaaccttacagtgtaattatagtttccccccttcttgtcctttgggcaacctttcttttctgtaagaaatacaactggtcccctgggtggcaggaaatccaggtgggggagtgggctgcttctggttcggcggactgtaaggtatgctgcacagggcttccttgggcctggccccacacttcctttgcaccagcactgtcctgccaaaagccagaaatcctggaagagggccgaatctagtttattacttgcctgttggaaatgtaggcttgtgttttttggcaaggcatgagcagagcccggttatttgactgctctgagatttaactccattccgcttttggacaatgacatatgagcatgtgtgaacagcagccccatttccccccagtttgcctgccctagacatgccctcagacagctggctctgccagctttcccagtgccaggttctagagcccctgttcttctccctcccctgctcatttccagtccaccagagcgggcagtgtcagaggtcccatgcagcctcctctcttgtgaggaaccccagagcacctgtagtctctaagccaactagccagtattgagggctcctgggttatggaaatgaaaccagggctgggaaaagatattccctgtcctgtatcacttccaatgaagagaaacaagaattttagcaaattgaacattgctgcagtgcctagaacaatgcctggcatgtagtagatgttgaataaatacttgtttaatgaacaactttatattcttcaattatctcatcctagggactgataagttttctcattctatcagagaaaataaaggttatgagggttgcattaggtagagtaagctaggctacagctgtaagtagactcaaagatgtgtaatggatcaaatgcaacagaagtttatttgttgctcttgttcaaggtgggtgtttctggttagcaggtgactctcctccattgagttcagggactcagtttccttctatcttgtggctctgccgtccccaaagaccaccttgctgatagtgtccagtggcaaaagggaaaaaagagtggactagcacagttaggaggttcttacgggccaaacctatgagtgttgcctatgacttcggctagaactcaattacatggccacagctaactccaaagaggctgggaaatacagtctattgtgtgcccaggggtacactaaattttgaacatctgtgtcatcttcgaacttagattcctaaaatgcatctgcagcccagctttgagattcagaaggcctgatgcaaggttccatggtaaattttgcttggtttaagtcctcctgccaatgaaaaccaagtgacattaggaacagatctaacaataagttaaaaaaaaatcaagctataatagtttatattcaatatgatttcaactgtgttaaatattctgtttgtttattttagagcagggttgtccaatattttggcttcccagccacattggaagaattgtcttgggccacacataaacatattaatgctgaggatagctaatgagcttaaaaacaacaacaacaaaaaaaactcataatattttaagaaagcttacaaatttatattaggccacactcaaagctgtcctggactgcatgcagcccacggccgaacaatcttgttttagagacagggtctccctggtctccttctgttgcccaggctggagtgcaataccacaatcatagcttccggtagcctcaaactcctgggctcaagtgatcctcccacttcagcctctcaagtaaccaggactacaggtgtgccacctacctggctaatttttaaatttttttgtagagacagtgtcttgccatattgcccaggctggtcttgaactcctggcctcaagcaatcctcctacccacctccccaaagtgctgggattacaggtgcgagtcatcgtgcctgcctatgttaaatattcttaataaatgattagacagaaggtaacatgacagtgacttaattgtggttgccctttagagatgagattatcagtggtattttgttttagcctgcttctgtttttctgtattttacaagatttctatcttgaacatgcattgctttttttttttttttttttcaatttgaaatacctttttttttttttttttttttttttaaactgatgggtaggctccatcttcagagattctgagccagtgggtctggagtagggcctggtacttgctcttttattttttaatttaatttttttacagagagtgtcttgttctgtcacttaggccagagtgcagtggcacaatcatagctcactccagcctcaaactcctaggctcaagtgatcctcctgccccagcctccccagtagctaggattacaggtgcgtgacactatgcccagctgactttaattttttttttttttttttgtagagacagggtctcgctaggtttcccagactgaccttgaactcctggcctcaagcagtcctcccacaatggcctcccaaatgccaggattacaggcatgagccaccatacctagcttctgttttgttttgttttgttttgttttctcacagtatgtgaatctcataagagttccatctccctgcctgcagctttttgactcaccaggataggaatatgcctctgagaactttttacgcacatgcctttacatgtctgcttcatttatgaactagtcagctctgtgtcaggccctgttgtaggtgtcgaggaaatatcactacaaaacagacaagaatccctccttcagagaccttacattccattgtggacacagacaataaacacggtaaaaaaataagatagatggcatgtaagatggtaaatacaagaataaaaaaaaaaagtaaggggatataaaatgtcagtagggtagaaattttacatggggtgacacagaaggccttcccagaaaggaacttttaatataaagacctgctggtcagtacagagctagccaggagactcttctttataactctgtctagatctgaaatttatcaggttatttgaccaatggcaaccccaaatcccaagattctgttctttactatcaccctgctcactgtcgtgtttatctgaatgttctgaactagagtcttatttgctatctctgttgttagttggtaggagacttgcagatctatactccttttaaaaacatctgaattgttttagatctcagggactcccaaaggatttcatcaggaggtgtccctaaagcttgaagcagcatttaattttcttctgcccacgttgacagactgactatagtattataagactttagttgacgtcctggcgatcctccatagttttcatttacacatgagtagagagcatttcacttgtctaaggtcctttcacaccattgctggaaactgcccatgacagccaacctgcagcccagagcaaaaggcataatgaatgtggaaggactctgcaggaccatacggagctatgtaaaagaaaggattattttgggggtgtaagagtcatttatatcaaatgcagccagacaaggagggattgcaaaatgttattctgtagaagtatgagcattagtggcgtaatacagcatcattacagtgatggtttcttcctgtatcccaaagtcccccagcctcctctcttcccctttctacctggaagtttacgaattctctctttgcccttgctgagacttagattctctggagtctgtcactcacctgcctctccatcagatattgtaatagtcatagttgtattctgcaaaatccgtgaaattcacatggctctagcctgaaatgtccagcctccactcctgctccctgacttctgctgtgccccctcctgctggtgtctgctccccttctctgcctgaggaatcctgctctcccatcagcaaccgccaacatcctggcacatgcagaggtcccggtttcccttgatcacaagggacctccttccttatgcctccctggtgcacaggaagtgtttgctggaaccgtttatgtggtaaagttgagtcggtgcctcagccatctgcatgaggaatgacatgggcctctggactctagatcaggctccagcctgatgtcccgagcagccatctatcatcctgcccgggagcacaaggcagccccagtggcagtataccaaatcattagaccaatatcatcattgtcccatgtgcggtatcttggttctttcttcaggcacggggtggaggattttagctgtaaaatatttacccacgcaccactgctaagctctgttctctgagtcaaaaaggggttgtgttcacacatggtttgggtgcatacacgagggaattacagagcacatagtccagttttctattgtttcattaccttagctgaggttttaagatgttaagtgtgtcactttggtcacacaaacttacttttacctctctttaattctggacatcggaaaagggagtccaggttagtggcgtggcttggagcctttccttcactatccacctgctgcatctgtggaggcttctccagcccctcacctgatgtggtagtgacagcagcaataatgttgcagctgtcgtttttacatgtttaccatgtgccaggtctagaataggcattttgcatatatcagctatatttcacgatcagctgagattcagagacctgaatgtgttcccggttacacagttgtcgaagtggagctgggatgcaggctcagagctaacgtccaccttcgaaactctaaagccgcgcttcctttccacctctttgtccattgtcttcaattcttttatttttatttatttatttattttttgagatggagttttgctctttgtggcccaggctggagtgcagtggtgcaatctcggctcactgcaactcctgcctcccgggttcaacggattctcctgtctcagcttcccaagtagctgggattacaggtgcctgccaccacacccggctaatttttgtatttttagtagagatgagttttaacaatgttggccagctggtctcgaactcctgacctcagttgatctgcccgccttggcctcccaaggtactgggattacaggcgtgagtcaccgtgcctgaccttgtcttcaattcttttttttttttttcttttttttgacagattttcgctctttcgcccatgctggaatgcagtggcgatctcggctaactgcagcctttgccttctggtttcaagcgattctcctgcctcagcctcccgagtagctgggattataggcgcctgccatcatgcctggctaatttttgtatttttagtagagacagagtttcaccatgttggccaggctggtctcaaactcctgacctagtgatcctcccgcctcagactcccaaagtgctgggattacaggcgtgagccactgtgcctggccgtgtcttcaattctttaaggtcttattctttcatcctgtctcctgctcatgcccaatgttcaagcatgttcccttaccctgtattcctttataatactcgctgcatagtgtcacagtatacttagcatctcaaaagcagtctttataggatgcaaccacactttaaaatagccctgaagaccccacatttacgttcttgaagtggcaactccgcctaccttgcaggtaacttctttatacttccaaccgtgctttggagaatggggctttttaacagtgtctcagaggactgtggtggtacagaaggtagacagagagtggactcatgcctaggagcttcatccttccccactgccactctggaggggttgcagagagggagcctcgaattagtcagaaagggctggggtgcttggttacagacggggccttttccaggaggcaaaagatctcagatgtctacgtgccctacaccgctgtctttcatgggacccgaggaaagctctcccaaggaacgggaggagtgggacttctgtccctcaggcttttatttttacttgtgatgtttttcttttcctggtttgctgccatcaatgccatttgcaaggccttttgtggggaggaggtataatctgcctgtttagttttggaagctgcttaaaggttttaggatttctgtcccactttcccacctagacgtgatgccaagggtaagaaggcatcggggaaactgggcaagtcgtaaagtaattattggaacagtcatacaattcaaattcctgccgttctgatatcgcttaattcttttgaagacctgaataaaatgtgttctttttctgagacatttagatacattgtttgaacaaaggaaacagggtgacttcaaaatgtccagtatgtggaaatcgatgccgttcagcctgtggtgtaattaatgaaaacattggcgacagtcggcctcattgtttgtcattgtgcaacaggaggtggtacactaataaggagccggggaaggtttacgtaattcagaaggaagcagacgtgtgcagttttgactgatgcccttctcactgcagatccaggctcaccgagcaggttcctattcctgatggacgtggagatgtctgattggattttgtcatttgatttttgacactgattaatgatagatttttatttcccttatggtcagaaataattgtcttgaaaagcttcactttagatcatagttttcacacacagttataattcattgggtaaagcatagtagaacaaactatggaaaaggaaatgtcattggtagactttggtcgcttaggacaggtgtggtggcccttggaatcaggagatctggagttctgtcctggccccatcagtcccagctgtgtgagcttagggatagtgcttgcccactctgggagcagccttcatctgtaaaaggagggggttgctcaggacccttgcacctccttccttttacagatgaagattgctttgtctaagcccccttggtgaggtcaagaattgtgaaatgtttgtacaagtgagatgtcaagagtacaaaatgtacagacgaactgccagtgaaaatgtcatttaagtttatctgctaacagtttattccctttggtctcctctcagtttttgttttgtaattgtccatgttttgtctggtaatttattattttttttattagaaaagtaaacaccaaagtgtttttccattccgcttgacagcataacaaattgccatttaaattcatctcttaaggatttcaaaaaggcattaaacacactgctcaacatggtatgtatttaattgaaatgagctgacttttgaattaattagctctttagaaaaaataggcaaaaatggagccgaaaagcatgggtttgaattctggcttcactgctagtacgagctgtgtgaccctgggcaccttttctcatctctgaatctctaatttctcatctctaataggagagggacactttccctatgagagtgtggtgaggtataaagataatgtatgtaaactgcacagtacagtatctgacagttagtagatacttaatggatagcagctgtaactgttatacattattttattacaataattaaaataactagagaatttgtgtatattatatactgggttctatctaccaaatcattctaatatgatgtgcattgattaccaaaagaaatagtcctccagtatggatgccagttttgtttctgttagagtgtgtggagtgagatttaccagagagggatttctcttttctggttgacagatcaaaggtacgcctatgagaatacatggcaagaatttattcttttttttttttttaacagtgataaaatatactttactttgttgagtcagagggttgtaaaaaaaattattgctaaagtaggtatcaggcaaacagaaaggtgctttagaagtccagttaccttggagtttatttaaactaagagaaaaacgtcataatgttttcatgcgatacatatctggttctttaacaattgtgtgacaaacagcagaaggaattaaggaatgccgcacttgtgatccatacaaaacaccaacactttaggttgtacataattaaagaaatatctcaaacactttttaaaacactgtagtagccaatacatagaggcatgccgtaggtaggcacaggaatgcagtttagaaaaataaataaatcacataggaactactcaatttccttaaaatcactgagcaagaaaagcaacattgaactggctgggcgcagtggctcacgcctctaatcccagcactttgggaggccgaggcgggcggatcacgaggtcaagagatcaagaccattctggccaacatggtgaaaccccgtctaatttttgtactaaaaatactaaaagtactttttttgtactaaaagtacaaaaattagctgggcgtggtggcgctcgcctgtagtcccagctactcaggaggctgaggcaggagaatggcgtgaacccaggaggcggagcttgcagtgagccgagatcgcaccactgcactccagcctggcgacagagcgagactctttctcaaaaaaaaaaattaaaaaaaaaaaaaaaaggaaagcagcattgaactttcatattgattttacacagcttttatacagtaccttgacttaaatccaagagcaaaacttgactgtcctcctctatttttggtaaacttacgtgactttcccccctggattttacctgggagtagcctttttaaatttttatttaaaagagggcaggtttggcactttatagtaatgtcaccaatgttaatatttcttgggatctcaggaagattcacattttttacagctgatacaggttcagcacaggctgaagctccccctcagccagcctcagatttttccagcttattttgtgcaccaatttgtgtaacaatcccattcatgtttgtctccaataccattcccccatcatcatttctgcaagaatattgtgaaccgtgtctacatggaaaatcaaatccagttcacaaacattttcaaaacatttgtctaatgtttccacaaatccatagggctggtagaacttggagagccgcggtttcccatgattgttaagattaggatcgccttgatcgtggctgggtcgggcccaccgggtaggcactgggggccagggtgcgggccggcgcgcaagcctcgcctcgtgatcttgccggcgatccttccccacccactccctcccgcacgccggcaagagtttattcttacaggctgccattgcaaactactgtcttcagaaacaaggtcacttcaaagtgtccagaatgtggtaattggtgccattcagcctgtggcgtaattaaggaaaacatttgcccattgttgtccattgtgctagagagaggcgtccaggaaagattcatactcccaaaccctccatgggagtggtgatctggagagggtcggacagccagaaagcacatagttgaccctgaaaggttttgttgcagcctgtcataccctaacctttataatctgtctgaatctctactgcaggtcaagtagccatggtctggtggggatagaggtggcaggtgggctagaacgtgccatatcttgatttgtggcaatgggcctcctactcttcggagtggagacagctaataccatgagtcaaagaccaaatcgggatagccgatgtataaaaacacaagcaccgggtttgcaaactggaagaaaggtcttgaagaaggtgtcagaagcaaaaaatggtaagtatgtgaggaggtggatattttaattagcatgactatagaaatcatttcactatgtatatgtatgtcaaaacatgtgtgctgtaaatatatagtttttattttttaaaaaatgaatgctgtcagtatgagtccatttaaaaataagcaggcttaaaggttcaaggaaattgctgagaactggcatctcacgcttccttttggggttagtcgatgcatggtatggctaatgtaaagatccaggatcttatgaacacagctttttaccttggactgttcctcttgcagactcagctaccaccttcctttaggattaaaaatgttttacttagcctcaacaatttgttttagagccactttcatagtgcctagtcctggattcccaaataggtttcttcatcttcgtaaactcgaaagtggccatctggggttcagtgtcaggaagggttctgagtccaagtcagatttaaagaataaccatgatgcattactggtatctgtcgggggtctgggagaaggaattgaatgtatttgaatacacttattttattattttttaaaactgagttatcattcacgtagttcacccttttacagtgtgcatttcagtggttttagtattcttgcaagattgtgcagctacaccactatgtaattccagaacattttcatctgcctagaatgaaactctatgtacatcagcagtcactccccatacctctattcccctatcccctggcaactaccagtctcctttctgtctctctggacttgcctgttgggggtatttcatataaagggaatcatgtgatatgtggcccttgtgtctggtttcttttacttagcataatgttttcaaggtttatccatgttgtagcttatatcagtatctcatatctttttatggatgaacaatattttattctatgaatagaccacattttgtttatccatttttcagtggatggatatttgggttgtgtctactttttgcctattatgaataatgctgctataaacatttgtgtacaaggttttgggtgaacatataatttacttctcttgggaatacatgtgaagtgaaattgctggctgtatagtaactttatgtttaactttttgagaaacggccaaactgctcttcaaaatgactgtcccattttacatgcttaccagcaatgcacaggggttccagtttcttcacaccctcactaacatttgtcattgtctgccttttaatttgagccatcccagtgggtgtgaagttgtattctttctgcttttgattgcacttttctaatgtccagtgatgttgaacatcttttcctgtgtttactggccatttgtatatcttctttggataaatggcttcagttataattccaaggccagattttgccctagggacagtactgatttatatagttaggctgactgcttcctaattgggagaattggtagttctgaatttcagaaacatctgagaagggtggatattgaagctttatataaaatatgtagcagttttcttttaatgtgattatgatttgggaactttttagttttactaccatgaaaaacagaacttccaagcatactttgccattcattgttagaataatataaacatacatgtttatagcagtgttctgttttcagatcatcctacatatattatctcattataaccattacaacactgccgtgaggtaggatgaatattagccattattatccccacttttaaaaagtagaagctgagagtcagcttgtgatttgcccaagttcaccaactagtagaatttaaattcaggccttctgacttactttgttaatggtaatgaattattagtgatgtcagggatttgaagggtgagcttacattgctaaaaatcagcaatatgcccatcttcaaataacagattgttactgacttcagaatgtattatttgaatagctgtaaaacaggatgaattgttacttttccatttagcctctttagctacaaagtacttacaataaaagagcagaattacatatcactgcctgctcattacattttgaacccagaaggaaatccacccaaagaaagaacaaagctgggaatggatttagaaccctaaaaagaggcagcctttggttagctgaccttgaaccatccatcatgcctcctcctcccagcctccatattcctaaactgacatccttggggaacaggaatttaaatgtagaacgagtgcagagaaagtgagatatctattgagatcaaataaaaattgaccttgagactaacattaactgacagacaccacattaaaagctaaacattacctttaaagggtgggaaagatgagtgactttttaaatgccgtcttgagctgggcacagtggcttacgtctgtaatcccagtactttggaaggacgaggagggcagatcacctgaggttaggagttcgagaccacctggcctacatggtgaaacgctgtctctactaaaaatataaaaattagccaggcgtggtggcacacacctgtaatcccagctacttgggaggctgaggcaggagaattgcttcaacccaggaggtggaggttgcaatgagctgagattgtggcactgcactgcagcatgggcaacagagtgagactcggtcttaaaaaaaaaaaaaaaagcagtcttgattaagtccatatgcagtcttttttgtttttaacatttcttttaaacttaagtattttggggatagaaaaataagtctattgatcatatggatgtgaattttgttaactgtgaaacacagcttacctactcatttttcttttgaccatgagggttattaaatttgcttttgatcatttcatgcatatctacatcttaagtttttagaatttaaaagttgtacactatctttatgaagttcttactgttatgttgcacatcttttctaacttaaaataagcccttgtagtatgtcactaatttggaaaatttacctttactttgaaaagaactacatcaagcatagtgaggccaggtgtggtagatcatgcctgtaatcccaacactttgggaggctgagcgggtggatggcttgggccaggagtttggagatcagccagggcatcatcttgagaccccatctccacaaaaaataaaaattagccaggcatggtggcatgtgcctgtagtctcagctactcaggaagctgagatgggaggattgctcggacccaggagttcaaggctcccgtgagctatgatcaggccactgtactccagcctgggcaacagagcgagaccctgtctccaaataacaaaccacagtgacatctttcataggatgacccatctgcctcaaaccagcatcaaagcttattttatgaggaaaatttatataacaaaagtttttgaagcaccgtactctcttgttggagaggatatcatttattaaagcttttggttttgctttcaaaatattttttgaaaaatatacatgtacgcatgtacgcctatgtatttttatttttaccatattggatagcatcaaacagtggtaatagttattctcatggctaaacatatagattaaaaacacatggaaggacttgtaggtaaataatgatttcagttattacgtagtgcgaaatgattctatcaggaaactgtgggatgagtaatgtgactctgctgtaagattttcagtagcagaagtacagaacaaaaataaaacatgtcagcaaaaaacacaatggtaagttgtcatctgagtgattgtgtaagccttgaagatagttaatgtaaccgagatgaggcgtccacataagctcctgccttcacaatagatatgttgtgtctatttggatatcacaaaatgtcattcggttttttattctgctttcatgtactacatttcttatcttgctttttcattcttcatgtaaaagaggtttctagacagagtttctgtttcagttcacatatattttatcacttatggagctcctttttcctgggaactgttctaggagttttatacattttatctcatttaattctcacgtcaaccctatgacgtaggcattgtcaatttcaccaattttaggggacagagcagctgagggtcagcaaggttaagtaactggcttaaggtcatgaaggtaatcagtcatctgcagaagcaagattttgactcagttctgtctgatgctactgtcgttatccataagcgatgtatgtatattttagttagaaaactggaatgtttggccgggcgcggtggctcacgccggtaatcccagcactttgggaggccgaggcgggcggatcacgaggtcaggagatcgagaccatcctggctaacacggtgaaaccccatctctactaaaaatacaaaaaattagctgggcgaggtggtgggcgcctgtagtcccagctacgcgggaggctgaggcaggagaatggcgtgaaccccggggggcagagcctgcagtgagccgagatcgcgccactgcactccatagaagctctctcccctccccacaaactctgagtcactcagcttgagctcaggaatgatttcagatgtctaaacaggtcatttgcagggtctgggtagtctgcccacagaggaggtaaaagctctggctcaatcttgaaccattgcaaatttaagccagtggatctgaaggcaattgagttctgttctgccactccagctcaggcaggacagctgcttccctgaaacagggccctctgaggttagatgtacagcctcagtgggcatcagtgtcatgaatagccgctcctcatttggcagcagtaactatccagagacaaaggataggattcgggataaccgtggtcataagctagaagtctccagagtccttagaggaatttgaaaactgaacagaatttttttctttccacactgtgtcagggctttagcaaaggagttctgttgtgacaattgtctgggtaacatctgcctactgttttttgttttgttttgttttgttttgttttcctgatctgtagtccatcttgcttaacagtgcccaagggcacaagcttcacactgttaatagttttactcttaacacctccttggctcctttgtcccaagaaggtgagatcccacttccaggtgatctcctgcaggacttttccctgagcctctaacccatttctagcccatatttccccctcaagaacaataattcagtaatgttttcagttctcctgaaacaatcccaaattttggattttttcttaatgttgaattataagagttattgatatattcattctggatgtaagactgtcatttgatatatagtgaaattttttctttctttgtttatttttgcccattattttcatagggaataaaatattatgaaatgttctcagtctgctgcttgccttttcattttatttcttttcttttctttcctttttttttttttcttttttgagacagtctcgctccgtcacccaggctggagggcagtggtgcgatcttgactcactgcaacttctgccttttgggttcaagagattctcctggctggccacggtggctcacgcttgtaatcccagcactttgggaggccgaggcaggtggatcatgtggtcaggagcttgagactatcctggctaacacggtgaaaccccatctctactaaaagtacaaaaaattagctgggcatggtagcacacgcctgtaatcccagctactcgggaggctgaggcaggagaattgcttgaacctgggaggtggaggttgcagtgagtcaagatcgcgccactgcactctagcctgggtgacaaagccagactccgtctcaaaaaagaattaaaaaaaagagagagatagtctcctgccttagcctcccaagtagctgggattagcaggcatgtgccaccaggcccgactaattttgtatttttagtagagacagggtttctccatgttggtcaggctggtctcgagctcctgacctcaggtgatccacctgccttggcctcccaaacttctgggattacaggcatgagccaccgcacccggccttaatggtatctttttaagagaagtttttagttttgatgaaaatcaatttaaccatttttattttatggttaacactttttgaaacttagaaatctttgcataccccaaggtagcaattttttttttttttaaagacagggttttgctcttgttgcccaggctggagtgcaatggcataatctcggctcactgcaacctctaccttccaggttcaagtgattctcctgcctcagcctcccaagtagctgggactataggcatgcaccaccacctccagctaatgttttgtatttagtagagacgggatttcaccatgttggtcaggctcgtctcgaactgctgacctcagatgatccacccgtctcagcctcccaaagctctgggattacaggcgtgagccactgagtccagccaaggtagcaaagatttttctcctatattttcttctagaagttttatagttttagcttccatatttaggtctgtgatccattccatattaatttcttgtgtatgcactgtgagatgtaaggctccaggttcattctttctctttgtggatatctagatattctagcacaaattgttgaaaaacttttttcccccattaaattgccttgagatctttgtaacaacaataaaaaaatcaattaacaatatatttttagatcatttttacactgtcttttgttttatggatctgtgtgtctctatgccagcaccacactatcctgattactgtagttttatagtaagtcctgaaatcaagtactgtaagtcttcaaactttgttctttcaattattttggccattctgtgtactaagaatcagcttaccaattcctgtaaaacaatgccttctagactttttacttggattgcaaatgaacctcttaatcaatttggcaagcatcagcaccttgaccgtgttgaatctgacaatccatgaacatgatatacttcatttcttgagatcccttttagtttttcagagcgatgttttgtaatatcagtgtacagatcttatacatattttgctgaatttttccctaagtatttcatgttgccgacgcagttgtaaatagtattcttttattccactgtcctgtcattcattgttatgtagaaatacaattgatttctgtatgctgaccatgtatcttgcagccttgctaacttcactttagtagtttttagtagatttttaaagattttctaagtgtattatcatgtcatctgcagataaagacccttttgcttattcctttctaatttctttgccttttacttaatttattgcattggctactgcatatagtacaatgttgaatagaggtggtaagagtgtagacatgcttgccttgttcctaatcttagggagaaaagtgtctttcaccaataactgtattgtcagctggaagtttttcatagatgcactttatcaggttgaggaagtttccttctgttcctactttgctgaaaatttccataataaatgcatgttcagttttttgagtgctttttcttatatccattgagacaatcatagatttctaacctctattctgttgaaatggcaagttactttgattgatttttcagatgtcgaaaaagtgtgtctccttgacataagcattgcttggtcataatgtattatcctttttgtatatttctggattttatttgttaatattttgagttcatgtactgagtggaccagccaagtaggcagatgggcccgcaccatccatataaggtatttggaacaactttgagcacattctacagatgcctaataaccttagtgaggcctgcagttctatgctcaaataacctccccttctttttcacttgtcctttgaaatggactgccccagagatggtatatgaatctgtagggcaaagtttgaagtatgagcttgagtaaatgatgagttccttgaagacaaaggctttattgcattcttttttttttttttttttccccctgggatagggccttgctctttttttccaggctggagtgtagcggtgtgatcacagctcactgcagcctggacctcctgagagcaagcaattttctcacctcagcctctggagcaggtgggactacaggtgtgttccatcacacctggctaatttttattttattttttgtagagatgaggactcagtgtgtcgtcgtggctgctcttgagttcctgggctcaagtggtcctcctacctcagcctcccaaagtactgagatgacaagcatgaaccaccgcacctggccagcattcctatctgtcagtataagattatattaactagtgttacagaaaccccaaatgatggtggcttatacaaaatgaaagtttattcatctctctcaggcctggtctcctcttacacataaacatcctcatggacccaggctgcttctagctcatgatctgccaactcaaagatgtaaccttcattattctcatggtctacatggggtgcacctgcatttcagcagcagcagagtggaggaggggacagtgaagaagagaagcaacaaagagtgcatgccggctgcctttccaggaaggtgcctggaagctgccaggagagacttctgcatgcacacaccactgattataacttggtcatgtgtcacggcaaggcgagggttttgaggcaagagttgtggagaataaagagttgttcactttctatttgaaaatcagctagtttattcatttaatttttcttaagttcctgaaacaaagttatttgcaatttatatgtttctgggcctgagtttcctggaatagtaaagtcatgttaacagaaacagtggaaaagaaaattcatgttaatgtacacggtaagctgtgtgggtgtaagtagttttggttctcaatatctatcctaggacctcgcatagtgcatggcacatggcacgtgatgctactcaataactgtctgttgcctgtgtggtaatagctcacacttacccagtgctcactgtgtgctgggcaggatgataatgttctccttgcagaatctcatttaatcctcaggacagtcttttaagtggccactcttgttatccccactaccttgcagatgaggaaaccgaggcttacgtatattttcattcatttattcaacaaatatttattcaggacctgctatgtgctgggtactggagatatagcagggtttaaagcacaccaaatccttgctctcatggaatcagccttctgggtaattttctaaaatcacatagatactgggtcgagggtagcccttaaacctaggtggtctgactcctgaacttgcaatcttaaccgttgttttattggtagatgaatggattgatgagtgtggtgaacaaaaattgtgactatccatttcacaaacagcttcgtggttgccctttagctccagcttggatggttagattgccctgtctgaagctggatttattttattttatttatttttggagatggagtctcgctctgtcacccaggctggagtgcagtggtgcgatcttggctcactgcaacctctgcctcctgggttcaaacgattctcctgcctcagcctcccaagtagttgggactataggcgcacactgccacgcccggctaattttttgtattttaatagagacggagtttcgccgtgttgcccaggctggtctcgaactcctgagctcaggcaatccgccctcctcagcctcccaaagttctggtatgagccaccacgcctggccaagctgggtcttttgaatggctatgggtgctcagtgaggcaaccctaggtgatatcataacacctctgcttatccagaagacaattagtatatatgttatcttgttagaatccatgtgccaaaaatagaaataggaaaggcaaataaggatatatccctagattgtcaaaatggtgattcagaattgtgtgagatactggtttactgcctacagtcacatcaaatgtgttacaatgagcatgtgtctgggggttcgtggagtaaaggtagggattatggatcaaggacaatgttacctcaagagcaaaggtcagagacatcaaaaataggcatcaacagttttaccatccttttccagatagtccattgttgcttgcaccaagttgagactttctttgcaacaaagaatgggggaaacatttaaaaggtaataactttccctacatgtgatctagtcttctttaatgcagtgccacgtgccaacaaaagtctcataaagcaccagtgatacagggtcttgctcaggaaatatgtgtaaaagaggggagctgctggacttcggagagctggggtccagtgtaggttctgtcactgtgagatcttcaaagtcacgcaaactcaagtttcctcttgcggtttttttcttccatggagcataatggaagtaagacatgatgtcagcacgcatgaacaacctgtttgaactcagtgtgctcatctcagcattaacagaaagtgcctttacaaaagctttggagacattaaacacgggccccagctggatgtggaaacatgtagggaagtacatgccatttgacaagtacctgtgaagatggctgtgaacagtcttcatcaggtgtgaatcggggatggattgactgccaaggactttagacttgataagttagagccttggaggccatttcagatagaaactcttcaagcatctatctagtctggtagggttgcggggtggagggccaggaatgccctgccaagtaaaatgtgatgcccgagaaggttcccaattcaggattccacctggctcccacgagccccgctgtctctcaggtgtgtggagtgtttctcagtgctcattgcaaggccaccctgaaaaggcccagcgggtgactgtcaggaccacaggactctcctggctcactacttccaaagtgctgagcgccagacagggctgcagagaaccccggaaagtgtgcattgtttccacattatttggagtttctcactcccatgttttttttttttttctcttctccttctccccgtgcccaactagctgctcctcctgccctgcaggcactcaagcaagaggcccgccagaggacagcaacactgatgtgcttcggtcgcctcccgcccctcctgccctccccacagatgatagcaaaagggaaattattttttcttggggctggctttggtcccccgtgttttcatgagtttgtttttgtgtctctcgaagccattttcagaggctctctggtaccgggtgttgagcccttgtcctgatgcaaggtcgggaaggggcgtgctccaggaataaaccagaaggaagggctggaggagcctgggaaccttgggataggagtgtgggcctcagtagttgagctgttttctcctggcctgggaaagaaacaaggggtgagggggtggaagtggggtccatgctgaggaaggggtgcaagtgcccaacacgatggcggtctctctctctatttttatctgggtgatgggtactaaagagcctctgtaaggggaagagaagaagtcacgcaagggcagcccagagcccgcagtttctttaatgggggagaagggcacatgagatagtcctcacagtttgacaaatgtggtgtgttgtaaggacgggagccttggttgcatttttggccctggcagggagagcctcccttccattgcagtgttccccgagtgtccgccaaactgcagccgtccagggaagagaaggattgagtgaagaacatgcattttggggtttgggatttttgttattgttgttagaaacagggtctcactgtgtcgcccaggctggagtgcagtggcatgatcatggctcactgcagcttcgaccttctggactcaagccatcctcccacctcagcctcccaagtagctgggattacacgcacacaccaccacgcccatctgctcctagtttttttctagataagcaacctgagacacaaaggataagcattagcagctcatacacgtgacagagccagattcagccttggcctgactgatttccacatccagaattcccctcatatagggagatagaaatctcaggatctcaacaaggtacaaataacgcacattcccagaacatagagccagggacagtcccctctcagttctcttctaaaggtggttctggcacaacagttgataaagctgtgtccctgaagggctttttagccctgggtgcttcctgtaaaacttgtcagcttccactggatctgcgggactgtgtccctcacaggctggacacccggccctgcggagaggacttgattaaacaaggtataatgtacttctctttcccatccacagatggatctgtctgtagaaactctgttcagcttcatgcaggagcgccagaaaagatacgccaagtatgccgagcagatccagaaagtgaacgagatgtccgccatcctccgccgcatacagatgggcatcgaccagactgtgcccctgctggacaggctcaacagcatgctgcccgagggcgagcggctggagcccttcagcatgaagcccgaccgcgagctcaggctgtagctgctgcccggcctgcctggggctgggagccccagacaccgacaccctgaggacgtgtggagctaaggtcatatcatctgaccaggtctggaggctggcgggaggctccctgaaagtgggtgcgaaggagtccggctggcatgaaaatctgactttgcccagctcttttccttgatgcagtttcccggtgtggaaggaacctaaccagttctcggtgataactgaagctggaacgtgtgaattattaggaattctttgaagaactctgcattgagaattatttttatttagtttttttttttttttaattgagagtatatagtccagtccaggtaccggaataaaaatatggagacaaggggaaaatattttacgaagctctgtgttctcaacgccctcatgaacttttcagtaggctgtctggtttatgtgtggtcaacttgaaaaactaattgaatctaggtctctgtattgttcctgtttctaccctgactgtttccgtcacaccaagcccttatctggggcgcgtcttcctgcccaggtggaacactggcattttgttgactgtcaggttaggtgtcccttagtcgtcatcagaagctgaagccttcctttccacaccctcatcagattcatctccactgataaccggtttccttgatgcagacatagtttagctttctttgactgcagagatgtctcattccacagacatttcttgaacccatttgatgtgtccaatattgtgccagggatacaaatatggccgtatagcctcaggccttcatttctgaaaagaaaaaagctcaaaaagctgctgaatttctctgggagtttaggaaaggaagttatttgagtaacaacaaaagtgcttagtgtcgtactttacacatcataggtgttctaatggaagcaaggactggagaagcaaagagtggaatgtgaggagcagacctaggcagacaccttgagactaaaagtcagagctgaagggagtcgctggggccaggacggcatgcaggcctgtaccctgttccctaagttcctgcaagcgtcgggaggtgtgttttcagataccagaaagagccttcagtagattcacaagattaaaattgatgcgcttaatttaatgtatcttggctaaacttgatctgattctaatcttggtttgagacagggtcttgtgctgttgctcaggctggagtgcagtggcgcaatcatagcacactgactcctcaaactcccgggctccggggatcctcacgcctcagactcctgagtagctgggattacaggtgtgtgccaccaaatccagctaattaaaaaaaattaattaattttacattttcaaattcaaaagaataatacaatgaatattcatatttctttcacctagattgacaaaaagtggtatatttaagacatcaccatcattgtctttcttctggagtatacagaacctggttctgaacacagggatatgtttgtagcttcgaggaatgaagggctgtttacagagctacaaaaatagcttaggtgccattatcctcactgcacttaatacaggtgacacatgaaagcacagagtgggtggcagttcaagcctgcgagggccgagcctttccactgctgcagctgttagtggctggcacagggcaggatggcagacctagtgcagcacaaacaaaccacgcagtcagccagctctccagccaactgtgtctacttctaaagtagaagttagacaaaacatggggttcacttagactggggtcctgagtaggtgataggctacttattactgggtggaagcggagaagtatggcagaagaacaataggcaaattcaatactcccggaaagaattctagttagtttaatattttgatggcatgttgtggtttctgcagtgtcgtgaacttggctaaactgaactgtgttcccagaattcccttccttgtttgtttctctggtgagggttggccacgagagagatttgcatgaggtttggaagtggaagtagagcaacagccatgtgtattcactggaagtggatgtaggtcaggccctgttccatcacgtgcacgttaccatggatctcctgcacttgtggtgtgggcagccgctgggcccacggctcctcccactcccgcagaactctgcctttggcttttccagaccctgggccgggtatgagaaccagcttcttggtctgcagccacaaggatgaaggtttggggatgagagaccagcacgggctctgatgagagacaggtgcaggtcccagcttgtggcttgcaggtctcagtcgtacttgctctccctcaccatcctttccaaccgcctggcctgtggtctggtgaagaagaaacagccgaaccgagactttcaccagcccctctaattgctcaaaccgctttcacaatcctctctttctacatcattcctagtggttcttttctgatggaacctctgactggtaacatggcattaccagtcctttccctctcatgttttgctatttcctgatggaacctgggagtctgagtgatttgtatttcaagaagcagttatgctggatctctttgttggttaataccccatgacctatctggccgttatgggatatttcagggataggagttgtgaaagagcccttggctggacgtttctagccttaatctttggcaagccatttcatttccctgagcctcagtttccgccttcctacagcgtgagcaggtctgggtgggctctcaagcccctttcagctctaagattccaagtctgtgattccgatacatcttgactacaatgagcgtgtttaccttttgtctctgagcagtggccctgggtcttggtagtgactaaattccgagctcccaaggtgcagctgcttttcttccttttaattataaattagctgttcattggctgcttctttctagagcctgttttgcttatcttgcaatctgttcatttctgttgatgaacacagtcaaataggcctctatgtgcagtctcctggtttccctggtcaaagtggaaggttggtagaaactggccttcatgtctttgtttccctcaaagttttattcttagtaacgctatatatggttttatagaccacacatatatagtttcctgtgtcttagatgataacatccttaaaatatgaaatatattttgaacctagatacctacccagtattctctgcacagagtaaacatttcattaaatgagtttcaaggactccataccctgatataggagtacattcaagaaatgagtttaggccgggcgcggtggctcacacctgtaatcccagcactttgggaggccgagacgagtggatcacctgaggtcaggagttccagaccagcctgaccaacatggtgaaaccccatctctactaaaaaaaatacagaaattacccgggcatggtggctggtgcctgtaatccccgctacttgggaggccaaggtgggagaatcgcttgaacctgggaggcggaggttgcagtgagccaagttcgtgccattgcactctggcctgggtaacaagagtgaaactccgtttagaaatgagtttagtctgggagaatctgctttttgagtaaaaaagtttgattttatgtatgtgtgcgtctgtatatatgtttctgtatcctgagtatttctttgcggcttcttcagttatgaaagaggttggtactgttacccttacgttataggtattacaaactcggttttacaaggttacataaactaatggccctggggcgaatgacgtatgccacttttgtgttgatttgtagaacttacttagctttggcatttcccctagtaattcccaaggcaaaaccaggaattgtcagagacgtgaccagacatgtattaaaattctagtgcaattgggaaacttggtcttcctgatttgtttatacttcagccaaacccagatatatagtgctcagcagaaattattcaaaatgttgatactcaagattgaaggatggattagggagaaatgaaaacttttcttcttgtggactttttaggtatgaaatttaatcacgagagtagttttgcttttctttccctgacctttcgcttcattcctttgttaagaactatatagtgcctctgaggaggtggcattattgttcactaacttaccataaatcaggggtctccaaaccccaggccacagactggtacccatctgtggcgtgtgaggaagtgtgctgcacagcaggaggtgagcggcggatgagcaggtgaagcttcacgtgttgttgttgttgtttattgagatggagtctcgctctgttgcccaggctggagtgcagtggcacgatctcggctcactgcaacctccgcctcccgggttcaagcagttatactgtctcagcctcccgagtagctgggactacaggtgcccgccaccacacccggctaattttttatttttagtagagatggggtttcaccatgttggccaggcaggtctcaaactcctgacctcgtgatctgcccgacttggcctcccaaagtactgggattacaggcgtgagccactgcacctggccagcttcgtgtgtatttatagctgctccccatcactcacatcactgcctgagctccacctcctgtcagaacagacccagcattagactcccctaagagcgtgaaccctattgtgaactgcgcacgtgaaggatctaggttttgcgctccttatgagaatctaatgcctgatgatctgagatggaacggtttcatccagaaaccatccccctgcttccctgtctgtagaaaaattgtcttctatgaaatgggtccctggtgccagaaaggttggggactgctgtcataaataacattgaatttcatgtgggttttttttttttgacacaccaggcatgtctcttccattcaaatgctatggctacagagggaaagggtagccagataattatccacatgcttcaaaccaaaaagataaaaaagttggcaactagatctagttgcctgccaggatgaccagcgttatgctggtgtgtgcgtgtccatgcctccgggatttttccagggttatcaatgtcagtgtaagatctgatggaatttaccgttgactcaattttcttcaccaatcaaggctcattccttgaggcatgagttatgcgaaaagcttttctgcaccaagtactttcattctggtctttggaattgtcataattctgacagagaacacagaccattactgaatgctcttcaggttaccctatttgcctgtcacattgcttctaccggccacatcctgcatttcctgtgggacagcattttcaaacggattctagtgtttgagctggaaccaaaagaatgaaactgtttttacataagtgcatattgctgtctctgcaaataaagtacaacaatatgactgacttgtaaatatcttccaggacaatgctgtgattttccagttgattctgcaactttaaagatataaccaagtataattaggccgttcaaggatgaatgggtcccacagaagctagaaatagtttacttcctgcttccatttctagatgcagaagactaatattcacagaaaaattacgtagacaaattttgtttactagatctaaaacattcctgcttctcagaaaaacaaaaccaaaggagtatttaagataaagtaacagtgaacgtgttgagactaaaaagtttccatcaactagtcccatatgcaccctctacccttcacataatctctttggacactcggctccaattttgtcttatttttcttcacatctcaatctacaccttcctaatatgtccggaattggtggattcttggtttcactgacttcaagaatgaagtcgcggaccctcacagtgagtgttacagttcttaaaggcagcgtgtccggagtttgttccttctgatgttcggatgtgtttggagtttcttccttctggtgggttcgtggtgtcgctggctcaggagtgaagctgcagaccttcgcggtgagtgttacagctcttaaggcagcgcgtccagagttgttcattcctcccagtgggctcgtggtctcgctggcttcaggagtaaagctgcagacctttgcggtgagtgttacagctcataaaagcagtgtggacccaaagagtgagcagtagcaagatttattgcaaagagcgaaagaacaaagcttccacagtgtggaaggggacccgagcgggttgccaccgctggctcgggcagcctgcttttattctcttatctggccccacccacatcctgctgattggtagagccgagtggtctgttttgacagggcactgatttgtgtgtttacaatccctgagctagacacaaatgttctccaaggccccaccagagtagctagatacagagggttgattggtgcattcacgaaccttgagctagacacagggtgctgattggtgtgtttacaaaccttgagctagatacagagtgccgattggtgtatttacaatccctgagctagacataaaggttctccaagtccccaccagactcaggagcccagctggcttcacccagtggatcctgcaccagagctgcaggtggagctacctgccagtcccacgccctgtgcccacactcctcagcccttggctggttgatgggactgggcgctgtggagcagggggcggcgctcggggaggctcaggccgcacaggagcccacggagttcggggaggctcaggcatggcgggctgcaggtcctgagccctgccctgtgggaaggcagctaaggccctgtgagaaattgagcacagcagctgctggcccgggtgctaaaagcccctcactgctcgggcggtggggccagctggctgctccgagcgcagggtccgctgagcccacgcccacctggaactcgcactggcctgcaagcaccgtgcgcagccccggttcccgcccatgcctctccctccacacctctccctccacacctcccggcaagctgagggagccggctccgccttggccagccgagaaaggggctcccacagtgcagcggcgggctgaagggctcctcaagtgccgccaaagtggaagcccaggcagaggaggtgctgagagtgagtgaggggtgtgagggctgccagtgcgctgtcacctctcactaatttccccttagtttattttttgtttaaaatggagtttcgctcttgttgcccaggctggagtgcaatggcgaaatcttggctcactgtaacctccacctcctaggttcaagcaattctcgtgcctcagcctcccaagtagctgggatgacaggcacccacacctggctaatttttgtatttttagtagagaagggatttcaccaggtaggcccggttggtctcaaactcctgacctcaggtaatccacctgccttggcctcccaaagtgctgggattacaagcgtgagccaccgcccccagcctcccctcttagtttaattcctggtctaattgtagttgtcacatccaaaccagtcctccaacaatagcctgctgaggctggtcatgaaggggctccgagcactgtcagcaactggcctgaacttcaggctctcccaagatctgcatcttctcattggaagcctctcactgaaacaactgttcctcctgttaccctctatctctggaggctgatttattctaattccctttattcctctatctcacttccacctctttttctgcagggtcctggccaagatagctcttctagtctagctcacccggcccaatctttcttataaattttcttaaatgtaacttcaactcaaccaacttcaaggtcacctgtgattctttctgtagtcaatattccatctgtttgcactgaagctttattccttcaatgcctaatttttatgaaactgatgagactaagtttctagtctcataagtcatcaaatctagtgtcatgagcagagaggttgttgagatgtatgtggcaaggacaaaggacagctcttcaacaattgcccttcctgtttttcctgtaggaatcgtaacatcatttacatgttatatcgaaatgggccatgtgtgtgtagctggccttttttttcctaccatgtacttgtgtgttctggaatcagtcagctagaaaatatttaccaagtgtcttaggctttttcactgtagtgtgcatttaacgtacacagtaaagaatgaaggctggcactaaactgttagctaatcatccggtgttccatgtgaatgacagaacacggaataaacctgatgacaccaccactttattttgagctaaatcctcatttaagtgagaacaggacaggtttcaccactgcctcctttggcaacttgagtggtggtgttcccaccgagtttatggctgcaaagataggtcttttctcgtatttatgtataaacaggtaccagttttgattttatttaatcatttcatacattaacatacatgacacatcaaaatgagaaatgcacagtttaaccgttcaacagctggccttacttcaaaagaacactatattcatattaaacatttacagtctttccatctaactttacacatgtcctaaatcattttccagcacttctcacatagaagtctagttttgctctttaaaatcaccatctgtatcacccctagtagacgcgagggtttccccaattacatgctgaagagagccagccaccaccccacctaaagacatccaagcagctccagagcctgcctccgaggccaccccttcgccacggcagtctcgattccaagaactgattatctgacactagtgaaccagcactaaaggctgtaggatgtgactacatcacagttccagaaggaagggggaccatggccaagagaagccctaaatgacagaagctcattaaaaccaagtcccccaaacctcctgaaacatcgttagcaaggagctactgctttcctttcttaaacatgttttgggcatgaccacactctggaagtggtgaactgttacacatttggtgtgtgtgtacataacatcaaaaactactgtgtgaaacttgagaatgtctgattaaagatttcaatgtatatctaaaaactaactcaaatcgttgaccagcactttcccagtatcataacaatgcggctgaccctcttctgccttcactttacaccccatcatagcacattatttgtgcacaactagtgaggtctgtgcggctcatcatccccataaccaagtcggtctgtgttgagtcatatcattctgtgctggttttagaagtcaccataggaaacatgaagtcacatcctggtcaaaaaactgtccatttctcaaaaacagagaaaaacctgagatacgaggcagcaactagcgacacttacaggaagggaaagaacaatgacaacacccgcccagccccacccccaaaaagctgctgttgtgaattaaggcttcaaaagaggacccacattgtagctgataaaactcaagccaggaggatgtttgaaagccaatctgcactatcacttgttccagtgacctcctatgttcagctgccaggaccgattccatacagtgattgtaggttgaggactgaggacgcccctttgctctcgctccattttgatttgctttttccactgaagacacgccggccagcgtttccaaaaacagcttggccatggctttgcactctattcacaactgatcaaaactcaatggtcttctcagctttctcaaccgttttattctgaatattccttcctcactaaagcctctctcagccctactagtaaatgtgaaagtctgaggcaatcatagaaacatcagccccatcgcatgccgaggggataaaagccactaaggaaacaggtttcctgcttctcctcagcaatttgtacctttcttaatcttcccataatttacctccctaggaagtttcctataaaattctgccatattattacattttaccaactgtatccatgcagtgaagcagaaagggcaaaaacatctgctttggctgagaatttgaaggtgctgctgctctgctaccaacccaaataaattcacatttggcttgaaaccaagttcatctttatttaaaggattgacaatcccattttaaacaattctttgatttacaaagagggaggtagactcgttagcctcccaaccttagcttaaatcgtgatgttgccaggttcctggtggttcagctgaatcctagacagtttcccttctcttcataaagctgagaagaaaaaaaaattatctccatctaggcccacgggaattttgtgcatagacagtttgaattggtctgaaaagtgtgactagctacctacctattcacaatgcctagaaaatgggctaccagatatggtagtggtcaaagccccgactttcctgtctgaggtactgggtttgctctaaggtagaccttggcaaggcccctaatggtccgtccagcagagtgatgctcgtgtccctcggctgtcaggtgagcgtgggtttgtgaatcagctttggataggatcatttctcttggatttaccactaggctctgtccctaacagggtctacctacctgacccccaagctggctcagtctcagcgctaaggtgtactatggaagggtccggacaaagactaatatttgagatctcttagtagcacaacgtgaaaatggtaggggattttgtcctccaacaccaaagacacttgcttttttaagaacaagaggatgtgtaattcactgaataaaatggttttcctccgtctaggggggattctagcatctgcccttccatttttgttgagagaagtattagctgatctctcaaatgcagatgttaagagagtaacaactgggttgatccacctgttgcttttacaccatagctccattttccaaaaatatatatgtatgtacatatatatatttcagatttacagggaatttttttgtgaacaagaaaaaaaaattgtctatagaagtcacaagtgtctttcttctcaggagacctcaatgatttccatgctgcccgaaaagctagactgactgcccactttccccagctcttcccgtgacctgttctctgacatgatgctctctccaaattccatttggcagcttctgcgtttaaactgcttttcaaaggggctctcttcatgccagctccgccgcgagtcagctctgtcacttggcttctgccgcctgcgcacagaatagacttggtctccgcaagtgggcagctggctgcagctgtaggcagagtaactggcactgcctccgtagatggctgaggcagagtagaagtgtgaggactctgtggcaaaataccagctgctggtcagggaaggggtagaggtctggggggccaagatatccgagtgccagcccttaaggcccaggccagcagacttcgtgaggtgctgctggctggtggaaaggccgaaaaggaagctggtgtggtaattgtcctccacgctcccacttcgatgcagtggagataaaagggacctctgggcggtgccactgctgctggttctgaccgaatgcaatcgcttgctctggctgtctgaaggcctggcggtctgcagcttcttggggatgctggcttcctccttatcaggactggtttcgggagtctgctccgatagttcctgaacaggggagaactggcatagcttgttggtcccatccagagtagtggaaggtttgtagtattccaaagcatcttctgatgaggagaagccatgtaaggatgctgccatgctggctgaatatgaaactgatttgatatccagagagaaggaacgcttgagcttattgctgtcttccagcctgtctgcggacaggtgcagcccactgagcgcctgtaccagcgggctgtcctctaacagcgacggctgcacgctgggcacgctgggcacgctggcgggatgcacgggcctttgtcctgctgcctctgaggtagcagagtcggcacagggtggactgaggggcgtctcgcttttctgtccaccctctgagacagcagggacaggttcatttggcttctccaggtgcagcagcttgagtttgctctttggccctgatgctccagtctggttcttaatcttcttctcatagtccaggagttggcccagaaaattgaagtttggagatatagtaggtcttttttctttcacaaatctgcagagagaggaaaaaacaaaaacccgaattttacaactacactttatcttaagaatattaagtgaataaatgagatagggaattatcaggcagacctcaaaaactttggaagatgattggtttacaagttcggggagatgcttcaaggtggagaatacaaaggccctaggcactggggaagctttgcacacatcctggagtatgccagaagaggcagctgggccccaaaggctctagtttttgtctccttattttcaaaggcccagggctcccaatgcagctgataagagatggtatggggttttgttggtggtggtcttttttttttttaagagacagagacttgttctgtcgcccaggctggaatacagtggcatgatcatagctcactgcagcctcgaattcctgggcacgtgcagtcctcccacctcagcctcctgagtagctgggattacaggactacacgcttggctaattttaatttttaaagtttcttttgtagagaaagggtctcactgtgttgcccaggctggtcttgaacttctgggctcaagtgattctcccaccttggcctcccaaagtgctgggactacaggtgtgagccaccatgcctggccaagagatgattatttattcaccaccaaggacacccctgacacacacacaccagtgctaccatcaaaagtacagtataacagccactctccttcttcaatttccaatgtcatcccctcttaaagtcaccagtcacttctcaagacagttcacattttaaatttaatgacaaaaagaagatggtatcagatgatcaaagtatcaaagcaacacttctttttatagtcaacatgacagactaaccaagacaaagtggtctctgtgtgctaagcactgtgcttatgcactgaatcatcatttcatcctcagaactaccctttatcaggtgggtgtcattatccccatcatatagctccacagaatccttaagtgacttgcccaaaatcacacagctactaaatgatggtgctggattcaaaaccaggctggtcaaatatctgggtccatttttgtaaccactatgttaaaaaaaagattcatcaaaggatcaaaactaatactagatggctttcatgtttcatggaggaaataaagactcagagatgacagaccaattcttcagcggcccctgcacctcatggatacttttcaggtgatggaggagtagaactacactgaaaatttgcatttgaataaggaacaaggaaaaaaaaaacttggaaatcaagtaacctaaagcaaattcacaaaaatagaaataactggctcaagaataacaagtataaatgtagggtgctcataatgagacttcataacgtgatagaagggtgccttttcttctgatttctacatggagcaggaggacctcagggaggtctgaacggcggcatgagagctcgtgcagatgaccagaggacccacgtcctccaggctgctgacttaacatgggaagctgtttgggcagctcatttctgttttccaaactttgcaatttgagaaaaaaaaaatccaactgttaaatcaggcctgctccatgagtctctatatttttgattccttatcagataaaaatgaaccatctctacccaacgatacatgcaggggagtcagacaaatcagagactggaggcaacccagtcaaaatcacacacacacaatctggccgactctagaatgtaggaaattttactgaagaatggagtctgacagttaatctggttcatatttgcatttatgaggctttttcttcccagcaatccaaagtttgaagcagaacagagattctgcagtgagcattctattagagcttccccccatcatatgcaaattaaaacaaaggatacttttgcatttagggaaagcaataaactcatgtaacaggatagagatctctgcctggatctgttgttccttaaacataaaaagtggctgaggatgagtctgacacatgtgaaggcagaattaatgctaaatagtaaaacagcattcttttccaatcttcacaagaccattaaaaaatccacagtaacctgtaaaaaatgtgactaaaataatcatgatctgctttaatttggttacccatcctcatcattctttatgtttcaggtcaaatgaaaagccaatcacagaagacattttcctgccctcacctgtaagcttcatctaaagacatgtccatcctcttcatgatgtaggcgatagcgatggtggcggagcgggagatcccagctaaacagtgcactagaacacatccattggaggcttttgctttctctgtataagtcaaatgcaagaaaggtcactactaactattttgttcagcagtgaaatcttgtttccatttacttactcagtgtcttccacctgaaaacctctacgcaaatctcatctgtgtatatcatatttatcctcgcaatattcttttgaggaggcaggggaagataattccctcaccactgacatgcaggacaactggggtccaaaactgtttgttaataagcaattcgttaataagcaagctactactaactcaggtttcctgacttatgttagtattttcccctaagatatgggtaatatttaatatattcctgttatctgacacttcaaatttttccctgattacctaagaaatataattacattttttaaaatcattattactattttgagatagagtcttgctctgtcgcccaggctggagtgcacgatgtcggctcattgcaatctccgcctcccggattcaagtgattctcctgccttagcctccagagtagctgggattacaggtgtgcagcaccacgcctggctaatttttctatttttagtggagttgcggtttcaccatgttgggcaggctggtctctaactcctggcctcaagtgatccgtccacctcagcctcccaaagtgctgggattacaggagtgagccactgcccctggcctccctattttaagcaacttttctgtatgtcataaaatggctcaactttatttactgagttttagaagaaaaccttgtataggctatgaatcaggtttagcaggtcactttaatgagatccaagagaacttttatcccttccttgataccaggagttattgtcttatggcattatctcaattccccacaacatgatggaaggactcacggacactttgttagaaccaaagaaccaaggaaatccaagcagtgctgccatctctcactgctgaggggcttaacaatatgtacatgtggcaggggacgaggttattccacacagcctggaagctactaacattctggccagttccatgactgcctcaattctaaataattacatgtgtgctcagtcatgaagctgaattctccccttttcattcttggtagatactaccaaaagtctactgaaccttgtgttaaaattcttgcgattaacagatgcgcaaagaatcttactttggcagctgaataatacaaagctattcaatctcactgcctatgctataaatataagtttctagtgtaatgattattatatataacataattattcatcatatataaagcaacatacaggttttgggtagcatatgaataattaagcagcaagcagcttcccttctagatcaggaaaccaaacacaataaaacactaacaaatgaataccaagcaacactcaaacaaagaattgcatgctatacaagtaagaacatataaactcgtgtacacagtctcatgccttcctgtgcctccagcatccccttccttctcagctatcatttaccccacgttactctcagtgtttccttccctttctgccctactgctaagaagctcaaagctaaggtttctactcaatttcaataagaagtagcaattcagactttttgtcagttactgtacatttcctagcccctattacttgattattgctcctttataccattataatgtgtatgtgtgagaatatgtgtatcttttggttctaacctattattgaaaactgcttcaaatccttactggaaggagtctgggtttttgttttttaatgttgacaatactctctcattaattttaataattatctatctcaaaacctagattataaggacctagaaggatcttgcttgcttctaacaatcccccaaaagacttaacgctaggcacatggtaggcatccagctgatactggctgatacatattttcaaaagagattttaataaaaaaagaagaaggctggaaggaaataaaacaatgacagtaacatgcgttacgatgttgaggttataggtttccttttctctgtttttcaaattttctgcaatgtgcttacaactgtttttataaccacaactcttttgatgacgtcttttaaaaatgaaaaaaacaagtgactatactggagttgaggttcaccagcatgcatcttgggagacatgagccctaaactgtgtcttcaagcaaaggaattaatttaacacacacaactggcagagaggagaagggaaatgtgtgcgagaaagccctgcagtgggactgagcaaagtgctcattcgaaaacagcctgccttggagaagaaaccagagagaaggtttgagaaggtttcaaaggtgggaagcaggtgtttgagggtggtgggaatgttaggctaagggctacatttgttttttcagacagggtctcactctgttcatccaggctggagtgccatagtgcaaacatagctcactgtaactgtgagctcctaggctcaagcgatcctcctgcctcagcctcccagctaggactacaggtgcacaccaccatgcctggctaatttttgaaaattttttgtagagacaggatcttgctatgttgactaggctggtgtcaaactcctggcctcaagcaatcctcccgcctccgcttcccaaagtgctgtgattgattacacacgctgcacctggccaaggctacctttttaacgcagaaaactaagaagcctcttcaggtttctgaataaagaacgagaaggcaatgatgatgaaaactggaaacaagcaggtggccattaccgcaattaaggctaaaatctaggttaagaaaggggagagagaactgcaaatgaaaagggcaaagatgcagtgaggatgagaagttacaaaagctaaaaagaaggaagtaatactaagaggtgttacagagtccagctcaaaggacagaaaaaaggaggaacttcagataacaatttttaaaatacttattaacagccaattatgagtcaggtactttacaaggtgttcaatggacattatctattttacttatttttattttatctttttggtttactttttttctttttttttcattttacattatctattttaatcctcacaatatccctgtaaggtaggtatattaccttcagtttccagatcaagaaactgaagtgcacagaagtttgaagtaacttactcaaaccacttcactaataaccagggtaggcaggactcaaatacagacagtttgcctccaaaatacatggtcctaatcacctccctatgttgtgtccatgcagtcacgagtttggcatgaggagagctggaggaagagcccaggagacagtgaagaggaagcaagaggctgtatatgtagccagctgggtttgggggcacctcatgagtatcccatagcacaaacgggcaaactctgttactggcacattaactaaaagacaaaactccacataaacctgagtccttccaaccaacccggagacttacccaaatctaatctaaataacaacaacaaaaaagaaaaaatcactatgagcctgtaagtcattaagggggtacatcttcaaatgacatgctatcactaaccatggcttaaaaccccacagatccctaaaacttaaagtataataataaataaaaataaaaaaatttaaaaattaaaaaaaaattttacatttatctttaagaatttgtgtttgagaataattagctcttgccattctactactctgtatgtatgtgggttatcattcttgtgtctttcttctgcttgagtaaataaaaagcaagaacaacaacaaaaaaccccacagaggagaagacttagcaattgtagtgaatatgggctgaattcaaaaagtggcctggagattttgccttgaattacttgggtgggataaggatgatggctctaatagaaccaagcaaatgaaatactgataagtatttgcagatattacaaataaattataatatgtattttgtgtgtatgtgtttaaccaagttgcaaagtagttaaagttcttttgtatgaatgaaagtggcaggatgaccccaatatcttccatgaaaggaaaaaataagttgggagcaaagttattcatattctctattctcttctcttttctactaaactttgtctcctaaagcccacacattgtcatgacttaagaaaatcatgttctcttctaggtagattttgatatctgatttttagctgaaattagagccaatgtctctggaagtgacgtgcaatgggaacattaaccgtaatttattttttttatttttattttttttgagacaaagtctcactctgttgccaaggctggagtgcaatggcgtggtctcggctcactgcaacctccacatcccaggttcaagagattctcctgcctcagcctcccaagtagctgggattacaggtgcccgccaccatgcccgactaatttttatatttttagtagagacgtgttggccaggctatcgcaaactccagcaacctcaggtgatccccccatctcggcctcccaaagtgctgggattacaggcgtaagccaccatgcccagccaattgttattttttaaagagacaaaaacaatgatttgctgaatgttttttagaagtacaatgggagggtgtgtgttaacttgtgggggtttgtttgtgatttttttttttttttttgagatagagtttcactctgttacccaggctggagtgcagtggcgcgatcttggctcactgcaacctccgcctcctggattcaagcaattctcctgcctcagcttcccaagtagctgggactacaggcatgtgccactacgcccagctaatttttgtatttttagtagaggtggggtttcactatatgttggccaggctggtctcgaactcctgacctcaggtgatctgccagcctcggcctcccaaagtgctgggattacaggcgtgagctacctggccatttgtttgtgattactttaatatgaactaagtcatttatcttcagatgtttcacagaatgaatcctaattgaagatgaaaccctcagcaacctggaaatcttgaaaaaaaggcaagtgttttggaattacttaaagttccaaaagcattaaatagaatattcccctcacaggtgaaaattataatatggggcttaatatacataattccactttttgtttttgagacagggtctggctctactgcccaggctggagttcagtggcacaatctcagctcactgcaacctccgcctcctggctcaagcaatcctcccacctcagcctcccgagtaggcgggaccacaggtgcactggtagagacaaggttttgctatgttgcccaagctggtctcgaactcctgggttcaagtgattgcttgcctcggcttgttaaagtgctgggattaaggcataagcccctgtgcctggccaattccacttttttttttttttttttttttttggagacagagtctcactctgctgcctaggctggagtgcaatggtgcaatcttggctcactgcaagctctgcctcccgggttcatgccattctcctgcctcagcctcccgagcagctgggactacaggttcctgtcacctcgcccagctaattttttgtatttttagtagagatgggttttcactgtgttagccaggatggtctcaatctcctgacctcatgatccacccgcctaggcctcccaaagtgctgggattacaggcgtgacccaccgcgcctggccaattccacttttttgaaagaactagttcttttatttttaattatggtaatggtaaccaattcagagtaattatggattagggtgctccaacttatgtaactgggggaaaaaaaattccttacatggaacatcaagagtcactgtggtatgttgctcaggagctagcagtgtttctcctctgctcagccactgtccactaaagccacattccaaatacacatcaccaagttaccacccagcagatctgatcctgtggcaccaaaatgcctcagcagtaagtacccaggggccagagaagctccagaattgaacaagcccaggaagcacaacaaagtatggcacagatgagatcccgtcaagaccattgccaggaaaataaccaaatgagagtgtgtgtgtgtgtgtgtgtgtgtgtgtgtgtgtgtgaaaattctgttagatcaaacactacctgaaattattggcatgtggaccccggctcagaaacactgacataaagacttaaatgtaatgggatttgttttcaaaagatttgacttttctctgtaaaaaacacagcaacaaggcaacagggaatattaccaaagtttcccaaaggcttgtataggatttgaaaaagttgggggaagaatttaaccctaaaagcttaactgattttcaaacacctgcaaatacataattacagatcctgtgaagcttaaccttggtggtgttaaatgttagctagaatgtcacaaggccagtccttagggacagtgtgacacacacgtcaccttgaccaccagatgagtaagctgcaccacgtgctgttttcagacttttgaaatctctgaaataggctccttttctctaaagaaaaaatggggggctgagggggttcacctacacatgagacgatcacccacaggacctgcaatattatttgagctacttaccaatgaaatctactgatttgtccaaccacggcaaaattttctcacaaaagctgtcattcacaggcacacgcaggaaatgagactcggggataaagtcaggctttggacaggtattgctggcatttaacacataaccaatcccattctgctgcatcagctcctatggagagaaagagtagcagttaaagtgactaataatatagtaaacatgatcattctgaaagagtgaagtttaatgtgatgataaaaatgcccagtttccttgaaatataattcattcagatcagtgaagtccaaaaacctagcaaaatgacatctagagacaagtttaaagaaaaaaaaaaatttaaggacaacaaacgctatttaaaatagtatgcttgaagcccacacatcattcatatagtcaagtctctattatcttcattactagagagagaagtggaacaaagaatacaaaagaaaacaacagtttatatgattttagaatatatggacacacaacattttcttcccacacggaacacgctggttctctaagatacaattctagtcattcttctcactctaaatactctctttgaaggctgcacttacttctgtagtcttaattaccagttctacatgctgatggcgtgtgtgtgtgtgtcctcttaaatttccaacccgtatctccaactacctactgactatcaggatgttccacaggcccttcacattcaaaatgtcagaaactaaacatattctctttttcccttttctgcccccaactcctgcctcctctctgtaatccccaaattggtttagggtaataacatcgacccagccaactaagctcgagaataaaatggggctcctttctcttccccatgaccctcatccaaatggctgccaaatccttttggaataacctcttccattgatcctctctcctctctatacccattcactgctcagtagccaagataaccaaaaaagccaccaggagctcttgaagtttgcagtggttttctctccaaaccatgttctgaacaactagaggaatctttgttatgattaaccccaagctgggtgctttatccacattcttttcatttccttgagtctcatttcctgctcctgtcccatatagcacccccaacgtcaaatgtatacccaccctctgttcacacgattcctgtgcttagaaggccctgtccttcttccagaagacactcttcccacttttcctactttaacctcatctgtgaactctttcccactcatgcataattaaccattcagttctctgtccttccaaagtactttgttcacaccattaattaagcacctaccatagtgtgttaccattaacagataattctcatctcccctgttatgtaatgaagtaatgagtaagatcttggaccgcgtcttgtttttgcaccttcagcccagctatagaattgcactcaaaacaatctgttcaactgacatccatccaccatttagcaggcaagcccacacaaacccgcttcatttagtcatccccctgctgcctctcaggagacgttccaagcctggaataattatcttagtctaagcaatcttggtcatttcttccttctcttggaatactaccttttctacaaatcttttccaactacctgaaagaaaatgggcaattttcttcctatattacccttctgaaacatgccagttccctaatctcttcatttactacatttggcacaataaatatactttattttacataaaaggtgaacagcagccgggcgcagtgactcatgcctgtaatcccagcactttgggatggccgaggcaggaggatcacctgaggtcgggagtttgaaaccagcctgaccaacatggagaaaccccaactctactaaaactacaaaattatccaggtgtggtggcacatgtctgtaatcccagctactcgggaaagttgaggcagaagaatcgcttgaactcaggaggcagaggttgtggtgagctgagatcgcgccattgcactccagcctgggcaacaagagcaaaactccatctcaaacaaacacacaaacaaaaaagtggacagcataaatccagattgtgtatgcaaccatctcttatctctgagatgacaatgtcaataaacagcttttggaactaggtggatttcttagattggccaacacccttcagctatgccagagcccaagtcttctgatggtctcatgcttctgttaggttaacaatcaggctacgtagatcttaatggtatttactacaacctttaaacttttgtacatgtagcaaaggttacatttgtttttctatgtgtgaacccaaggtgagtttatctagtactatctgatcaacaacagggtgcagaaactgattcaggatcactcatgtaagaacagaagtgggtcactggagttaaatcagcctttgaggactttctcaccaatagtcctttccaccaacggtactacatttttctcctttccaccaatggtactacagatatgttaaattaaaagtaaaggaattagtaatatccctatccactcaattcaataatgaagaaattacagaagtttctgagaaatgaggtgactctaatagtgttacacactgtacacaatcaaaagacaacaggaaattctaagagaaaacatgttgcaagtcaataaggactgtcaaaattgattttccatagaaaaaatacgatgtacacttctgacaagtaaacttaatagcctacattttaaagaaatgacaacctatattaagtcaaaaaatatttattgagcacctttgttagagaccttttaattagacaatgacacacggtactgattaagaaaatcatatctaacatttaatgaatgcctacaatgtgccaggtactgtattaagcatttaaatggactgtctcatttaattctcacaaccaccctttgatgtgggttcaattattgacctcctggggtcaagtgatccacctgcctcagactcctgagtagctggaactacaggcatgtgccactgctcccctcaaatttttaaacattttttttgtagagacagggtctcgctgtattgtccaggctgctctcaaacttatggcctcaagcgatcctcctaccttggcctcccaaagtgcttggattataggcatgagctactgtatgcagctagtaaaatattttaaacgcaaaatggactgagaaaaaattaaataatttcaatggctttatttataaaatttttagcttaaaaggtctattgattaaatctactatccagatgctacctgaaaatttttttggaatagtaagatgggacttgataaataaaacaagtacaatttgtaaaaacaaacaaaccaaaaacaaaaaaaaacccttaaatacttaatataatttggctactaaattaaatatcataaataagtgccttcttatctggattggtagtcagtggaaaaagtcagttaagggggaaatcattaaaaatgatatatacatactcgaaacatcattttaacttaaaacaaataaacatgcatgaatacactgatttctgatgcaggaccacagcttcttgttttctaggttagctgactggagttcgtaagcaaatcacacctaagtgcatctaccacttctacttttcattttttaaagaagagcaggaacttgtaaaacactatcagtgccaaagccttctagattaaaactgtcccccaaatactttacagctcccttattcccacctaatttgacaaacatatatatggcaatctgtctttcctgaatctttccaaaacacctgacttaggtcacagaaaagcatccctcttccttcacatttcattggtgtatgtcctattttaattaacatacataattataataacaagtccagtggcctaaagttcgagaacaaacacaactgattcttggtaagtatactattcaaatggtggaggcagacgtgctacagcaaagagcccactcatgcagcaggcattcaccttccaaagatgtggggaaaagatgtcgtgaaatctctggagtcagttaagaaagtttctaaagtttcatgtaactgttgttagtttgctctcttgatttttttaatttttttttttttttacaaacttcaatacaaatggctgggaggggatcttaatttttgttggtgtttttaagacacagggtcccaccatgttgtccaggctaacctcaaactcctggattcgagtgatcctcccgtctcagcctcccgagtagctgggattacaggcgtgtgccaccatacctgactcatcttattgtttgtaatggtgaaactgagatggaactataattatgaagaatgagtctgattcttttgtggaataaggattgcttttatttatagatacgtatcaatgacttcttactaaattataaaaagatatttatataattcattcagtttagtttcagcatgctgtataaaacatacacaactgaatatttactctgccctataattaaacatcataatctttaagcttctagagagcagtcaccatatgctgttaaatatttagctcaactttgtgctaagtctgcaaatacacactttctactgattagataatccttcttcactggccttcaaagatccttccaacaccttggcctcacagttctttgaactcctcatcttggcctctcactctcatgagatctagcctggtctctgtcattaccaattaccacaaaccctccataatcttgatttcatgcacccttccactttccagctcactcaagatctcttatactacactacacccagaatctgtaaacccctgcaggaggacctacagtctgatgatctactaattttctctgtccttcatccccatgatgtctgtctgccttccttgcccaatgtaaattctataatcagttattacaatcactcctttccttttaccccaacttcctctgccctcatcaattgttcgtactcacttggcaagattacaaccctagttaagtctaattctccacctagtcagcactgcccatgccactgaacatggccagagaaaaacactccacaatgctacctgatctaactttcaattcatactcctcagcaatctctgtatttccccagtccattcactttttctctttcccatatgccattctgtttccctttttcttcaaactccctatatgtccccactcatcttcactcacagctgaagaatgaccttgcttcctactacaatggaaaaactgaaacagtcagaggcaaattttgatagacttccatcaccacatttacccatctctcagcaaatgcgcccagatataatgccttcccacctgctgttttgggcgaactgtccatactcgtaaggccaatccctccgcttgctaaataaatccatcccctcttgctcaagaacatagctttgtgattctcctttctcctacatcaattttccactgtacaggatcattcttcctacctgcaatcaaacaaaccattatttctcccaccttaaaaatatctcctctcagcttcgcgtctccctccagccattaccccatatctttgaaattccttgaaagaaccccttctacttgatatctccagctccactcctcctgttatctcctgaacccactccattcaggctttcacccccaacactctaccaaaactgctcaatgatcaccagcgatagtcatgttgctaaatccaatgaccaattctcagtcttcatctttcttgacctaaagtactacttggcacactcgactgctccttcctcctggaaaacacgttgtttatttgcctccctgattacttgatttccttccttcctcaatatttacttctcaatattctttgttgggtcattctcaactccccagactttcagggtgggagtgctcacggctcaatccttttctcatctatattttgcctcttagtaattatctgatcatctcttatgacatcaagtactgtctgtatgttaatgactcccacctttatacctcctccttcagggatccccctgccccattcatacatccatctgtctactcaacatctccacttggaagtataacaggcatttcgaactcagcgtgtccagaactgactcctgcccttcctacagactccatctcagttaatggcaactgcatctccgagtctccttgacacctctctttttcacacacccctaccatccaatcctattggctataccttcaatatagagcccaaatctcaccattactgccaccttgacttcaacacattaccatggagcctcctaaccggccttcctgcttccatccagtaggaaattcaggctattttcaacacagaagctaaagtgatcctaacaatgtaagtcagattatgttgctcctctgcttggaaccttccaatgactccctctgaactctttttctcagagtaaaagctcccgtctttccaagtcctatgcagaaatcttgtattgtctggatctgctcctgttacctctctgacgacactctcccatgctcactctgctccagccacactggcctcgctcttcctttagcataccacatgtgctttgccttggtggcttcttctgcctgtactgctcttcctccagatattcaaatggcttactctttgacctcctttgagtgtttgttcaaatgcctctatctcaattaggccactttgatcacccatttaattacaacccacacctcacaggtaatccccagccctcttaccctgttttcttcatagcactcatactgtactatactatgtaatttacctatttattatgcttcctatcaagtttctttctcctaggatgtaagctaatgaaagcagagattattgtctcatttcctggtgtacccccagcacctagaacactgtttggcacatggtagaggctcaataaacatttgttgggcgaatacatgaacgaacccttatccctgaagctgactaaaatcagtatctagtaactggtttattagcatcttctaatgagaaaccttcatatatgttccttgcacattttcattttacaagtcactgtaaaatatcattaacttacattcatttcataatttaaaaaagactgtttttcctgggttgaaaattttagattctcaaattcattaacagaaggttttctgagtaaattaacagaaggtgtgtttacttaatgtttaaggacatgtacatttcatacaagttgcatgggttacaaattaggatataactatttattttgaaaaataatcaccaagggcttactatgcatcaaggtattctggggcataaaaaagcaagtgttctcactgagggatgaatagtctactagcaactgtaagacagttgcacgaataatgatgatacaaagaggtatccgatgaatataatgtagcaggataaacaaaatggcagtggaaaacaggagtaaaaccaaagggaaggattctgagaagactatttataatgggaactaaaattgtcagctgaagctcagatggcggtagaggcattccagatggagtatagaaaatgaatgaagaccaaggacaggacagaaatatctggggtgcactcactaggtgagtgtgtccagacattgaaagaggatgagcagaggaagagaacaggagaggtaagaactaaaaaggtggtattaggtcctggaaggtcttaaatatcaagctaaagagttttactgccaagctacagaactttatcaaatgccatactgagaagactgatcgatttattaaagcaaactcctaaaggatctcttcttggaaacaattcattagtggttagtgtggaatctcagtgtggcacggaataaagtaaagtacatgggtaacggccccagaaaaaccagagcacagcccagcgcattaccactcatcgcctgggtgatcttgggaaggttacctaacctccggtagctttaatttcctcacctgtaaaataaggctaatgatgtgtattttgtaaagccagtatgaggataataaagtgcctgacacataatatagggtcccctgaaatgttagttctcttattttatcttgttgtaaaaattgcttgtaaattgtatggtatatgaattatatctcagtaaagccattacaaaaaaaaaaaaaaaaaaaagcccatgatgtatatttttcactaatccaaactgtcttttctcctaattggtgttaagtagggaaattacattgaatacagcaggcgaggttcatctgcaaagtgaagacatactccccctaaggatttaaatagtgattctagtttcaacacacagttgagtaaactttcaaaaatgattatctgtaaaccaagacaaatttcattttattattatgatttccattcacaacttttctcccttgaaaactttctctctcctaaccctgaaataagctttctcctgcagtcagactaatttctaaatatgagttctatgatcctttgatgcagactgtgaagtagtacagagagaacagattaatatatggccttaatgaaactgctctgtttggtcaaattctctctgttcagtgaggctgaggacagagatctcattaaataaccacaggcatttcaattctagataaaagaattgtaatttttctttctgaagtcaattccatgactaattttgcatttgcccatccatttgccttcaaaactggcctcaagtcctacttaactccatcaagccttcctcaaacgacaaaacacactgtatctactactcaccctagtaggctgcatagtctaccctaagatgacaatgacaagtgtccctataaaccaggaactgtgcttggcatatgccatttcatttgaatgttacatgaacaccaggaggccggagttattgtggcgtgtaggtaaagagactgagatgcagtaacagctgaagtgatatggctggtaaggtggagaactgggatgcaaaactgtccacccctaaagctggctctcaaccatcatgccgtgctgcttccacactgggagggacactgtagtcaccttgtcatgtcaattgttgtttaatgaataggtcttgtctaaccaacttgaacactgtatggtgttctacatagagtgacatcatagacattgaagaaatattttattgataattttgacacgcttttgtgttcctagatcatatatttccactggaaactctgaaagcattcttagcctatattgtgtttaggctatttgttgcctaactcttctaagaaaacaacagagaatgtagcagtcagtcttcctactgtgtaccaggcagaacaataagaaagcctaggaaaaccaattttgcatgttaagaggctgaaataagaagctatacaaaaaatgttgacagcagattatttaaatggagaaggagcaggcagcagagctcctttagaaaagaagctgcagtggttcacctcagatacagttctgcttaataactactcccaataggtaagtcagtcatatgctgcatatatttaaatgtgaacaaaagtctgcatttgaaattgtaactgataagagagaaaagcaatcaagaacttttgtctttcacagagtaaccagagattctttctcaaatcccactcatttcaaatatgaactaggcatcagcagatgacttttatttagtacaataagctgctcccatttcagctctagtacaaagactagaggatgaaagaacacactctgagaaacaaagtacagttgtgagggaaaaggaaaataaaagtatgtttttggtaccgatgacctcttatggtcttctacaaaagaaccatgtctttaaaacatcagtaaaaattaatacatgctgagacctagactgtccaataaggtagcagccacaagccacacatggctactgagcacctaaaatgtgactactccaaattgagatgtgctgtaagtataaaatacacaccagattttaaagactcagtacaaaaagagactgtaaaatatctcagtaattttgtatactgattgcatgttgaaatactattttagatatactaggttaaatatgttatttttaaacattaaaattagttttgcccatttctttacttttaaaggccactggaaaaatttaaattatgtatgtgacttgcattatatttctgttggacggtactggtatagatgatgttgcagaaaaaacagggaaagaaattctccattgtgactcaatagacttaagatttcagtccttcgtaacagcctgctatagagaattcctttttccagaagatgggcatttttggtgtaatataagcatgggacttaaaattacagcagcctcggtttacatttgatctgtgccactgactagctctgaagtccatgacataatctcgggtaagtgacttagctcagggcaaatgtatctcctaatcctattatgagggttaaatgcaataatataaaaagcccagcattttaaatgggaaacattatgattctcccaagaaaatttctgtgacatgcttctaacatattttggtggcacttcatttaaaaaaaaaaaaaagactaataggccaggcacggtggctcacgcctgtaatcccagcactttgggaggctgaggcgggcggatcacgaggtcaggagatcgagaccatcctggcaaacatggtgaaaccccgtctatattaaaaatacaaaaattagtcaggcatggtggtgcgtgcctgtagtctcagctactcgggaggctgaggcaggagaattgcttgaacacgggagggggaggttgcagtgagccgagatcatgccactgcactccagcctggtgacagggcaagactccatctcaaagaaacaaaacaaaacaaaacaaaacaaaacactaataatattagtggtctcatggttactgtttgtaaagacttcaacttctgaattttaataaaaagaactgtactgttagggaagattataaaattttcatttttggagatctttaggaaaaaaagaagcatattatttctcttggaaagtataaatcacgaagttcagcaggatgataggttagttaatactatttgtaaaaaagaggcaaatctagttctaaaactcaactggataatgttggggaattcatgtaacatttttggaatactgatttcctcacttatcaaatgctggtggctgactaaatgatctctgaaatctccttcaacgctaaggtttttgtcaacaacgaacctagaggtcaaacatgcatttctttattttattttttattatttatttatttatttatttatttattttttgagatagggctttgctctgtcacccaggctagagtacactggcacaatctgggctcagtgcagcctctgcctcccaagctcaagcaatcctcccacctcagcctcccaagtagctggaactacaggctagggccacaaagcccggctaatttttgtaatttttgtagagacggggttttgccacgttgtcctggctgttctcaaactcctgagctcaaatgatctgcccacctgacccttccaaggtgctaggattccaaagtgtgtgagccacaaatataaatttatattcactgctttcaaagctatccagcttaatagtttattcttatttctcaccatccttgcagaataaaaataaaagtctatacatctattttaggggtgcttcctgacaagccttctataataactccttgcccaaggtgttgtcctataaacttccacaaacccattctccccactgcaaatatttcctctcgatacatctacctatgtatcctgcttagtgctgtatatgtttagaagccagagttaaaaaaagaaaactactatttttcccatcctcaactccaaattctggtttaactgctgtcaccttttttaaccaacatatttattaaatctgaaaaaggtatacagcaaaatgaatgtgtcatttaactgagtgtcaaaagtaacaaaaactatctgtaacacaattacttgtggaatgacctgctgatggctggttaaggtttaccaggattaaacaggattcttaactaggaattttattttattttctgatctgaagattaaataaaccagctccagctttgccctaggaatgcatgggactttaagaaattaattttgctttctgtaacatagcctgcttatctctaaaaagaattaataataactgcacactcaaaggcattgtgaccccaccagaaaggctcggtacaagcataagctattaaatctcaaatcggcagatctcacagtaaaagcagacatattaacaacacagtgttgaggcaaaattttgaaaaggcaggagttttaaacatacacacactcacaaaagaatgccttattgctacccaatgacccgatgatcgggtatttttcttcctcctagaaagccttgccttccaggtgctaaagaaagccagtctggaagcttatttttacaatcagcccaattcttctagttactcaaggagaacgtgttaaggggttcttccctttgcataggaaaatagcacttgtaaatcaccaatagttgaattaagatctctgactgctttttcaatttgtggtgatgtaaattaagagattttagagaaaaatcacttttccacgcagtaagagcactattttgcagcattactaattaagagcatacaagctgtggagtcagattatagttctattgctgttctgcttgtaccatcatatacaaaggcctcactcaatccaatgtgttcctccattagggcacgctttgtccagtagggcccgtgtctttttcatcaataatccatgctcttccctcttccttctcaaccaaactcctccaaagagctttaacccagggaggctggcagtgcatagtttcagcctttgtcctcaccatctttttaacacctttccccacccccagccagcagtcatcatgaggaccttcctcaatccaagcccaacctgcatccctttctagtatgttgcaataaataaatatatttctaaatgtgtgataatccaggaactaacagcctgagagtgcccaattataatagatcaattaataccctaagaatataaggctaaacttctgaaaaatcctgtcctatttcagttctcttggacctattaagaacaagtagacatgacaataatttaggtttcctgcagtaaaaagtaacatcaaacaaattaacactccaagagatgacgcaactgttacctggggagcacactgagaatggcatagcagctcctgagattggggtgtgtttcaaatgacataatgggtaactgctgtttctccagctaacaatataaacccagcaatgaaggatattttcaaagcacccaccttgttgaggacatctcgctggcagccaagataaagattgggaagaattcgggttggcccaatgttggcaacaggtaagcaaggctgagaaatgcaggtagggactagagtggattttccttcacagaggccagggaaacaacgagagaactcagcaaacccacctaagaataaacattataaaattataaaaaattatgccacgcacaaaataaaaaccagctttctgtgaactgctcaaacagtttaaacccacgaatccaagtggatatcactgcacacctattcctggctacagctgctgatgctaagactgaagcataatccagcactaggcctggcctataacgctaccatggggataggcaagtcctgaaggcacttataatgaatgactcctctctctcagatattctcttcatcttcacataccctacaacatttgctccccactccccatgcaaatgtttttttttgtaaaacataaagaggatttaaagttagtagcaagtaaccaagccaataattcacagaagcagaatggggatgtaagaaatgaaaactgaggctgaatgcaacttcttcaaaataaaattgatcgagtcaaaaattctttctacaactaactttaaatcttcttaccatacaaattttttactgcaaaggtatcacaaacatactcccacctacgaatattctatcaagttctggggattccctgggcagttagtcaaggtctccataattaccactgatgtctggagagctcccgttcatctcagcaagcactataaagaagtgctgacagactaattgcttagggtgcaggaaggctttgtggcaagattactgaactcagaattagaagaattcagttttttctagtcctgtccttacaatgatctgctctatgaccttcactaagtcacagtcttgccaccactcaatggagtgaaatctatgtagccaaaggaggtgctttcactccctccgggaaaagaaaaaatgagtaaggttatttgctttccaatctaaatattccttgctgtccaaacccaaacaccaaacagattctgataaattttcagatatacgccttgctattcaaaccctcgctattcactaagtccgaatcaaggagatttggatgacgggatcctcgtatatttttaacattaaatttaaaaacaaggcagggctcggtggctcacgcctgtaatccccgcactttgggaggccgaggcaggcggattgcctgaggtcaggggttcgagaccagcctggctaacatggtgaaaccgtctctactaaaaatacaaaaattagccaggcatggtggtgggtgcctgtaatcccagctactcaggaggctgaggcaggagaatcgcttgaacctagaaggcggaggttgcagtgagccgagattgcgccactgcactccagcctgggcaacagagcaacactccgtctcaaaaacaaaaataaaaataaaaaaacaacaaataacatgttaagtcttattagaagatagtacctttttaactgagccttgaacaagatcctgaaatctgactcaagtatttatcttcatctctttgagttatattgtattagactttctcccacttcaagaaacacacaaaatatgcccttgaaaactgctagaagtgcaggaagttgagagggaatcatctttcattatgccctgtattatgtttaattcaagcataattcagccagacgcctgtctctactgtctaggctcagtgcagggtcctcaatgcaacaagttagaatggtaggcagttgacaactatgccacctgcagaatgtaaaaagagtggcctggcctccaacctgaccaagtgtctttctatatattttttaacacagaagcagttaaagctcttccacttactgaagttcttaaggtaatctgataggcagaatacatggatccattatagaaatcacaaattcctttgtgtcacaggccctcaggatacctgcaccttacagtttcatggtttcattttttttttttttttttgagacgaagttttgctcttgttgcccaggctagagtgcgatggcatgatctcagctcactgcaatctccgcctcccgagttcaagagattctcctgcctcagcttcctgagtagctgggactacaggtatgcaccaccaccctcggctaattttgtatttttagtagagacggggtttctccatgttggtcaggctgatctggaactcctgacctcaggtgatccacctgccttggcctccagtttcatttcttaccgtttccaatgatgacctccagccacataaaactcattgttatttcacatttccatgccgttctcttgtccaagaataccaccctcacaccgccccatgcatgcacacgtagaagccacggtacatacagcatacacatgtgggcaagccccatgatcatacagcagaggaagtaagaacacaagcccttgtacctgagttcctgtcctggctttaccactttctagttgtctgatttgtcaagttacttaagcccctcctactctaatttcctcatctataaaatgaggataatgatcacacctatctcacagagttgttgagataattagttagtatatcaaaagtattttgtgcctggcgtatagtaaagcactcaggaggtatcactggttattgctttttttttttttttttttgagacagagtctcactctgtcgcccaggctagagtgcagtggcgcgatcttggctcactgcaacctccgcttcccgggttcaagcgattctcctgcctcagcctcccgagtagctgggactacaggcgcatgccaccacatttggctaattttttatttttagtagagacagggtttcatcaagttggccaggctggtcatgaactcctgacctcaggtgatctgcccacctcggcctccccgtttttttgttacggtgatcaaacattcagtatctagcgccatctgtggggccttcctccacctttgagctgcggctgtttagctacacctccttagtattcatctgagacaaaaagtggaaaaaggaatgcctgtaaggttaacttcccaaagtgtgccccagagcactggcgtcctgcaagaagctgacagacaggatagcggtctaaaaagtgagagaaatattgtatatcctagctccctggcagagtcagagcacatgttaacttactaaaggttctaaaaagtattttcaaagaaactggtttcatttattgaagtctagtaagtttccccaaacttatctgaccatggaattccccctaaaatatattaatagctagtagaattcacacttacaaaatgctacgctagggtcaaagcaactactgaaatggagtcaatcagaactcctgtacttacaagtacaacccacagacaatctcaaaaaaagggggtcagccaatattggtatataagtgcccactgtttagaatttatgcttttgtttctattcgtgttttgttccttttcagtctctctaattgaataacacagtcattatttaagtgagttttttccccaaggtagttcttgtaacaataaatgttaaagattctcatcattctttgcttttcttacacctacccaacctaacaactgtcaggcactattttaattacaattaaattgtatgatgttaaattttaatgtggtgtctattaacatgtagttttggtgtttctcttttttttcttaaagacagggtctcactctgttgcctaggctggagtggcatgatctcagctcactgcaacctctgcctcccaggctcaagtgatcctcccacctcagcttcccgagtagccagggctacaggggaacaccaccacgcccagctaatttttgtatttttgtagagacagggtccttcctatgttgcccaggctggtctcaaactcctaggcacaagtgatctacccaccttggcctcccacagtgctgggtttacaggcatgagccactgcgccctgccagttctggtgtttctctaaagaactgtcttcatatatttttcaattctggctctaaaacagttcctggaatggttgtcatttaaattcaacaaaacagcttgggcaacatggataaacccaatctctgttaaaaaaaaaaaaaaaaaaaaagaaagaaagaaaaaattagccaggcatggtggagtattcctgtagttccagctacttgagaggctgaggtgggaggactgtttgagcccaggaggttgatgatgcagtgagctgtgatcgcaccactgcactccagcctgggtgacaaagtgagaccctgtctcaaaaaaatacatacatacatccaacaaaacaatattccaataaatgttctcaaagagaaaacagagaatccaaggaaacaccacttgaatttcatttgaaccttataaatgattatttttataaataatgtatgtaatcctagaatgtactgaacacttactgcgtgacaaacattgctctaagcactctataggtatttacacactcttacagctgccctatgagataggtgttactactaatcccatttatagataaggctcagaatcacataatataggctcagaatcacgtaatataataaccggaagagccaggttataagtctacttttctaaatcctatggaattactttcaactctcccttggatgcagggacagccttgctgatgatattcatggggtcctggcctccccagctgtgaccaggctaaaaaggccatggtcctctcccaaactgatggaagagccttgtttccccaaagctatatcgctcaaaggcttcaatgagggagaaggaagaagatccgacaagaacagagaaaggagaatctctttaaaggcaatttcacatgacaccaataacaaagtttacagatgaactggttgaaatgtaaatatggtcactggtttgttcatgaccaccatttacaagttggtagtagaccttggctgtcaggtcaccccccacagaacaactttcagaggagatgcaattctgcaataatcataaactgagccatcagccaggctgttcgaggtccagttctatcgttaattggtacagtgatcctagatcactttgatttcagtggacctcaaaagtaagtgtggctctagaaagttctaagacagagaacagaaaggagagaaagaaaccattgttcagcttcaaaacaaaagagccaaacaaaacaacactacactgtaaaacacattataaaacaaaaagaagcctctttttcacaaatctttctcaactgatatctagaacaaactcaaacaaatatttaaaaatatttaacagatttagctgcaatcagaacattcatttagtgctcagtttggcttgaaatgtcccagactggctcccagtcacttccagaaaaccctacctcagccagagcacattttcactgatctttatctatgacaatgttccactctgctgacatcctccttcattgacagttttttccattcactgacctttcattcactgctgcactctagtgactccagtttcgtttcattaattaacaacagatgagacactgcctgatttcccttggacctctaaaaactaactgtggcctcaccagcaactcagttttgaaacatgcttaaaatgtccctcttcctttcgtaagttctcttacaaacaagatccacttcagaagaaaagttcatttatgcaaacgttctgctccaaatggctaacggagacaaagaatcaagcgtcctcttatctgcccttatcataactttgttgtcccagggactccaagctagattccattacaagacataacatcagtccgttatccgctatttactgtgaaaagcagtaccgaaaaactgataagcttcttgaaaaaatttgcgcctattttttaaagttgtctgaagacttggctcactgtccaatcttgccaagtttctcctattcctaattttatgctgtttatcatctgggaatgcagaaaacaaagtcatagtaacccacatgtgtttccctaacatggacctgaacctaagaatgactgtgccccctactctggaagtatctgtgctaagaggaaggaagacaaatacacagctatttccagcctgctgagaaacagggatgggcagtccctgcaggcagagaagcgtcttggcctctacagctgtggatgcacaggcagccagaccgcaatgctaaaacccatgtttctgttagtcttccataaatccaaccaaaagaatgcatgtttacaaataaaaacatagatactacttccgacacagaaaacatctggtacagcttctaaggcattcctcatttagataacaccttctcctaattcagccatgaaaacgtcttcccttaagatcacctccttcacaattccaattataaatatgattttctgtaaaagcaaacgtgaaccaccattccattttgggggggaaaaatctgccaagtaaaataaaatacatataacaactctactaaacaattccaattagtcactcttttctcttccctctcacccatgcaatcagttatatatcacagtattttctttaaatgaaagtatatttacataataaacaaaagtagcactttactgtggcttactgatattcttaaaatgtttttaaggccaaagttctaaaaatagatccctctccttttagcagttccatgactttaaagatggtttcctgcagggagagacagagggcctttccactcatgccttcatttaaatagggagcaagtcactagggatttatcaactggcagagccgccttcaaggaaggcagaatcaaagagaactgccctcccaccctatattgtgaatggattccatggttatacaaagaaataatattgatataaagctctactttatggaagacattttcctaaaaagtcatatgcaaatttaacttttgtattttaaatcatctgcatatagttcatatggtttcacagtttttgaactatgcggttaaattcttgttgttgttgttttttggagatggagtttcactcttgttgcccaggctggagtgcaatggtgcgatctccgctcaccgcaacctccacctcccgggttcaagcaattctcctgcctcagcctcccgagtagctgggatcacaggcatgcgccatcatgcccggctaattttgtattgttagtaaacacggggtttctccatgttggtcaggctggtctcgaactcccaacctcaggtgatcagcccgccttggcctcccaaagcgctgggattacaggcgtgagccaccgtgcccagccattaaattcttttgtagttctcaagtagtttaattcttttgtaaaacaaaactccctttttgtaacataaacacaatcctttcatttgcttattttagaatatatgtgaaaaactagagtacaccttcacctgtagaggacagttctctcttctctccatactggaaagaaaatctgttgctttaccatcacacaaaggagacaactctaacattaaaaatggaaaatactgaaaatgtttattttgcagtaaagtactttaattgctcttaagagtaattctgttatgcctcagtctgacatgtctgatttaggcaactttattctctagacactcaaaaacagactaaagtatggtcacaattctttcgggatcagcagacagtaaacatggagagttgaaactagttgaagaaaagaaaagaaaaaaaaaagcaacataatttcatacccctaaagaaagcaaacaaaatatgtaactaatgtttcaatgtagatactttggtctggataagccaagccacacaggtttggtaaattactcctaggaaggtagagagcatagcattttttccacagcattagcagcattccaccttttcccatatagccaactctccaattgagccatactaaagagaaaaatcccaaatgatctaaagcattaatttaaagctcttattccatccacccccatctactggagcacagaccaagaggagagtggatagatacgcatttctctttcaggaaggctgacaagtagcctacatctcacaaaacttatcccataaatgacacctccaaaagagcttgccctatattaaacaaccctatcacgtgacacagttgggaaatgggaaattctatctaattttggtattaggacatatgcaacagttatgacatacacaacagttatgacatacacaacaaatgaatgaaaaattttcaaagcaccagcagacaaatcactaaacactaaaattatgcaacttataatttcttatgactcagaatgtccagatcttataactcaggataatatttaaatcaactccatcagcaacatccagatgtgttattcaagaaggaagagttctcagaagatgtagactggtaactattctgctgatcttttaaattggcaatacataactatgcccagaaaaactcctcttaaacgtcctgaaacaaagattgttctaaagactgcaaccagaataacccatcaaaaggaatacagccagaatctaccacttggctgaacagaattaacaagctctgtaggtaggagagccagagtcacagagtctccctactattttcctaacacatctgtgctttcccgcctttaggcttttgaaaagtcaacctttccaatccattttgtatttccttctaaaccacaggcaagcacaagttacacctcttctatagcagtatggtcccaaaatttttttaccaggatcaacaaaatacattttacactcaaaccctctgaacacctacacatactcaccactaagacaaaagtttcatgatactatcttccctaattctgttgcgtttaaagaaaaaaaaaaaacaaacttccttgagcagcgtatctagacatggtccagcttagaggctctataaaatttataccaatcatttggcagtacctaccactgacctagtaactgtgaaataactgtgtatgtgttgtgacccgtcttacttctccagctattgtgagctgcttatggataagaattatccataattctttgtaattacctcagcatttagcatagtgcctggcacataattagaattcaataaatgtttattgaatccttccttgttacaatgaatagctgttgatggacataagtcttgtatatttttggtgttccgaaggatttcctgattccattcaaagccaaaagctagttggtgtgggtgggggcacaaaatctgcttcctattcctagaccacaatgccccagaagactctcagggtgagtgaggaggcacagggcaagaaaaaaacattttttcttctactacaggaaaaaagataaaattggcgagtgtcactttggttatccaaaagcgacactgaatccttactatgattctgctgtatccacaggactttacataaaagggaaagaaaattttttctgatgcccctaaatggcgcaggactccacaccggtgtggagagtcccgtaatatatctccatggctcagggaatcagggcacatcccataggaaaccaatgagacaccaactatgattataccccagatgaggatggtgtggctgctggacatgtctataatcatcatcaaaatggataatgaaatgagattatccataggggaaacttgatgagtcaagaggaaaaaggaatacaagtctagtgtctggagaattattcaagaataaaatctgactaacttgtaaactgtccatgaatcacactatacagctcacttctcaggctatccatgtgaagcgcaaagctttctaagccatctagccacaggctctcccctaagaccacttctgtatattccactctgtgtacagtcctcctctttggccaactacacattttgacaagagacgtcatagagcagtgagggagaaagggataactgcgtttcacatataagttcaaaaaacacttaatagcacctactatgagtttgacatagcgctaggtaatggaacagtggtgaccaagacagagagccttctctggagttgacagttttatgggataaactttaaccaaataattagatgaataattaactaattatggtaagtggccaaaggcatatggaaaccaactttgcctggtagctagggaaggcttgacaaccacattgaatctagcaggaaaacaactaggtaaatagcagagagaagagcccagggcagaggacagagcctctgtgaaggcccagggtgcatgatgtcttaggtttagagcaacagggaggaggcctaaggagctgaggcaaaacaacaactgaggacttaaagtggcactggatgaagttagcaaggtaggcagaagccagccactgcagggccttgtgaatcagttaaaaattttgtaacttatcttaagagcactgcatattattgatgcatattaaactgggaagtgatgtaatctgaattagttaaaaacacaaaataaaaatgtaactttggctgcagtgtgagcaatggattggaaggtggcaagacagagcatgtgaacagatcagttaagaggctcctggagcaacctgggggaggaataacattcaactgacttcatggtagcagaagaccagaaaaccagacagaccgaagaggttggaagaaagatctggtgactaagagatgacaggtattgcagccatatctccaatagctcacaatacccatcaccttaaagtacaaattcttccttctgatttaaagagcttacataatttgatctcatgtcctctcaattcccatttctctccttcacaaaaaatccactctggtctgctcactgcccctccaaatctatgttcattcctgacatttttaatcatgttctttccccctcagaatgcgcagaaccctccctacccaaatcttactcctcatctttcaaggtttgattaaaattccactgccctaatcaagtcttccctgacttctgcagactactctgaatcatcccttatcactgtatcatacattttagcaaatgatcatatacttctctttctttcatccactttaggtgcatttccccaaattaaccactacattctcaaaggcaggggcaagccttttgcttttccaatatcttcacccccgagagcccagtccaaggcacagccatggaggcacccatcaaatattgagaggctgagtgagtgaaagggctgaagaatatgctggacctggtgtttctctagactacacagctgccccacctggggcaagggaagattgatgtcactgttgtcatctgggatgcttttgtttggtttgtgcacaatatcaggatggggaaccaaaggactatctttaagctttagttggctctctagtctgtttgtttcaaaagacaatctcaagcatgtgtcttagccactggtagctgggaagagacatgactgactctccacactggcagatagcaatcggagaaaagatgatccaatttagacgaattcatgccaactgagactcagaaacagagccagaaatacacagcagccagtgagcaaacagcacctttttccccagctttattgaagtatgattaacaaacaaaaattttatctgtttaaggtgtacagcatgatgatgtgatatacatatacacttggaatgactaccttacctcacatagccatgctctttttgttgtggtgagaacacttaagatctactctttcagcaaatttgaagtatatggtacgtttattgtcaaccgtagtcaccatgctgtacaataggtctctagaacttactcatcatatcactgaaagtctgtactctttaagcagcatctccccattaccccagccctccagcccctggtaaccaccgttctactgttttcatgagtttgactcttttagatccacatgtgataccatgcagtatttgtctttctgtgtctggcttatttcaattagcataatgtcctccaggttcacccatattgttgcaaaatggtaggatttccttcttttttaaggctgaatattccattgtgtgtgtatgtgtgcatacagcatctatttttagtctgttttcagtgactctcagtcactgtagttttttagacccaagagcagccagttccttaataattggcatacttttactgaaatccattaatttcaatctcatttaccaagttctacaggattcgaaatggaattactgaagatttcccttctccagacaaaggagaagaaacaccaaactagataacagaatttatggtaatagcacaaagagcaaaatccataaccaggaagatcaggttctatcatacctccatgaggaaggacagtaatcaattctattaaaccaaaagtatacatttattacacagaactgtcatcagaatctagatccttattaaattgaaaatgtgtagagtctaatacatttttgttcactcgtaggtctaactacaatagttaagttcaactcaaaacgaagaaatgagtatttggcctttaaccatagcaaacattaatcgaagacctttgctgtgttcttaataaatggtatcttctatccttattcacagctatacaccagcataaaacagagtagacttttacttgatgatctcttctggctaacatagtttaatgctttaaaacaatttatatacagtgtatttttatagattgctatattctataaagtatgaagaatatgactgaaattctcaaaaagactgagaaagagctattacaaaaagagcctttcagaataagcctgatctgaaatgggcacccttgattcccaatctagcctcctgacaaaattccagaagactctggaattacttgtggatgtgggccttgggcagcaagagcttgggagagtcactcagcagctctgttattttcctcatttgtaaatgaaagggctgaagtctgtggttcatttatggttttctcccgcaatcgctgtagggttattctgtgctgcatcacaggacagaagggagtgctgtggaattaataagcctggcagagcccttttgcttttactcaggctgtactggggaaagagaaggacatagtagaacagcatttttcacatgcaggttgatctttatttctactaaattaacccatttactctcttttccatatgtcagcataaaataaaagcccaaattcaatagttttcctttttttcacatatatttacttctaatctggcgctcttagaaatagacaagtagaataaactgatacatagtgaataagtaaaagccaagaaacaagtttatttttcagagaactagttttctgcaggttgttgaaaacaccaaaaaagttgctcaataaatcaatgttggcaactgattttttgggttttcaaactcatactgataagtttcttatttttttttgaaggatagtcttttagactattgatacagaaatttcacatccattgtctaatacaatcctcataataaggcaagcgttattatctctttttaggagctgaaaaaatacaagataattcaggttaaatgacttatccaaagttgccataaggagcagagacacacacagaaaacacaggctacagctttgacccctagtccattgttctttccagcttaaagggatttcctcaatgcagatgttagatcacctagggaatgggtgtgggcatggcactgagttgatcagaagaccctgaaaccttctgcagatgcagatacagagcctgtgctcaggtaatacctttaccactaggacctagtttttcttcctcctgctcttttctgatcctttttctttagtcaatatctaaagtttagcagtaacacgaaagatattaccaacccttgaaaatggttccttttttggattctccaatccccatctctccccttcccctcaatcttaaatcttacatctgcaggagaaaaaacaagaacaggcccggcacatggcatagagcatggcactacctctctctagctctaccttgtgtaatttcttttttcttcttttggagacagggtcttgctctgtcgcccaggctggagttcagtggcacaatcacggctcgctgcaacctcaaaactcctgggatcaagtgagccttccaagtagctgggactataggtatgataccaccgcacccggctaattttttaaatttctagtacagacgaggtctctctctgttggccaggcaggtctcaaactcctgagctcaagtgatcctcctgcctcagcctcctgaagtgttgggaatacaggcataagccaccatgcctggcaccttgtacaatttctatacccagattacctattgctcccaggaagttggtcttctctacgtttatgacttctcattacaagttcaaaatatagtttatcagacacaaaggactttattaaaaagaaaaaatatatagtttattctgccaatattttcctataattctaattatttaatatacttaattatataagctttcctgaaatattctcaatagaattagattcttttcaaattatgagaaacccagttaatttttttagccaaataggaattacagcatttttcccttccaaaagcccatcctagattataaaatcattattatgatacatttatgttacacccatttttttactctattaatatgcttttttttttttttgagatggagtttcattcttgttgcccaggctgaagtgcaatggtgcgatcttggctcaccgcaacctctacctcctggattcaagcaattctcctgcctcagcttcctgagcagctaggattacaggcatgcgccaccacacctggttaattttgtattttttagtagagacggggtttctccacattggtcaggctggttacgaactcccaacctcaggtgatccgcccgcctcggcctcccaaagtgctgggattacaggtgtgagccaccgcacctggccaatatgaattcttaagtctaaatttcaaggggggttgtggggaagatatgcaggtctttaaattgtacttattcaataacctgacttcaaaattgaaaaaaaaaggaaacaatggtttgccattacctacccattaatggtaatagagaactttttttttctttttgagacagagtctcactctgttgcctacaccagggtgcagtgatgcgatcttggctcactgcaacctctgcctcccgggttcaagcaattctcctgcctcagcctcctgagtagctgagactacaggcagatgccaccatgcccggctaatttttatatttttagtagagatggggttttgccatgttggccaggctggtctcgaactcctgacctcaggtgatccacccacctcggcctcccaaagttctgggattacaggtgtaagtcaccatggccgggcagtaatggagaactttctaaagcatccaaatttgttttttttttaagatgagattgctactgataattttgtgttttgtttttttagagacaggctctctgtcacccagactgtagtgcagtgttgcaatcacagctcactgtaacctcgaactcctgggctcaagcaatcctcccccatcagcttcccgagtagctggaaatagaggggtgcaccaccacacccagctgctactgatattaaaccctttaatccactgggagtgaaacaatgctatggcttagtttgacttggttagtaggttatttactaatgactagagcaatcaatttacatttacatttttaaaaatacaataattattctgactgttctcaattaacatgaattcaaggacttgcgtattcctatgagtggagctagatttctagggttgttagctctttatcaaatatcagtatttaaggaccacagaaaattagcactgtttcactacagcagcattttcatcagattttaataccatcttcacatctgcttatatggatgaagaaagtttcatattagatattttcccatcgcagctatatatttgctttatcagaataaatacaccttccaaatcacctattttgaaacaatctgaagttttctctactttcagacttcatcactgcttaatatgcttatattctagactgataaatcataggaaatataaacaatataaaaccttcaggtaagctaatatcaaaatatttactgaaaacttaagaagggctaggccttgcgggaacacaaaggtaaacaagacctggtccatattaaaaaactaagcccactgcattcctgtagaggttccccaaatcccacttccttctccttcagtaatccttcatttttcatgaccatgtaagtaggtcctccaggtaagtgtcagtctcctcttgtttgaaggaaaagagctcgttaagatactgctatcaatttcttgggagtcctcttgttctccttattcacagtcattcttccgtgggtaaggtagccctgagagtgtgagtagatgtggggccacaattcctcactgccatagctaatgaccataaaaaccatctcacatatctgatgctttcttttctcaaggtggctgaaagttctaaaccgatggaaaaattattccaagaaaccactttgtctttctattaccatgtccaaacgagactgacaacaatctccaactgttgaaagtcacaggggcagtttgtagtgaaaattgtctccagtgaccttgtaacttacagtagcccctgtgagaaactagggtgcttttcagttatttctccccaaccaaaatatttaagaaacttttgtcaatatgtccttctgtcccacatccctggcttgtcctctgagcagctggacctttgcaataaaacagtttcccaagaattgatggccaaaccttctccaatactgttatccacttaccccaattatctacctaccctgacgaaaaaattcactaaccaagagaatccccaattgcttttggatgattgggaaggcttctaatcatctagaaccctctcttaggtgtcacaagaaatccagctgctcagaaattcccaaacaagcaattcagactctgaagtcacctcctaagctaatagaaacacaggattctggaggtatggatgaagatatggtgctactaatacatttaatgtggctcctggtgctgcctccatggacttgccgttaggcctaagaaacacttcctgtttgaaacagggatgtcagggtgttctgactcagtgtgtcacaccacgtgtccctagagttgacatagctaatcaggcagtcctgtttcttccttattgcccagtgaatgcccctcccaaggctacacaggatagattaagaaccttcccaggtaacaaaggaatgctctttggtaaaggagtaaagggtacaagtagctaaagcacctgtgctagaaactcaatgtgagctcactcctctggggggctgtctacttgaccgagatgttgagtaaggtctccccatagggtaaaagtaactcaaacaagaacatggtgggataaccactctgtcacgaagcacatcttggcatattgcttctttaagaaagactctggctgggtgtggtggctcatgcctgtaatcccagcactttgggaggccgaggcaggcagatcacctgaggtcaaagttcgagaccagactggccaacatggtgaaacccggtctctactaaaatacaaaaattagccaggcgtggtggcaggtgctcagaatcccagctacttgggaggctgaggcaggagaatcgcttgaacctgggaagcagaggttgcagcaagccaaggtcacaccaccgcactctagcctgggcgacagggcaaaattctgtctcaaaaaaaaaaaaagaaaagaaaaaccctgatcccattaacaggattccaaggtaaagtccctcacacagtggccacctgaaacatgaaatgagttcctaaactcacccaattagtttagtgaaatgctaataatagctgttacatttaacacactcatactcccagtaaaagaatgtgtctatcaacagagacagaatctaatattataattctcagttacagacttctgaaaactacattctaagacaagctggcttcacttaagaacactaattgaaagatcagacggaatcacagcataaatgaaaggtgtacagatagacaatctgaaaaagatgaactatccttgttcttagagaactgaggaaaagcttgtgagagagaactggagacatggaaatcttatctaaacctgcccagagtttaaaattattaacacaccaacaactaattaatcttaatgttttgtttttcttagaccaaatgtttaaaagcactcttgcctatcactgaagctgaatccgcccaacacagcagctttatgttaaggttactgtgtgttgtcaaactatattcccagctctatgagcccacagggcaagggaaaggattttcatttgcaaaacgagaagcaaaggatgaatagccttctttggaatttgatgggattaactcctacaatgccgtcctccaggagagatatagaatatttggtccttcccacacactttataagatcatctggttgcttagcatttctacgttgagacttttttttaattataaaacaaataaaaatatacaagtaacttttaaaacaattcccctaattaccagaagaaacattctgcacacattctccccctatttcattgtttataatgcccagaaaggtgaccataaggcttatctctggagtccgctccaactataaatgttaagtaagagtttgacactgtaatattggtctggttcttgccacaggggtgggaactagcaggagctgagatgttcatcatttggtgttcttacatcacaggtgaatggaaaaaggcagacagaagcagctggctttgagctatccatatgggtgtgcaaatctatgtggcactaccagttaatagcaagcaaagaggcacttgagccaagtcaaaaatacactgacctatgtggaagaatgatatagtattcaagttaaatagaacggtgacatcaatcaaaagctataaataaatcattttacacagcaaagttgggatgatctattgtactgagttcacagtgaaatatgcttactcatacagctcagcaagattctgagtccttttaattccatcacgagccttacctgcaagcaggtgaacagagttgaagctcttctccagtttacccagaagtacagtgagaaaacagtctgaagagagagaggcaacatcttgggagctttgatcgtaaactacaaccttctgactgcaatcaatgtcaacctgaaatgcaaacatgaggcttgttaggaagaaggtgagaaaagtaatctcaaactactgcttaagatctcacatttaccagtgctggggcgaataattgcttcctgttttcaattaataatttgaataaaaatgagatgtagtcaatttacgagacagacacatacaaaactcttaaaaaccaaaatgatgctatttctgtgtaggtgatctcacgattccctggttttaaatcctttatactataaaatggtaaagttcataataaaccaaacaatatgcaaaataaacataaccctggacctaaacaaactttttttaaaatgacttttacaccttaacaaagaaatcagttgtttatttaaattaaaacatgagctcatttgtatttgtgaagaaaaaaaccaacttcctcaccacacagacaacattttagtatcccaggaataacttcccttgaagatatcattaagtcttgaccaatgttaccacatgtgttatgacacataaaaagcacccctaataattagttcctactttctttccaaagaacttgaaaagaatgactttcctttcagtaaatttgcagataatatagaatagtgtttaataaaatcattttagcaagccacaagaaaatatagcacttgtccaaactaaagcaagttaatccttcatagtttagaaatattattaaatgtggcaatatggacaataaattattttgaggtaccacaaggcaccaaaatttaaaaagcaaccaaaacttcctcaaattactttctctacttaaagaggaggcttcaattaaaattattcctcattcagtgtgtccatttattttgaaaaggcaaaaaggaaagcgtttaccttatgtttcgctgaatgctggatgagctctgtaattaacactttgtcctgttgcaaccttcgcttcataagcttggagcagttgatattaatggcttccaaaatgtgggatgtattgtattccacaaatggccggctatcaattagcagcactttttccgttccactttccagcagagccaccaacctctcagtaacaatttgagttccaatcatctcatgggccatgacaacaataagtcctcttttcccacctccttctttaatttgccacgatgatgtaatggtggtgtgctcaaaggctcagccactccattgtactaaaagtgtatgaggtcaggctggtggtgactggcaaaaggagagttaaacccattttcagcaagagccctccaagtgaatgtctctttctctttcccgttgatgtgctcttgcaaaggactccgtccacaaagcagcccctcacatttgattcataaagagatgactggaataaccattccacaacaaaagatgctttggagcagccagcgcattacatcattctttacctttgctcccgcgctccaacagctttacactggactgaaagcctacgcggagagagaaagacagaaaacaaaacgtgaggtcaaaaaaagaagaaagagtgtcagattagagagagtgtatgattcataatatttactccattaatctaattccatacttgatgcactgcttcatttgaacaaacaaataaaaaggacaaattggtatggcttcagaaaaatgtgctagtgataattccattttacctcaaaatgtaaaaactcaaagaaaacaaaacaagacatatcatgaattataatcacctagggctcagaactaaatgacctgtagtattgaattaaaagggctacaaaaagctgcttgaagtattattattccaaatagttttcctatattttatttgcttatttattgaaatcccacaaagaatggcagctgaggacaaagttagcaatcctgtgttaccaggacaaaaaaaaaaatattttctgaaatggcttgagaattcctgcgatgaatgggtaggtgtatatgtgtgtatgtgtgtgcacatgtgagctcacgcgagtaccagggcgcaaacagcagccttttaaaattgccctcacggaggagagaagatgcaggaaaactggagtttctataaatttcagctatcttttaaggaagaggaaggacaaaaacaactgatatgtttgtcacagcagctgctgagctaggcctgtgaagtgctgaagctcacagccatggccctgtcatgtctccttccggaggccatctccctaccaccaagttgcttaaggccctgtaagcttatccttcactttttcctgcttcattcttcagagaatcactaactcctagtcttaaaaaaatctcaccccttaacctggaactctaagttggcaacccagacatagagagcccttaaagctgaacccagtgcttccctttcttgccaaactcctttaatcaatcactttctaattaacactagttgaagttttgcgcttattgcttggacttcaccttgaccttcaatactctcggattcctatctcccctggtccatctctgcttatatgaaatcctctactacataaaactacatgtctacttctggcactgaacttctagagggtaaattttttttttttttgagacagggtcttgctctgtcacccaggctgcagtgcagtagcacaatctcagctcactgcaacccctgcctctcaggctcaagtgattctcctgcctcagcctcccaagttgctgggactacaggcgcgcaccaccacacccagctaatttttgtactttttgtagagacagggtttcgccatgttgcccaggctggtctcaaactcctgggctcaagcaatccacctgtctcagcctcccaaagtgctgggactacaggtatgagccaccgcacccagcctagagggtaaatatttgattgcaaaagtttattatatttcttacttctacagtactttggacataacatactcaatatattattatagtaggtaaattcttccttgttccaaaaacagtttaagattctaaataaatatttgattagctgatttcaggtcaggatgtcagagcctttaaaaacctttagatcatgtttcctaattttgtacttacaaattagaagctaaagcatggagacagaaggtggagcatgatataaagagatgtagctttgccatttacttatgcaaccttggacaaatcacataacctctctaaaccacagtttcttcacctacaaaatggagacattatagtggcctcatctcttcaaatttggtctgagaacaaaattatctaatttattgaaagctggtaaataaaaaagcaactatgcatcatagacaggaggaaaaataccctacagatgccaatggcaaacaaagctggcttgcatctggcatctgaaagacatcactcacagataaaaacagatgtaattccatcctcctatagtacagctgcaaccaaactgtgccctttctcacagaggctgacacacagggagttagaaggcacctgagatactgtctcaaccacaccatattttacaaaccagctccatttaatacattatatttccatttcttattttccaagaaacaactttcattaatgtattatttttagcatagctttatggtaatgaagtacaaaagtcatctctattttcaactgaaggaactataagagagaatttgtcctagtcaatccactaataaacttctgcaaagcgcctaccaaagccataccactcaatcaggttctgcctgctcagtgacagagttcacggcaatgtaaggtcctgtattcagattgtctgattcccaaaccagggcttctactactgggttgccctgttttccctaagtacttgttcccataatggaactggactgggaaagaatgatgccaattgtccatgagggtacccaggtggcacagaaagtggaaatccgagaacaagagcaagttgattccaacaatggcactgggtctctgagtctgattggctcctctcaaagagataaaatccggatgggacaaagcagttatctgggttagcagatcaagggacaaaaggagggagaagtcagcaaacatgcaaaagttgaattagaaagttctcatctttgcttcccctcagccaattctcataaacccaaagacaggttacaacaaacagttctacagagcagagaatgtcattcttgcccagagaatcagagcttagttacagatataaaaagaccctttccctgaccaagaaaggctctggtcaaagtgactctaagctgaggatgtaagtgaagcataggggtaaaagtgaagtgagggtgaagttccattctttcagtgctgtactgaggccagctggagtcctcctggtaggacttcatgcccaaggtctaattctctgtagtgctaaatgggtgaggtgagaggcagagccctgccaagggatcatggagggtaaagtaacaatggccttaatctctttcatttacagttagagaattttggttaaatctccatcactggctatgagtctaattttaaaaatttctctgtagttactgttttgttttcaaaatcctttgcattaggtaagatttgaaagatgacaagagaatattttgcttgcaacatcaccaagctaatcttacccagaatttctataagtcaaggggaataaaaatttttacaatgaaccacaaaggctcaagtccatagaacaaaatccagagcagaccagctttgctatttatctatttatttagccagctgctaaagttgaaatactttctttagatttttaaataggtaatatattcatatggttcaaaaaaagtctaaaaatgtatacatagtatgaacgtgtacagtttattgtgtcacttatacatcaataaaggtgtttaaaattgccacgatattgaaacttcagcaaatacatttaaataaaaaaaaactaaatatattcataatccttcttctaccattatcctccatctgcctgggtcccaaccctgccctctaactggtaacaacttttagtagtctcatctaatttattccaaagatttttttaaattaatatagaatgaagcacaaatatacacacttttccttctctttgttcaaatggttacaaagtatagacactgtcttgcatcttgctttttctttcacttacagtacttgaatctcatttttttcaacatttaattagaaaatgaatccatctatatttccatgggccttgcatatatgcatgtctggaaatctaaataaaacatgtagaaattcttttttttttttgagacagagtttcactcttattgcccaggctggagtgcaatggcgcatctcggctcaccgcaacctccacctcccaggttcaagcgattctcctgcctcagcctctccagtagctgggattacaggcatgcgccaccacacccggctaattttgtatttctagtagagatggggtttctccatgtcaggctggtctcgaactcccgacctcaggtaatccacctgccttggcctcccaaagtgctgggattacaggtgtgagccactgcatccggcgaaattcttaaacttaaaagataactccagctgggcatagtagctcatgactgtaatccaagcactttggaaggccaaggcaggaggatcacttgagtccaagagttcaagaccagcctgagcaacacagtgagaccctatctctacaaaaaattaaaaatatatgtatacacacacacacacacacacacacacacacaattttcccccctagaattacatactagagtacctaagaagctgacaagtaactcataatagtgtgctcaaaaggttagcaaattaaatgctgggggtcaccacagctggcctgttttatgacatactagttagagagtaccctctataactactctggcttaaaagaaagttaaaatgtgatggtgaacattcatgaagttatggaaattatcttttaaaggataacctaaagtcagcaaggcagtatttatcaaactgaagactggtaaccttaatcagggctactacacaaaaaactgcaaagtatcccaagttcaaaataaaggttttaaaagactatctaggaataaagataaactgagtcaacatcttagtataacaaaatgactacagatcatggaagaaaatcagcaaatctcctaaagaaataccatttctggtatatttttacctttcagcaaatgatttatgttttatattttataatatttaacacaagttgtataacaactttccccctttaatatacaattttgtctgtttttatatgtaatttatttttatttagattccatttggttacttatggaaatgtatttatgactataacagaaatcactggagttttatttcttgaaattcactctatatccaactctgcacaaatacggtgtatcaatgaagtatgctactgaataagttatgtttaagaactgtaagtctatttttatgttaaagtgaacaggtagggcctgtttcaactaagagaacaacataaagtctgtataaaaccagtatttgccattaattacttaaaaggaaaatgttttgtttcgatttttattacttgtacacttcaaaatttgtgcctagccagagaatcctttttttaagattatttttacgtgattatattaaggatcttcttctgcttcccagatgatttttctcttcaacttcccaaacatgatcctgggttctaggtcagtcatactgacactgactatatcccactcagaaaaaaagtgataatcgctcacacacacaatttttttctttctacccatgggttattttctgctggcagcaatagtttcatctgctactgctactgctgccctaaaacacccactcccaaggcctgcatcaaggcccacagcaggggatggggctccaggaggaagcggggggtcccactcagagaggcacaactccattttaaacattttcttttacaaagagaaattatcagggaaaggaaaaggatcccatagctatggggtgcttaacaggcctgttgagtgaggagagggatttagttttatttggttgggctagagctcaagttcaaattctcagtttatggaaaggatataatcaggtgagaagtttacttttattaaactacaagcctgacttaaattttttccctccaacaaaactgaagaaacaggcaacaagatataccgaaatgcctttcaatagagccctaaacacaggctttcaataacaggaaaaaaaccaatcaaaagggaaaaaaggagactatcatatctgcaagcaaacaagaactccttagactttgactgcctcaatgctacacagattaaagcaactttatctcataagctgtgggttaagataaacttgatagaaattctgagctctggtatttggcaaatatattcaattaaaaaaataaaaacaaacacaaaaaaccaccctcaccaaaatcaagaaagctaagaacttggtgcggcaaaccaccatggcatgtgtatacctatgaaacaaacctgcatgttctgcacatgtaccccagaacttaaaagtataatatatactttataatatgtacttttatttataaaagtataaaacaaagtaaaactacaaacttaatgtgctttttagctgcctattaatgtctgatcatatttccttacccaaaaattgaggacacatattctgacaagtgatggcaataatgagactgcttgaagcaaaactatttagatgatactagacctggagacagcagttatccgcaccgtagaacccagttgcctcgcactgacataccacactgttgaaagccgcccctccaatcagaggttcaggttgtttacatacatctcaaggacccacagataaaggctggaatagcagtcagccttcaaagactacctataatgcctgcgcttttaggcacaggccagcccaggcagaggccaaatctgtgagaagccttcaccaaagtttctgttcagggcaaggagcactcccctcctggtattggctcaatcagagctcttgtctttttcttagtactgcttcctgtttatgatcacctgtttcacccgcttccccttccctgacccacctgagctctcctcctccttccccctcccaaccttcctctttccctctgccacccatgtatgtatcctagacacactcctcctggcccacaggctccttcacctacccctctacacttaatgcttcctccagacacgctgcctgaaaactcaggaccctacctactgggagaggggccggtgtatggaggtggtcttgggagggtagaaatggaaggatccctggatgaagttactgggcaagaggaaatacggccagggattggcttaatctgagaattgaggagaaaatgttttagaagggtattttcagtaaaggtaggctggaggcaggagaagaaagatttagaacaagccaaacagaggtcagatggggattaattcgtgcatcctggttttcttgaacatctgccaaatcactataattcatcaggcctactgtaactaattcagtcaactaacaagtacttatttggcacctaatatgtgccaggcactgtgaaaatgtagcaataaatgaaaaaagtattcattataatttataagttattaatgtactgcctggttataaattaacaaggcaaaaattactgcctttctggagcttctaatttagtgatgggggacacgatcaacaacaaaaacaaaacatttcctatgatagacgccgataagaactagggagaaaaaatagagcaagagcaaagggtgtgcgggggtggctgttaaattgtaaacagagtagtcacagaaggccttaccttgagaacatgagagaggagagtggtaagagactgagctatgtggatacctggaagattgtagctttctggggccaatgaatatactagccaagataatgctgaattgggcaaataccaataaaagatgtggcaggtgttcatgctttgttcagaactatggttatatctattggaaatgatgcatttccaggaaactgaacttttgtttttgttgttttttgagacagggtcttgctctgtcacccaaggctggaatgcagtgctatgatctcagtttactgcaaccttcaactcctgggctcaagtgatcctcccacttcagtctcccaagtaactgggaccacaggcatgtgccaccacacctggctaatttttatttcttgtagagacggggtctcactgtgttgcttagtctggtctcaaactcctgggctcaaacaattctcatacattggcctccaaaagtgctgggattacaggcgtgagccactgtgcccggccaaactttttaaattaatggataaaactgtatgtatttatcatgtacaacacgatattctgaagtagatatacactgtggaatggttaattctactaacaagtgcattaccacacatagccatcattgttgtgatgagaacacttaacatccactccttgaatttttcaggaatactatatatcctcgttaactgtggtcaccatgctgtacaatagatccttgaacgtatttctcctaaataattatttactttcaccaacatctccccaggcttcccctccccattaaacatcccagcctttggtaaccattctactctctacttccatgagatcaactttttcagctcccatatatgagtgaaattacacagtatttgtcttcctgtgtcttgtttatttcacttaacacaatgtcctccaggttcatccatgttgtagaaaatgacaggatttccttattttttaaggctgaatagaatttcattgtgtacatatataccacgttttctttattcattcatattttgatagacgcttaggttgattccttatcttggctattgtaaatagcactgcaataaacatgggtatgcaaacatctcattttctttactcagtaatgggattgctggattatatggtggttctatttttaattttttttgaggaacctccatagtgttttccataatggctataaatagttcatatttccactaacagtgtataagggttttcctttctccacatccttaccaacactgatcttctgtcttttgaaaacagccatactaccaggagtgggatactatcttactgtggttttaatttgcatttctctgatgatgagtgatgctgagcattttttcatagacctgttggccatttgcatgttttctttgaaaaatgtcaggtctttcacccatttttcaaccaagttacttgctttcttgccattgagttgttggagttcctgatgtttttgaggtattaactatttatcagatgtatagtttacaaatattttctcccattctgtaggttgtctcttcactctgttgactgtttcccttgcagtgcagaagctttttagcttgacataatcccatttgtctatttttgcttttgttgtccatgcttttgaggcaggcaattgaacttttagcttcagtgtgaaaaaacatatatataagaaaatttagtacaatttcttccttaaaactacaaagagagaaactgtggttcctatacagtgcatttcttggcaaagaaatgaaaagaaatcctgtaacaagaaagattactattaatgttaatattatacattttttccaaccccacaagtgtgttgtatctactaagagaatcttagttttacaacatggaatgtagtaaaatatcaaagacacattaagcaagatatatgtgtgaaaaaagtctatacaaggaggtagtttaaaggatctttacattaaaaattttttaaatgctttcaaggttctctccttgtcagaaggatcaaatacttaacacaaggcctttacaagttagattactatattgaaggggttgataacactaaaataagtttataatctttatctattaatatatgcaccccctcctttagtccacaccagccccagaacaacaaaattccaatacatgaaagatatagtatactttgttgacaaagaactaattgactaaaggtattaagaccagagtaaacatctgaacaatttggaacacagtctaaggggagaggggttataatttaatttttccaaacaggactggaaggctctaggagcaagcaatggaatgcaacaccgacaccaaacttctcacccacctgcactcaagctcaagctcacaatagtaatattccataatttaatctattttaaatctcttagtactaaaataaataaaattagaatgctgaactacattctcctgaagataatttcaaaatggctcacagaataaattcaaagtgacttatggctgggcatggtgactcatgcctgtaatcccagcactttttcccagaatttttccaatgccaaaagtgtgttgtatctactaagagaatcttagttttacaatatggaacgtagtaaaatatcaaatacatgttaagcaagacatatgcatgaaaaaagtctacacaacaaggaggtagtttcaagaatctcctttaaactacttttgggaggccgaggtgggtggatcacttgaggtcaggagttcaagaccagtctggccaacagggcgaaaccccgtctctactaaaaatacaaaaattcaccagatgtggtggcatgggcctgtaatcccggctactcgggaggctgaggcaggagaatcgcttgaacttgggaggtggacactgcagtgagccgagatcacaccactgcactccaacctggatgacagcgtgagactcatcttaaaacaaggccgggcgcggtggctcacgcctgtaatcccagcactttgggaggccgaggcgggtggatcatgaggtcaggagatcgagaccatcctggctaacaaggtgaaaccccgtctctactaaaaatacagaaaattagccgggcgcggtggcgggcgcctgtggtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaacaaaacaaagtgacttacaagaaagtgctttatctttcagttaaaatacacatgaaaaaatactggaaaaggcctacatgtataagaaagggacagactggcttaagtaacttataaattatgataaatcctgcaacatggtatgcaacatttaaaaacgatggtgtaaaaatatacttattgacagccaaggatggtcatgatatattgagaataaagtcaagtctcagaacagctaggtaaaatagaacctcaaacacccacaggcatacaaacacatacgatggatatgtataaaacatagtaatagttttacttaggtaattaaacgtaattgtcatactcttttccataaccttggaaattatgaaaaatattaatataaggtcatgacatacattcagacccaggaactattaccaggtcctactgtactccttcttctcaggaccattataaaagtttgggtgggcaaaggttaagaagatgagaactgggcacagtggctcatgcctgttatcctagcactttgggaggccaaggcgggcagatcacctgaggtcaagaattcgagaactacttggccaacatggtgaaaccccatctctactaaaaatacaaaacttagctgggcgtggtggtgcatgcctgtaatcccagctattcgggaggctgaggcagcagaatcgcttgaacctgggaggcggaggttgcagtgagccgggatcgctccattgcactccagcctgggggacgagagcgaaactctgtctcaaaaaaaaaaaaaaacaaagaagatgaacaaatgtaatgtatggaaattaatgtttaccctcaaggtaaaagctgaaatggatttataaagaattattttaaacagcaataatgtttgaggggtgggggaagtgagaaaaatgaaattttaaatcacatgtttatgactatgaagctagactttaaaaataggtcagttagggtatgactcttataatacaaaagtttatttggtatacaaaggatttatagctaatgtattttttaattatattcactaatacttgtaaaagatcattcaatttataaagtttccaaaataaacctgtttaaagtgtcacaaatgcaacgcaagatgactttcattgctctcacttggaaaagtgcaaattcctctaacaaagtatatgcaatggcttcgtcactattctcagctcctaagcagacatgcacaacaaggtttgaacacattccaggcgtggccttcaagcccggaccacacctgcttccaaggccctgcggctaaaaataactctggggcctcaaaaatgggacaccagccaggcccaggggtagctgcaggccccttgctcagcttcaacagcaaaagcaggagctacaaaaactctaaaatcacagaacactccaccacaggcttccttctctcagtctctttgtgccagtcacctacaacctaggcctgctcagtttctttgctccatgagggcaaaactaaccctaggaatttagagacaagtgaggttattgtttttaaaagatactgtggactaggactcaggagaccttgttcctaatttcaactcatctactaaaatgctaaaatggcgtatacagtgtcacttgacattccccaagcctgtgtttttcctacttgtataatgaggaattcagtgatcactaatatctaaagattatttcacttagaacaaaaagatattgctgtaagtgtgcctcagttctcagcaaagtctcctaacagggacagggctgacttatcattaagcagtcatattatggtgtgagagtttataccctacaacacacaaactaaaacgggtaactctggggtaactgttccaggtaattcctttgtgacaggggattttcaaggcttgctctgagcaactatttccacttctcttccaatcccacagtatgcaggagacccctttggggattttgttactctaccaggtaaggaaaaaagaaagggcggccaggtagcagagaaagatgcagcaacagcatcgctgttcattcactgcaggatcctagtctgtgctaatttaagtcattgcatctgtccgcacacttccccctgctggggccctggaagttaatgatatcaggaagctgtatcaggagcaaagtaccacaaagtgacaggccaagacctaggctgaagaatcacagcaccacaggaaagcaaggacactaaaggctagcggagtagccccagacgggagtcggaacattctctgtcctcatcccttggttattttttccactttgtcctttccactgtctttttctataattcggctccatcacatcatctaactgtagtttctggacccttcttttgtccttagaggctttgctgtttcttcatcctcatattcatcttaatttctctcttcatgagtataaccaagcctcttcctgtctgatgttaagctcttatcatacattcattttctattttttgaggaggaactgccaagtcccttgatgtactgctattataacaagtaatattttccagactggtttgagacagtcacccgtgaattcaggtattttatcatctatcagcctttaaaatctttgatttgttactctaaaaaaaagttttattttggaggagaaaggtaaaatttttccagtttggtgtttcacacatggttggttatactaagtaaagatcatcaattcaatattttacatttatattagcccttaaatacctcatgttccagatactaagtcagacttccacctaagcctcacaggaagacacaaattctcaggattttcacactagattatttagaaaacaaacaagatctgaattattttataatctagtgctcagattctaaaagcagaaataacctctgcacatgcagaaaaagctggcttcatcaagagtctgcctggcacattaggacggacacctgtgccagtgctcagccgctcagccctgcccatcctcctccaccagcctcggtgagctgttagttctccttacctcagctcccagtaacgctgttgtctgattctttagaagggtttcccaaacaatcttaatagcaaaacaaatagtaatgggctatatcccatagaagaagataaatatcaatgagtctaaggggaaaaaaatttttttttacaaaacatctgcttctacaaatcaaagtttgagagaatggtgtttctatttgctattcttttttattttttcttttttaagaggttattctgtcatttttacacagtactatacttggccctctataattctgggtgtaatgtcagttgggttcaggcacattacctgcagcagcaacaaacaccttcctatcaaagtctcaatttcccactctaaaataccaatatgtcagtgttgaagttaaattaggtttctaacccaatgcagggaaaaagagaattgatggcaagtccttgatattaattagttgagtaaatgttgaaaatgacattttgaacaaatatgaaaagataacatgccggtcagatgtccagcaagccaaagagaaaggcttcctgaaaaatgtaaatttcaaagagagttttgaaagaaaatagggacatgaaccagcagagagaagagaggaagatgattccagatgcagaaaacgcatgagcaaagacagagggataacaaactgtatgcaggctttcctggctacagattatgtcaacaagtaacaaaataagttggtagagtaaaaggggctagatggtaaagaatcctgaagtctaaagccatctaggccactgtacgctttatgaaaataacataagaacactactaagagaatttcactctggtaactctattcagaatggactgaggtgagaatagatttaaggagactgactgactagtctccttacagtaccatacagttttagttgcctatggatgcgctcagtctagaatggtaactataaaacctgagagccaagagactgttaatagtctaaatccaaggcaatgtgcctggcacaagatatacccttattatatgtcatgggcactgaaagtacccatgaaaatggctatctagactacatgattgaattattgcaccagaataatatctgaaaatatctcaatgtcttattctgtcccagcttcacataagctaatgtaaagcaaaatgagcactatgtacaggctcaagttttactaattaggtcattgtttataaaccagaataattagacataataaaaggctgaaataggccgggcacagtggctcatgcatgtaatcccagcactttgggaggccgaggctgatggatcacctgaagttaggagttcaagaccagcctggccaacatggtgagaccctgtctctactaaaaatacaaaaattagccggacatggtggcacatgcctgtaatcttagctactcaggaagctgaggcaagagaattacttaaacctgggaggcagaggtcgcagtgagccaagatcgctgccattgcaatccagcctgggcaacaagaacgaaactccatctcaaaaaaaaaacgccgatgcggtggctcacacctgtaatcccaacactttgggaggccgaggtgggcggatcgcctgaggtcgggagttcgagaccagcctgacaaacatggagaaacccccatctctactaaaaacacaaaaattagccaggcatggtggcgcattcctgtaagcccagctactcgggaggctgaggcaggagaattgcttgaacccaggaagtggaggttgcggtgggccaagatcacgccactgcactctatctagcctgggcaacaagagcaaaactccatctcaaaaaaacaggctgaaataaaaggctgaaaaataggtagactctgaaggttgacatttcttcaaggatgactttcttcaatatatttttctgtaatttctaagtttcctattttatagataactttcataacagaaaactatatatatttttaataagacgtaactcatgtcatgtcatgaaaaaaagatgtggaagtcaaagtgaaacctaaatgaattttaatacactatcatgacattcatccaacagtgactatagtgtgagcaaatttttaaaaagtttttaaatgtaattacatagccctatgacagcaatgctacaaggtaaaagacattcatatgtattctacacaaagcaatataactatatatgattcagtaccaggcaatgttcctttgccaaatgtaaccttcagtatcaaagaacacatattcaaaattaaaattataagcaaaatcattacaaatacagtaagcttgctattgatgaaacttaatataaaccagaccatagaactgtctattaagaaactcaatggctaaatgccaaaatatctaatttcaccatctcatctaaaacatagtccacggcatagaccctaaaaatatgctcacaaagctccacagtctaattctctactggacagattatgaaatacattcaaaagaaacctatcaccatttgctatcaacatatttaagtgtcacataagcatcactaagtatcagagactgaaagcccctctaagtagaacacgataataaatgttcagttttttctcttgcaaatagtgttcattcttctaattctggggtgtggatcttagctaatctataaaactccaggaaaaaaattaaatgagttagtagaatatatatatatatgttcatttatcgagcaccaactagattcaatttcctatagcacaatttcccacttttgcctgatcacaagaatcacttagaaacttgataaaaatgcccaaccaggcccacctctggagattgattcgtgggtctagagtggaacctgtgaatttgcatatttaacaaatgtcccaggaggttcagagaatcaggcaggtttgaaaacatgcatccccgtgcgccaccacgcctggctaaagacatctatcctaaagacatctttggtctttctctcaatgttcacatttaatcagttgtcaagacctactgattttcagtctctcttacctggaggacatagaggcataaaagctggatttgagttgaaaataatggtaagaggagaaatgggaagtcagtcatgtcacgtcattaaagaaagtcagagactactgaaatttcatagccaaagaaggacttccacttagtctagtgcatgtcttctggcaagttaataatgtcccttttacaaaatgttacatatttattcaaagtcacactattcatcagtggtaaaagacagaaaatagcttctagggagtgtgctttccacaaccctagagagcttaccaaacattctgcaaattttaataggctcctgaaaaacacagaacgcaaaatatttcaaaagatgagaaataatgcacccttttaaacacttaatgggtgtggctgtggagagttgccctcaccaaaatgccagcctgccatgaagttacagatgaaatgccaggcatgaaatagagaaccaaatggtgaggcaacagcctcggcaggactctagtgaagggggaggaaccctcgaagcaaatgcttgtcaacttcctgggtcaccatgaaaatacagtaagacagttaaagtatgtaataaaatataaagcatgtaataaatgctcaggtaatcctcccacctattgtaaattctaacatttgctaaaaagggaacaactcagtacatgattaaatggaggagcattttggctaacagagtagctctgaaccttagttacacattaaaatcatctgggagctcttaaatatccagatgtacctcagaatgataaatcagaatctctgaggaatgggcccaggcatcagtatttttcacacgaacaagcagaggtggatcctttaccttctcctaaaaaactgtcacaagggacaggtcacttggaaggcagtttaagagagagcagaggagaaatctggtgacacatgtaacactgtgattaatctattgcttacgatgttttatatgttgaaagtctggaattctgaatattttattatgtaagagatccagttctccaatgtcacagcctctataatttgaataataataaaggagcacaacaattcacttatgatacccaacagaagactgcaaggatatgctggggcacagagcccaattagggtttaataagacagggtttatgggtgaagcaatctagtttccaatctttcttcttaaaaatctacaaatgtttaggtgtagatgtgtcaaggaaagattgttaaagcttgggagagatagagttcagtgttcaccggcttatgaatgcacgttaaataaatatctccacccaggaatttcccattactaacggctaatcaccatcacaagggcatacagccctttagaattcctctctaatccaatcctgtaaaacttcacttaggatgatgatggaaaccaagattcgggcctccagccaatctatattacattaaataaaggacgtcaccacccttctcaaggttgggccagcagttatttaaaaaaaaaaaaaaaaaggctgggcacagtggttcacacctgcaatcccagcactttgggaggccgaggcaggtggaccatttgaggtcaggagttcaagaccagcctgaccaacatggtgaaaccccgtctctactaaaaaatacgaaaaaattagccgggcgtggtagcatagtcccagctactcgggaggctggggaggctgaagcaggagaatcacttgaacttgggatgtggaggttgcagtgagccaagatcgcaccactgcaccctggcctgggcgacagactgagactctgtctcataaaaagaaaaaagaaaatgagaccaggagtttgagactagcctaggcaacatactgagaccccgactctactttaaaaaaaaaaaaaactaaaaaaaaacatcagccaggtgtgctgacaggggcccgtagtcccagctactagtgaggctaagcctgggagatggaggttgctgcaaggctactggggagcttgagcccgggagatagaggttgcagtgagctatgattgccactgcactccagcctgggccacagagtgagaccctgtcttaaaatatataaaaatataaattaaaaaaatttttaaagatggtatttaaccagagtcaggagttttcgtaacatattaacatccaatacaaggaacactaggttagaaaatgctcattcagctatttcccttgtacagtgggtctaacttgtgcttccttcacttacacaacagtttttgaacatctatactgtgcaaggctttttgctcaaggaatctttggaggatacaattttaaagcaatttcataagatatctataaggctccgtgagatcacatagcaagagtgggagagaaaaatttcaagtggtgacatctagaagtcaacaggaggaggtgaggaggtggtcaatcccacctatgtatttattctggacgctctcctaccccaactccttagggtgctacacaatctctttgtattcacaaataacccctggtcaagaggtttggagggagcggcgacaccaccagccagcaaacttctactaattctggaggcaacttcctgtcagctggtccctaaaggctggttgcttcctgccaggaggccacttagcacagattcatctttcttcaggaggcagacagttgcttttttttcttttcttttcttttcttttttttttttttttttttttttgagccaggagtctcactctgattgcccaggctggagtgcagtggtgctgatcatggctcactgcagcctcaacctcccaggctcaggtgatccccccagctcagcctcccgagtaactgggactacatgtgcacaccatcacgcctggctaatttctctatttttagtagagctggagtttcaccatgttgcccagactggtctcaaactcctggactcaagcaattgactcacctcagtctcccaaagtcctgggattatgggcgtgagccaccgcacctggccacttgctgattctcactgtggcactgattttagagggaaaggcagaggggaagacaattcatcttcccttcaaccccaggtacacacagtcccctgccccacacaaatacaaacatgaagaataaaagaggtacaggccttgacaaggttacactgacattatttccacccaacagtatctcccacaaagcgttaaggagggaaaataagaaactcttattaaaattagtctatcttattggaaggcccagtaaggtaggtaaatggcataaattctcaggagttggtcaatctatgatagttgtagttggaatgagctgtctgtctagacccatggtcttcaagcttttcagctgacagcccacttcagagtgacaaactaccaggtctatgtcttcctaacaactatttctctgtctacatgtgttccaccacaaaccctagagagaaataactgtgaaaaaaattctgtaaagtgagatataacatccagattaaaatgtaaatacaagagcactgaaaatgtatgcacatgtaacaaacctgcacatataccccaaatctaaaataatttaagaaaggaaatggacccacaaaaacttgtataaaaatgttcacagcagatttataaacagccaaaaaaattaatcaactgatgaatagataaacaaaatgcagtatatccctactatggaatattatttagccatgaaaaggaattaatactgataccagctacaatatgggagaaccccaaaaacgttatgctaagggaaagaaactagataccaaagaccacatattatatgaatccatttatatgaaatacccagaaaggctgggtgccgtggctcacacctgtaatcccagcactttcagaggccgaggtgggcggatcacctcaggttgggagttaggtactagcctgaccatggagaaatcccgtctctactacaaatacaaaattacccgggcgtggtggcacatgcctgtaatcccagctactcaggaggctgaggcaggagaatcccttgaacctgggaggtggaggttgtggtgagccgagatcacgccattgcactccagcctgggcaacaagagcgaaacttcatctcaaaaaaagaaaagagaaaaaaaaaaaaaaaaaaaaagaaatacccagaaagggcaaatgcatagggacaggaagtaaatcagcagttgccaggggctgggaggagtgggaaatggtgtatgacctaatgtgcagagtttgttttgggggtgatgaaaatgtcctagaattagatagtagtgattactacacaactgtgaatataccaaaaaccactgcattgcacaccttcaaagacgaattttacgactgaaattatatctcaactttttttaaatggtaaatttggtggtatattaattgtatctcaataaactgtcatttttaaaaagggcaggcaggccaaggcatgactccagatgtaaagaaactaaagacacaagtaaatgtagaacacgatcctcaattggaccctgtatgcaagaccaaatatttgtgtccccactaaattcttaaattaaaaccctaagtccattgtgatagtatctgaaactggggcctttagagggtaattaggtcatgaggtggagccctcatgaatgggattcatgctatataaaaaggacccccagagagctctctttcttgggtatacgatgagaaattggtactctgcaacccagaagagggccctcaccagaaccagatcatgctggcactctgatctcagacttttagccttcagaactataagaagtcaatttgttatttataagctacccagtctaaggttgttatagcaacccaagcaaactaagactgtactagacagtacaatgctatgaagaatgtcgttgtgtcaacttacaggactgaaatacacgtgtgggctagttagaagtattaaatcaatgtcaggtttactggggttgacaactgtactgtgggtaggaaactgtccttgttcttcggagacctgctgatgtgcttgaggatagtgggccatgtgtacaacttatggttcagaaaaatgtatcatatataaatatgaagagagagcaagtaataaagcaaagggggcaaactggtaatagtagatgctgttcttttatttttttctgtaaatttaaaattattttcaaacaaaaagataaaaaagtaaatagaatacacataatctgagatctagaaattctacttccaataatttgtcttatataaatacctgcccaagtatattatgtgaaatacttttccctgtaacatgtttataactgtaaaaagaaacaacttcaaagttaatgagtgataaattggctaaatatattattatatcaatgtagtataccatatggacatgtaaaaagaaagatgtctatctgatatagaatgacttccagaaatatattcttttgtgaagagaaaaaaagaattggtttatccctagaaacaaaaccaataaaaaactcaagaagcctaggaatgtttggatttggttaagaaagaagctaagcctgttctatttatttatgaggccagttatttgtatttgtaatacaaataattttctcccttacagcattgataatacaagctttactaatgaaaaaggaaactaatacaatcttgtatgccacttactcctgtggttaactcaaagcatttaaaaataaatttcgtaaaaactcaagtataacatatatgccaataagcatacacaaatcatgaatgtacagctcaaagaatttttataaggttaacacactcatgtaatcaccatcctgatcaagaaatagaaacccacctgtactccagaagttggcttcatatgtcttcctactactaatctctctccccaaaggtaaccacgaacctgacttcttataccatggctgagttttgcctgtttttgagctcttttgtgtctgaactgttttgtacaaaattatgttcatatctatgttgttgtaagtagcaagagttttttcatgttcacttctacctagtatctcattgaatatacaacaatgtatttatctattcttccactgatggacatgtgggttgtttccagcttggagttattatgaattgtgctgctatgaacattcttgtacatgtcttttggtgagcataagtacacatttctgttgggtatacacctaggagtgggtttgctaggttaaacgcataagtatgtaacactttagtataatagatacaaccagttttccacagttattccaatttacaattccagaatccatacatgagggttctagttgctctacacccatgctgatactggtattttcaagtttttgtttgtttctcaattttagctactctgatcagtgtgtagtggtaattcactgtggtttcattcagcattttttgatgacgaatatggctgaacactgctagaagctttagttttttttaacctttcgcattgagatctacaattagcctataatttatttttgtaagtgatggcaagcaaggaccaaaattagttttctttttcttttcatacagataggcaattgacgtaggatcatttatcgaaagatctttctttccacattgctgtaaagtgccattttaatcataaattagtatctacatatatgggtctgattcagggctctattctgttccattatccattcatttattccacactgtatattcaatagtgtgaatcctacaactttgttcttccttaatattaccttgactattcttgccatttgcactgccatatgaattttagaatcaacttatataaacttctgtaaaagtttcaggtatctttcttagatttattaccagcatttgatattttttgatgctattataaacagcatctaaacatttcattttctgattactgttatatagaaatataggttttgtataataacctcacatccagtaatcttactaaatttatgtttactttgagatggattctcgctctgtcacccaggctggagtgcagtggcatgatctcagctcactgaaaacctctgcctcccaggttcaagcgattctcagcttgatgcctcagcctcctgagtagctggggctacaggtgtgcaccaccaagcccagctaatttgtgtacttttttttttttttttttccgtaaagacaaggtttcaccatgtttaccaggctagtctcaaactcctgacctcaggtgatccgcccgcctcagcctcccaaagtgctgggattacaggcatgagccaacacgcctggccactacatttatttttaaagcattattttttaacttacataaagtaaaattaatgctttttggtgtacagttctatgagttttgaccaaatgtacactgtaatgtaaccatcaccacaatcaagatgcagaacgtttccatcgctccaaaaaattcaaaaacaaatcctggtcaaatcttaagttaccctaataacagataagagagtacatggataaataaagtctaacgatatcctataaactacaatctagccaaaactatatgacagcttcagtctcatttcctggcaaatctttccccaccaaattcaaagccggtaagagaaatggtaaccaaatcacagttctagagccataatgtaccaatctaatatttaatatgtggattctgaatatctgaatggaaaagaacttgttataaatgatattgatgtaataacagtaacatcatgtacttttagaaacccaaatgaaattacactataaaaataagttatatttcccatgcaaaataaatggataatgaaaacatctgagagttatttatacaatattataaatttatgaaatgctatcatttgggggggaaattctgcaccctctggataatgattatgttaatgaattctggtctactaatgatcacccatggtttagttttatcttttttactttacctgtgtttcgtggttgtgttttttcacaattaaatgtccagcctatgctcagagggatggatggtgataagtagccccaaagggcctagataatattttgcaatgaaactgtcagtgctaccaaatatatttcaatccttgagttactgtataaccaaagttaagaatgaatgaacaagggtggctctgaccattatggcaactttccacaatgtagttctttgaagctgcctcagtccttccattacctccgctatttacacacccaggtgtttttagtattttgtaagaagggactggtaatggtcaatcaagacctggcaataggccagaaagcaatatagatgtcacagatggtcaagcacaaagacaacactagatagacatgctgtgttctagtgtaagcactaccaacatctcatgcattctgagtcaccctacatattgcttacccattcctatttggtttactggattttgcttgtttactttattcctcctatagtattgtcagcatgagaacattttaagtcatggcaccatatggcaataatatataactccataactaaaataagctccctaaagactggctatctgtcagatactatctataagacacaaaaaattaaaaacatcaagtgcttgaaacctaaaaataattttatcttagcagtacccttaagcctcaaccacaatcacattatttcttacctttaattaacatcatgatatcattgtccatatgagagccatggacaacaaataaatcagtttagaaatacttctttatacctggcatgaaaatatagctgttcttaacagaaataaaaattcactgaatttggactggtgttttgtttgctctatgtatttaaaacaataacaggccagtgcagtggctcatgcctgtaatcccagcaccttaggaggccgaggcaggtggatcacctgaggtcaggagtttgagaccagcctggccaacatggcaaaaccccgtctctaccaaaaatacaaaaattagccgggcgtggtggtgcccacctgtaatcccagctacttgggaggctgaggcaggagaatcgcttgaacccgggtggaggttgcagtgagccgagatagcgccactgcactctagcctgggcgacagagcgagacttggtctcaaaacaaacaaaacaaacaaacaaaaaaaagcaaaaaaaaaaaaaagaaaatacattgtccaatgaacttttcaccttctacttccttatgactgtgagtaggcttaaaaaaaaaaaaaaaaaaaaaaaaaagcaaaacatactactgtgtatctccagggtaagtacaagctctactactccaggccatatccaccataggacttgtgtacagcagcattaaaaaaacaaatatttaagcccaggattctgaggtgataccatgctataagcaggaaaataagtaagatcaaaagttagaaaatcaaagatccaacaaagctttggtggagtgctaccttctagctattggctggcaacaaagatttctcagtgtagaagttagataatactgagattccaaggaaatcttagacacaagaggttagctggtaaaaggcaatgcttgcaaaatttacaattttagagctggaaaaaccttagatatcacctagtccatccctctggtttacatataatgaggagagggaagaagaagagaatcaacccgagccctccaaatcctctttggagtatgaaaccctgactaagcagtaccagtaatagcagaagaagcagagatgacagttactgtactccactcactccatttttgtatccctgaactatatcacatctaatctgtgagttctaagtagctgattcacattaaagaaaaaggcatcctacaactcaacaacaaaaaactcaaataatccaatttttaaatgggcaaaggactggaataaacatttctcccaagatgatatataaatggccaactatttgaaaagatgctgaacatcaccaatcaccagagaaatgtgaatcaaaaccacaatgaggtatcacgtcacacccattaggacagctaaaaacaacaagtgttggctgggcacagtggctcatgcctgtaatcccagcactttgggaggccgaggcaggcggcctgaggtcaggagtttgagacaagcctggccaacacggtgaaaccccatctctactaaatatacaaaaattagctgggcctggtggcacgtgcctgtaatcccagctactcgggaagctgaggaaagagaatcacttgaacccaggaggcagaggttgcagtgagccgagatcgcaccactgcactccaacctggtgacagagtgagactctgtctcaaaaaaaaaaaaaaaaagaaaaagaaaaagaaaaagaaaaaaaagaaatattttgcaatagatctcttcctttttcttgctgtgttcctcccaacctttaataatctaaaggtgtcaagaactgctccaggatactatcttccttctcccaaaccatcctacagaagcggccagctaacatactgctcttagagtaagcagggcaggtctgcaatcgtggagaaaaggggaaatcatcaggaggggatttcaagtgggttgtcctccacttctaatcatgatcatgactttatccctcagcctatgaaaagcagagactagggtgacagaccccaagctgaaaaacccctagggcaaaaaaatgagaacactgtactgagtgtactttaattacagacaatacacacatatgtatatctttctctattaaaataaaaatacaattagtctttcattttcaatgaaatatgagtaactgcccaaaacccaaaacctaattttagctttagcctctttaccatcgacatcattattagggatacaacccagtcatcaagatgactgaaaaagtggcactgctgctttcccctgtgtaactgaatacacaattcctactaacagaaatggaatactggtaagttgctaaaaggcagactatctagtatagttattttaaccgtgttttgatggaaatccttcaattatatgtgcatctccatgactcctgttgcacccacccccgcacttccctagtcccattcttccaggcccagcacatgggggagcccagctgatcctggagtcttcctccgtgccctccatgcttagctccactctctgtccacagcctcattttgcctatagctatttccataatcactaatgcctactccattcactcttaccattcttctttcatttatcttctgccatcccttagctctcccaaaagaaaaaaataacagtctccccacctggatgaaacaaatgactgccaagagcagtccgttctcctctcacatatgttaccatctctcccattctgtcattcaagaaaaaaaataactcagtaccctggattttgaatacaataagtaagtatgaacagatatgtgtgtatatatgtggccacagtgcttttttattaaaaaaaaaaaatagggagagcaaattttcacttttttatgttataaagtgctctcactgactcttcccttctgtctaccctttatccaacacgctctgatgttatatgaccttccacccataatagtatctggccacatggctcatcctacacactaacatagtcccttctccctgacaaattcatcaactaagatggacatgttactttattgatttagatgcgtgtatcagaccaggcgcagtggcactctgggaggctgaggcaggtggatcacctgaggttaggagttgaagaccagcctggccaacatggtgaaaccctgtctctactaaaaatataaaaattagctaggcatgatggagggtgcctgtaatcccagctgcttgggaggctgaggtgggagaatcgcttgaacccgggaggcggaggctgcagtgagccaagacggcgccattgccctccagcctgggtgacagagtgagactccgtctcaaaaaaaaaaaaaaaaatgtgtatcagactgctctaaaaagatgtcagcacatggtactagtttacaccagcagttttcaaagtgtgatccagagatgaggaaggaaccccttcaagggatctataaaactatttttgataatatgaagatgttatctgtctttttcactttcattccctcatgagtgtacaacagtgggtcgaggatgcacggtatgtggtgatgatgtatctatcactctgacagctaagaaaacatatacttgtatattctttactgcctatcattttttaaaaacccagtttcacccatcattctcagcaaagtaacacaggaacagaaaaccaaatagcacatgttctcactcataagtgagagttgaacaatgagaacacatggacactgggaggggaacatcacacgctggggtctgttgggagggaaacatcacacgctggggtctgttggggattgggaggatagaggagggatagcattaggagaaatacctaatgtagatgacgggctgatgggtgcagcaaaccaccatggcatgtgtatacctgtgtaacaaacctgcacgtgctgcacatgtaccccaaaacttaaagtataattaaaaaaaaaagccagtctcacttaacaacatccttgataaaataataaaaggtattaatttttaaaacgtcaactcttgagaacttggcctttttcatattctgtatgatgaaataggaagcacacataaagcatttctgctgcatacctaagtataatgattatcttggggaaaagcatttatacaatttttttttttcataggacaccatttttgcttttttgactagcagacaatttacacttattcagactttggtatctggcagacattttctctaaaatgaataaagtgaacctgtcactttaagaaaaaccggcaatattgggctgctggccgtggctcacacctgtaaccccagcacctcgggaagcctaggcaggcagatcacttgaggccaggagttcaagaccagcctaaccaacatggcgaaacccccatctctactaaaaatacaaaaaaaatcagccaggcgtggtggtgcgtgtaatctgagctaggcagaggttgcagtgagccaagatcacaccactgtactctagcctgggcgacagagggagactgtattaaaaaaaaaaaaaaaaaaatgggcactatctgttgccaatgatataaattaagctttcaagagaaaactggtattttggaaaacttgaattcgccaccaagatcttgaccacttcccaattcttaaagattttttggatgagactgatggtgatattaatgactgtgatttgcttaatattgtataatcaaatgtgccaacatttcaaagatgtgcagaacttagtaaacctttttttttttttttttccgagatggaatatcgctctgttacccatgctggagtgcagtggcacgatctcagctcactgaaacctccacctcccaggttcaagcaattctcctgtctcagcctcccgagtagctaggactacaggcgtgcactgccatgcctggctaatttttgttatttttagtagagacggggtttcaccatgttggccaggctggtcttgatctcctgacctcgtgatccacctgcctcggcctcccaaagtgctgggattacaggcgtaagccactgtgcccagtcagcttagtaaaccattattttttgaatgatcaatgtatgcagttacaaaatcacacacaggtcaaagatccattcaaagtgcaagatggaccagtggattttaatgttacagagtacacaaaattcactgacatggcttcagattcagcagtgcaactaatatttaagaatctggctgggagcggtggctgcgcctgtaatcccagaaatttgggaggccgaggcaagcggatcacttggggtcgggagtttgagaccagcctggtcaatatgctgaaaccccatctctactaaaaatataaaaattagctgggcatggtggtgcgtgcctgtaatcccagttacttgagaggctgaggcaggagaatcacttgaacccgggaggcagaggttgcagtgagctgagatcacaccactgcactccagcctgggcgacagagcgagactatctcaaaaaaataaataaataaataaaaagcatttaccaattgttgaattttggtgtaacaaaaatattcacaattatatgaaaagactatgaaaataccccacccttcttcaactatgtatccgtgtgcagccaggttttcttcacgtatttcaaccaaaacaacatatcacaacagattgaatacaggagcaattatgcaaacccagctatcttctataaagaaatatactaaagagaatggcaaaacgtaaaacaatgccatgtttctcaccagatttttttgtgtgtgttggaatacctttttcataaaagcatattatttatatcaaccctctttgttttttcttcttttttttgagacacagtctcgctctgtcgcccaggctggagtgcaatggcaggatctcggctcactgcaacctctgcctcccgggttcaagcgattctcgtgcctcagcctcccaagtagctgggattacaggcgcccaccaccacacctggctaatttttgtatttttagtagagacggggttttaccatgttggtcaagctggtctcgaactcctgacttcatgagatccactgacctcagcctcccaaagtgttgggattacaggcatgagccaccatgcctggcctaatgtttgttattttttaaataaataaatattttaaacatttttcagttttaatttctaatgttaagtatggacagacatagtctatataaacaaaagatttttggggtcctcagaaatttttaagagtataaatgtgtcctgagaccaaaatgtttgaaaaccattagtttatagtaccacaaaaaaatagcacttttaagtatatgtatacaagagaatggacacctgaatatgaatcagaagatcttggctccaattctagcaccacttcttacttgctttaggatttcaataaattacttcatctctctaaggccttagtttcctcatctgtaaaatgggtaactcatgtcttccaaggataaaagagacaaaatatgtaaaagcaatttataaactacaaggtacactattattacaagatctcaaagttaagcattttaaacacttcttatgatgttttgtttctttgtttttgaaacagggtctcactctgttgcccaggctggagtgcactggcactaacatggcttactgcagccttgacctgccaggctcaggtgatcctcctacctgagccccacgagtggctgggactacaggtgtgcaccatcacacccagccaattttttgtattttttgtggcgacaaggtttcaccatgttgcccaggctggtctactcctgacctcaagtgatccgcccacctccccaagtgctgggattacaggcatgagccaccatgcctggcctcttacgatgtgtctatgaaattttccttattcttaaaattttattactaaaaacagaacttatagaaaatgtcaagtgcaggccaggagcagtggattacacctataatcctagcactttgagaggccaagacaagcagatcacttgaagtcaggagtttgagaccagcctggccaccctggtgaaaccacatctctactaaaaatacaaaaattagctggtgtggtggtgcacgcctgtaatcccagctacttgggaggctgaggcaggagaattgcttgaacccaggaggcagagattgcagtgagctgagactgcgccactgcactccaacctgggtgacagagtgaaactgggtctcaaaaaaaaaaaaaaaaaaaaaaagccaagtgcagacttttgattagctaattagctcaaatgtccaagcatataattttactttattttattttgcagagacagagtctcaccatgctacctaagctggtctcaaactcctgacctcaagcgatcctcccacctcagcctcccaaagtactggatcataagaatgaaccctcatacccaacccaacaacacaattttattgcatttaatttcttaccctacagttataattggttatatattttaaatcattattagggacatttccaaatatacacaaatgtaaaaaaaataacaaactccaacttacccattactcagcttcaacaattttcaaaaatttatcaatactcttttattcatttcccacttctgtgtgtttgtgcccatcctgaagttttttaaaatgaacatttcgcatcattttattctgcctgtaagtacatccatatgtatttttaacacatgaaaatattttaacataaccacaatatgactattatagctgaaaacattatggttgtaactattaaatatcacctaatatatattccattttcaagtttcccaactgtctcaattaaaaaaaaaaagtctttgttagtttttggttggtgggtattatcaaaatatcattcttaccaattctttctcaagtcaacccaagatgtttaactaaagctacgaaggaagaggaaataatactatgcttcatataccatgtacagtttacaaaacaagtcaagaactatcttctcgaggaattttcttttccaccaaccaaacaataacaacaaaaaccaagcaacaacaacaaataaacccactacaaaataagccagcatggcaatacatataccttagtattctgagaagtgatccaaagagcacacagctcagctgctcgggaagagaaggagctgttacactgtgagccgaaaaaggtgactggaaacaaccacccatcattttggaaaagaagaagtcaggtcagccacagggtcaaagctggaggtgaggtcagagaccccgttctagagtgagcacatggctcaaataagagtccatgcccaagactataagtcaaccccttgcaaactgcaactcaaagctcaaaacacagtgctctaagctagagatataatggaacggctataaaaagcaacaggtgtaagaactgactgaaattatttgacaaacatttgtcaaaagcctactctactatcctgggatataaactgtgtatttaaaaactagtacaacgcacactgtaagtagcatatacttctctacacatctttccccatttattttaagagaaataatggatatattaaatattaattatcttgccataccattacatcttttttctataaacgcaatttgccccaccccaacatacatagacattaaaacaaacctgaattcttctgtctttcccaaatatttttgaggagtacaagtcagattaacttttattacacataccacagacccacagcatttatagctgtaattcttttctaaattaaggccaagcatggtggctcacacctgtaatcccaatgctttgggacgccgaggtgggaggattgattgagcccaggagttcaagactagctgggcaacatagcaagaccctgtctctacacaaaataaaaaattagctaggtatagttgcacatgcctatagtcctagctatttgggaggctgaggtgggagaatcccttgaaccgaggaagtcaaggatgtagtgagctgtgatgacaccactgcactccagcttgggcgacagagtaagaccatgtctcaaaaaaataaaaattaaataaattaagcatttagtttaggaggaaatcaagagagcactaaagaatttcctaccttgtattaaaattgtttcccataggtttatctcaagtattttgtagatgaaaattggttaggtgcatacagaataattcttgagggatttggttctatagacacacttaatatcaacactttttaaaatcctttacctcaatttcacctataaaaaagttttgctggtcacagtggcttgtgcctgtaatcctagcactttgggagactaaggcaggaagactgcttgaagccaggagtttaagaccagcctgggcaacaaagtgagacccccatctctataaaaataataaaaataaataataataattagccgggtgtggtggcatgcaccacctgtggtctcagctacttgggaggctgaggcaggaggactgcttgagcccaggagtttgagactacagtgagctatgattgctctattgcacttcagcctgtgtgacagagacagaccccatctttaattaaaaaaaaaaaaattaaaaactgcaaaaagagtgaagggcacatatttcttaaagaatgcttcagaagaacaaaatgtgccccaaaacatgaaatagctcctgataatatcagtttttagttgaccactatgaaggacatcttctaaacaataacaaaacaaacctggcagtccaataactacaggaaagatcaagacttccccattttggaacatctttgcttcaggtttttactttttgtagtaatacaggaacaatatgccatagggacaagagttgaacaggtgtcatcccttaccctattttacctattggtaattaagcctaacagtttattgtctgtacatcttttcttttgtatgttcccatacaaaacaatctttggaatttagcttcactttatgacactatggtgattattgttcctaacagagagtctaacctaagaatatagcccaatacgtgaaaaagctaactgaacagtaaacaatgacattaatctcattgtaaaaaaacatgagattcttagcaaatggcagcaaaagaactgtggatacattaacaaggcattaaaaaaaaaatttaaagtttctggccgggtgtggtggctcacacctgtaatcccagcactttgggaggccaaggcgggtggaacacgaggtcaggagatcgagaccatcctggccaacgtggtgaaaccccgtctctactaaaatacaaaaaaaaattagctgggtgcggtggcacacgcctgtagtcccagctactcgggaggctgaggaaggggaatcgcttgaacccgggaggcggaggctgcagaaagccgagatggcgccactgcactccagcctggcgacagagcaagactccgtctcaaaaaaaaaaaaaaaaaaatctaagtttccatgctttgacctaaaaaaaagtcacataggtttctttttctttaattcccatttctttttttaaaaactggttaatgtgtagatttttattcaaattcatttggactgcacatgaatattaaaaagttataacatgaagactgttcattagactatcataggcaaagcaagtgattcacagaataagtgcaatttatcgaccctgatcattacctttactaccgaccactatttaacatcacttttttaatgtactgtttacttgtttactgtctttgtttattgtcctgtcttctcccactagaatataagttacgtaagggcaaaaactttctcttattttccactgtatggccagggtctagcacttggtagaggatcagcataaatttgctgaatgagatgggtgaataccttccgcctttcgcctcccccacttccctctctccatacacatgttaaccaatctttaaggccagggtcaaattctattatctctatgaagattacctccctgagccctctttctcttttgtacctgaatttggcacttgccagctgtctggtaattatctttgcatatgtatgtatctcccttaaaattcttataatcctgttctccataacatgggccagtgtccccaacttttggaatccatctcagcacatgtaaacagcatactgctaacaaatgttttgcttgattcctatcagtagttaatccagaaattcagttaataatttcagtttataatgtatccctccctttcaaataactcaaaataggccatgatattacagcgaatccctctttttatttctgacaattttaaattttacattctcatataagtaatgctcataatttaccctatcaatcactatccctcaagattatatgtttttttttttttgatacactgtcttgctctgttgcccaagctggagcgcagcagtgccatcatagctcactgcagccttgacctcccaggctcaagagatcctcccacttcagcctccaaagtagccggcaccacagctgcgtactactaccatacctagctaattttttgattttctgtggaaacaaggtctttgttgccagggctgttctcaacacctgagctcaagtgatcctcctgccttagcctcttaaagtgctgggattataggaatgagccaccacgcctggcctacattttttaatgtaataaaaaaatcttgtgactttgtggcaatacctataatgatgtttctaaccccagtcaagaagggcgtgaagtttcattcctctctcttgttgctgaggtatcagagggcatttttccacttattcctctttcctttcatggcaagatgtattctgttcccttccttactgatcatactcctggcaagcttttattatttctttgtacctgtccaaggtaatctgtcttacatccttcttttgagccactgtttcctccagttatttatttgattaaaattctaactccctgtctcaatccatttgtgtagaagaaccagctcttcttaaagcctgagcctgcttctttaaattcggccaacctttatgaacctctcttcacacagccaacccttgatcatcaaggataatgaaatgcatacaaataacagattgtctacaacacaagaaaatcagaaaaaaaaaattgacatctggctttggaatttatcatatgtagctttgggcaagacttattttcctaattatgtttttgtttaagccaacattcggattttcttttatgatggtgaatatctccgttttaaatgatcagtaaatttcttttaaagccaatcaagcaccaactatggtttttcctgtgaaatctttttaactagtttctttcatctgttgaaatctgtcataaaatctgttttatttcctctaagttatctccttattttcttgggattctgatccaaatcagttcaccctatattaatttacttcttcaaattaaagtaccttttgcttgagaacttaatgcattttaaaaacactgaatgtccagtgaaatttttagttcaggtaacacgaagtagaaaattatttttgtctaggaaaacttgggagttctaggataaattattacactggtaattctagcaaattatatttagtaggatttttaggattagctgaaaattgaaaaaatttaatactggacagctatataagtctgcttcatcaatatattaatcccatatgctaaacactgtatgaaattaaattcccagtccagggatttacagaaaatagcatcaaaacacactaacacataaatcctgcctcttattctgatccctacctaaactctgcaaccttctcacacctactcttcccccctcccatctcagcctcacttccactctcaactgtcccacaaataatttttaaacgtgtaggaaaaaggaaaagaaccggggtaacagtgtctcctcttttactgccttctcagttactgccattaagcttttggcccaaagactccaatccccaattttacatgtctatttttattttataggtacacacttacaatcaccaaactgaacgaaaggatagggcattctaaattgaaaaaggagcaaaactggataattctgcagttctgttcctagccccctccataatcatgcactatgatcatttggcactataatcaagccaaatgagatattgtactttgagttgctgatatagcagaggttaatactaaaaaagaaaaaaaaaattaattaccacagtttacattttttatctgaatgtacatttatagtacttgaaccgagttattttcaaaacactattcacactaacaaaattcaaaataaattcatttctaatttttcccccatgtagaattttgataagtgcaaaaattattttacctaaaatccaactcttgggctggtgttatttagcctatatttttacataagactgtaaatgttagccaaattaaaaaaaattttaatgcaactttccacattgtcttcaaactcagtaaattccacaattttaaaaaacaaaaacctttcaccgtgcctactcacatttttactaaaatccctacacagagccatacattctgcttttcattttacttctccaagctgctgccttcaccaaatagactccacgagcctcccaagtggtatccaccaatatatgtgatactcaaggaaaagtaggtattaaagagtaattaattcaattggtacgaaatcttttcttttaaaattttaccttaactttaaaaagcccttttcttgatggaggtgaaacagcataaatcctttgaggaaacggttatcctttacgtggactctccatcagccccataaggtgagtggcataaagaggcatttttctgacagtctcagttccccaaacactagtcctaaacttttgcatggatggtaaatttcacacacacacacacacacagaggcggaaaagaaagaagagaaagaaacatacctggtttattttctaaacaggtttgataggtttggttcacttgaaagagcagagtatttacttataatcttttaaaacagaagtgggagccagagcgctgggtaaataaaaacttcagagagttttaaaaccctgcatcttaactcacttccctttggttcaaggggatggcacagcaaaccccacggcaaatgagattatgcaacaggtttttttcctccccagcttattcatcacaggctggttagaggtgtgctttctccaatctgagacacccacgacttcaaaacgccaagaatccttgcagttgatgtttcctaaacttctttaggattttgcagtatccattcattttcagatctacttgccttttctctggttcattattggtattctttaggaaataaacccagcatctgaaaatatttccctctgtggtgtttcattacatgaaactacacgtgatacacagaccctgggcttttttatttctcacgttttgcagctagtgtaaataaagaagtcactaggcgtcgggccccccaacgccaagacccgagcccctgtccgaaaattgagggctttttcggttggttggttgaagaaagcagcaccgtcaccacccaggtggcctcgctgcttacaccaaaggcgaactggggataatgggaacagtcaggccagggccccacttggcaggcgtgttgtgtaacagtcgcgcctggaagtgagcagcttcgcccgcaaaggtgccgcgtcccgcggcggccgctcctctcggcggggcccggtccaagcgccgcgcagcggccgggagcgcacccactgcgaccccgcgcccggccgcacgcccccttcccgctccggccagcctccggccaggcctacacccccgcttcaaacgctcctgcggcccccggccgcggtcgcccccacgccgcctcccgaaagggtggccggtacgcccgggaaggcagagacggcggggctggagcgcggcgcccggcaccgggagtcggggcgcgctgcggagcgtccatgcggccgggcgggagggcgccccgggccccgcaccctcccgcccgcacaccccgcgcggcccgccaaggccacttacttttggggccgccgacctcccaattccctcagagggaaacgaaagttgtcacggcgtctcccctcgggcccccctcgcctcccggacttgcgaggcgccgccgcggagccgagagggcggctgcgctcccgctcgcgtcccgtcccgtcgctctcctcctcctcttcttttcagtatattatcttctccttctctgaggggtgggttggggcgggaggcttaggaagagaggagacgctcgcaacttttcttcactctttctcttccaccctcccccccatcagccttcaaaaaaaatgtcgaaagagatgaagaacttagggaggtaaaggtggggggccgcgttgtgaaagtgggggttgggggggagagagaggtggtaataatcgtttaaaaactgattaaagccccccaaacactgatacatagaaagagggggaaaggcgggggggtggggtggggggttgggggaaagagaaagagtcgctggtcaggaaacttcaagcgcggatgaggtcattggtttaaaaataaagagatggcgtcacttgaaaccaatcccagtgaatgaactcagcggagccccggggaaaggaggagacaggcgagggcagggcggtgggcgccgggcggggccgcgcgctcgcccatcccgcggccgcccgagcccggagcgcggctccgcgcctcgttccggccgctcggggaggggtcaggtcatgttcccttccagagtccggcgactctgaggcaggttccgcgggcgccgctgggaggagccggagctgccggaggaggcggccccgcggcctcctcccccacctctccctcctcctcctcctcctcccgcgcccgcgcgcccgccccctacccccgggctcgcggccccgacccccgggccggggtgtccgcctccagtgctgcgccccaacaggtatcggagggttttctccctcacccagacgcagaacctttccctcctccttgagctgtttccagctgcctcaccaacgtcaaaaaacgcaaacactgatttgagagaattacactcgctctgtaaaaagtctggcgaatgcaaaaggcaaggctctgccatctctcaggagagaagttacaggtacttcaagaaaaatcacactactgttgtcaggcattcagctatctatatgtttatggttgaaagcccccacataaatgttcctacattactttactttgcttatatttacaaatacaaggataagcagcctacattttctttaaaaatgttttctacaggaggcagcgcagaaacatctttaaataagaccaggggttaaccgcctcttgagaggtacaaaacccttgttgatttaactccacatacctcgtgcattttattatttgaattcattaaaatgtctgttttgagatgacattatgcactttggaaaacgagagacctgaggtggtgacaaaccaggacttggaatcactgaataggacaatcggagctttattccaatgttctttgagcatttgagcatgaagctgcttctactgagaagtactcacgtggatatcacataacaaagatgtgattaatgacggaaaagcaccctgcgagtggactgctccatgagccagaatttatgtgtaggaataatctaactcttcaaatattccatttacaatgtgccggattgggacactagaccctaaaggcactgtttgctgtgggatatccatgtgcaccctgcctaaagcacgtttttccactagcaaaagaactgataagcaggtttgggtgggttcgaaagataatacacccctgttactacttttctgcctttaagtcctgcaactaaaggcattccttatgattggtaatcattgaaggttagtgttgcggggtatggccctgggaacttctggcccatcttttataggagggaaaaaaaaagcccatttgaagatgggaggcaccctagcacctctggcagtagtaggtaaagcctgaaggccacagatggagaagcaactttgagcctgtgcctctggcctcttgaagactttgctaggggaagcaaatctctcccactgctccctgtcctctggtggccaggaggtgttactgcagcttccttgggattatttgtgctctaccaggaaacccctaaaaatctaactgtagacctttgttggaggtgttgggatttttaggaaggaagaagaagatagtccttttactagtggtacagagcatggatcttgcctggaggaaagattcatgagaattaatggtatcccctttgcatgccaaagttccagtaaccttgctttaactgacatggcttgaaacgtttctcccctttcctcagttacacaattaagtttgtgtaatgtatgatgtggtgccatcatagctatcatagaagtctctcagggtatttcatctatttctggaaacaagacgtatattaaagctcattaaaaacgaaatcaatgattgagtgatgtacaatattggttaaaagagtcagggggccgggcgtggtggcttaagcctataatcccagcactttgggaggcccgaggcgggtggatcatgaggtcaagagatcgagaccatcctggccaacatggtgaaaccccgtctctactaaaaatacaaaaattagccaggcgtggtggtgggcgcctgtagtcccagctactcaggaggctgaggcagaagaatcacttgaacccgggaggtggaggttgcaatgagccgagatcgcaccactgcactccagactccagcctggcaacagagtgagactccatctcaaaaaaaaaaaaaaaaacaaacaaacaaaaaaaaacatcaggggagaaaaggagcaatgtaggctgggattatcagggaaggcaccttataaagagttttgaccttatccttgaaggacagttcagatttagtttgcagtgaagaagccagtggagggaagattccagagggcaaatggcaatgagccaagacatggaggtggaatgaataatgagtaaggtgtattcaagtgacagaagagtaaacccagtagcagtagaaatcggtatttagcaattaggtatgaggttaaatttaagagatacagaggcacattgtggaggtacttgaatgttagaataaatagattgttacctgcccagcaggtgaaggggaaaccactaaacaagtttacttcaccgaagagtacatttctttcttttactaagaaaggttttctacatactaacaataaatatgtggaaacagccctctccctctcccgctcccgctcccgctccctctctttccacgatctccctctgatgccgagccgaagctggactatactgctgccatctcggctcactgcaacctccctgcctgattctcctgccttagcctgctgagtgcctgcgattgcaggcacgcaccgccacgcctgactggttttcgtatttttttggtggagacggggtttcgctgtgttggccgggctggtctccagctcctaaccgtgagtgatccgccagcctcggcctcctgaggtgccgggattgcagactgagtctggttcactcagtgctcaatggtgcccaggctggagtgcagtggcgtgatctcggctcgctacaacctccacctcccagccgcctgccttggcctcccaaagtgctgagagtgcagcctctgcccggccgccaccccatctgggaagtgaggagcgtctctgcctggctgcccatcgtctgggacgtgaggagcccctctgcctggctgccccatctggaagtgaggagcgtctctgcccggccgccatcccatctaggaagtgaggagcgcctcttcccggctgccatcccatctaggaagtgaggagcgtctctgcccggccgcccatcgtctgagatgtggggagcgcctctgccccgccgccccgtctgggaggtgaggagcgtctctgcccagccaccccgtctgagaagggaggagaccctccgcccggcagccgccccgtctgcgaagtgaggagcccctccgcccggcagccaccccgtctgggaagtgaggagcgtctccgcccggcagccacccagtccgggaaggaggtggggctcagcccccgccaggccagccgccctgtctgggagggaggtgggggggtcagccccacgcctggccagccgccccgtccgggaggtgaggggcgcctctgcccggccgcccctactgggaagtgaggagcccctctgcctggccaccaccccgtctgggaggtgtacccaacagctcattgagaacgggccatgatgacaatggcggttttgtggaatggaaagggggggaaggtggggaaaagattgagaaatcagatggttgccgtgtctgtgtagaaagaagtagacatgggagacttttcattttgttctgtactaagaaaaattcttctgccttgggatcctgttgatctgtgaccttacccccaaccctgtgctctctgaaacatgtgctgtgtccactcagggttaaatggattaagggcggtgcaagatgtgctttgttaaacagatgcttgaaggcagcatgctcgttaagagtcatcaccactccttaatctcaagtacccagtgacacagacactgcggaaggccgcggggtcctctgcctaggaaaaccagagacctttgttcacttgtttatctgctgaccttccctccactattgtcctgtgaccctgccaaatccccctctgcgagaaacacccaagaatgatcaataaaaaaaaaataataaaaaataaaaaataataataaaaaatgtggaaacagaaattaaaaacagaaccattttacaattgctccaaagaacgtgaaatatttacatataaatctaacaaaacatgtacaacatctgtgtgatgaaaattataaaatgctgatgaaagaaattaaagaagacaaataattggaatggcatactatattcatggattggaagaatcaataaacatgtcatttcttcccaaattgatctatagagttaacgtaattttcatcaatatcccagcaaggttttttgtagtcataagcaatcttaaactaaaacagtgtccaacacatctagaggactgagtgagtgctagactcccccaagacagaggaagagcacatacacttagggcaccagcaaggcagggagtccaaggtttacaatcagataatctagaaagaagctatttttgcttcagtacatgtaagtgtgtggtttagtactgttttttagttagagttaaatatggggaaggagcaccaaaattgctggttagaattaaatatgggggagaagcaccataatccttagtgtttagaccctcttaaggtcttacttaatccatccctggctgaagtttattcattgacaaacagtgattgagtgcctactacccttatgtgccaggcactgcacctagctctgggaatatggttataaataagattacctatctctcatgaaactaacattcaagtggagagagaagacaataagccaataaacaaaaaccacggcctggactgtgacaagatggactacacagggaaaaaaaactgggtgaggtgatagtgagtgacttggggtaggggtgaaggtggtgggggaagttcaaatgaagaggggacatttgaactgagaccttaaggatggcaacaggggaagtggtcagggtagagaaaacaggtcactctaagaccgttcagcagaaacagagtgacttgtagagagttggtgtgttcccagagccaaaggaagccagtggggcacaaaagtataaaacaagggtgggcaggagccagattatgtagtaccttatagtgtatggagttcagattctattctgaaagatttaagcagttagtacatgatctgatttatgaagaggacatttgcaattaagtaagcataaaaggttgcgttttagagagttgggttttttttcaagcagataaaagcctgttttgtttgaatggtctatgtaattactgaggccactatgtatagacaagaaaggaggagctttatctctcggtctcttcctccttggacaacatcttgatgatctcctccttcttggcctggaggcactcgtcatgaagtttgcacacttccttagtcttaggccagtgggcctcagcctggtccaccaggagcttcttgcgggacttgtctaccttcagcttgcggacaattccatgagaatacgcttgtttttgaacacaatccctttcaccttctggtacagagtgtaatacatgtggcaatcagtcttcttagattcacagtatcttctaagaagctggcacagaatcctcattctccttatccaggttaccttccctggcctttgggcattggctgtaccttcttgcttacctatgcccaggtgcctgcccttccgatggtccaaggttttctggcatcaaggagcctgggaatggacaggcacaggcttgcggatgatcagcccatgtttgatcagcttctggatttgctgatgggagttaacattggtctctgggagccaaccagaccttctttttgccacagcaaaagacattagaggaaaacttcctctgaagcctgagcatatgcatggcttcagctgcagcagcaaaaacagttttaatattctctattttttaggtaatataacagctcccttttccaataggaagagagagtttttgacaattttgttaatctccaaggatcctttgaatgttcctaagtcaaatgttcttagcctaggatttgtggattcctagagagtatatagatgggctccagagggtctaagagccccctaaaattttgtgtatatatgcttatacatgtttttctgtgagtgggtccctagctttcaacagattttcttttcttttcctttttaatgagatgaggtctcctactgccgaggcttgagtacataatcatggctcactgcagtctcaacctccagggctcaagtaatcctcctgcctcagcctcccaagtaactaggactacaggtgcaaaccactatgcctggctaatttttaaaacttttggccgggtgcggtagctcatgcctgtaatcccagcgctttgggaggacaaggcgggcggatcatgaggtcaggagatcaagaccatcctggctaacacggtgaaaccccgtctctactaaaaatacaaaaaattagccgggtgtggtggcgggcgcctgtagtctcagctactcgggaggctgaggcaggaggatggcgtaaacccgggagcttgcagtgagctgagatcgcaccactgcactccagtctgggcgacagagcgagaccctgtctcaaaaaaataaaaaataaataaataaaactttttttctgtagagatggggtcttgctttgttgcccaggctggttttgaactcctgggttcaaccatcctcctgcttcagtctcccaaagtgctggggttacaggcatgaaccaccatgcacagctgcaacaaactttcaaaggattttatcacacacacaaaaaaagtgaataagacctacttcacattaaagtcttggctatacttctgggatagtagctgctactgttatcttagggttcatgacactgaacaaattacagttctagaaagaagcaagttctgcctcagagatgacactatgttggaggagggcaatatttacagcaaagtaggaaggaacttcttggaagaaaaatgttaacctgcgtgatgtgagaactagaagatacctaggaaattacctggtaccatctcacattacatgtaagaaaatgaaggtccaaagaggttaaacgacttgcccaaggttgtatagctagttagggactaaaaaggaattccaaacaggtcaccaacactcagcacagcactctgtgctccccatggaaaggtatacaaagaaactggactattgagctttaaagtttaataggaaatatgtgttaaattttattcaactcaattacacaagtgcatgctcattcctaaggaactggaaggaaagagggaagtaaaggagttcaaaaatgtgtaagttctcagtcctgaaggagatgaaaaacatgaatgttaagatgtacaatcaaaacaaagtaaatagcagtaacactttttttttttttttttttttgagacagtctcgctctgtcacccaggctggagtgcagtggcgcgatctcagctcactgaaacctccgtctcacaggttcaagcgattctcctgcctcagcctcctgagtagctgggattacaggcacgcaccaccacacctgggtaatttttgtatttttagtagagacggggtttcaccattttggccagtctgacacctgaggtcaggggttcgagaccagcccggccaacactctatattatcagtctatatctgatctttctgcagcagatttgttaaacagactcaataagttataaaaactagacaatttttcacttatcaatttggcagttattttaaaaaccggtaatcccacagttgagttaacaatatggagaaacagactttctcattagcactggtgagaatataaacaggtataactcttctggagggcagtttggcaatatgcttatgaaagtctttaaaaatgcatacccaacaattctactttacgaatttatcttggccgggtgcggtggctcacacttgtaatcccagcactttgggaggccaaggcaggtggatcacgaggtcaggagatcgagaccagcctggccaacatggtgaaaccctctctctactaaaaatacaaaaattagccgggagtggtggcagatgcctataatcccagctactcgggaggctgaggcaggagaattgcttgaacccgggaggcagaggttgcagtgagcccagtgaaccaagatggctcccctgcactacagcctgggtgacagagctagagctagactctgtctcaaaaaaaaaaaaaaagaatttatcttaaggaaatgatagtactattttcaaagacatgactgaggatattaatcataataaataatagctagcatttattgaatattacctcatttaattctcataactattaatcttctcagtttacagttaacttgccagtgggacacagtggctcacacctgtaatcccagcactttgggaggctaaggcaggcagatcacttgggctcaggagttcgagaacagcctgggcaacgtagccaggcctcgtctctacaaaaaaactttaaaaaaattagccaggtgtggctgggcatggtggttcacacctgtaaggtaatcccagcactttgggaggccgaggagggtagatcacctgaggttgggggtttgagatcagcctgggagaaaccctgtatccactaaaaaaatacaaaaaattaaccaggcatggtggcgcatgcctgtaatcccagctactcgggagactgaggcaggagaattgcttgaactcgggaggcagaggttcagtgagccgagatcgtaccattgcactccagcctgggcaacaaaagtgaaactctgtctcaaaaaacaaacaaacaaaacaaaaaaaaattagccagttggggaggcacatgcttgtagtcccagctactcagagactgaggcaggaggatcacttgagcccaggaagtcaaggctgcagtgagctgtgattgtgccactgcactccaggctgggcaacacagtgaaaccctgtctaaaatatcaaaggatttggacttttttcaaggcaagcaatggaggagccattgaaaaatttttaaacaagaaagatcagattcacacttttccatacagagaatggttaggtggggcagacgtaaagcaagacaggaaacaactgtacgagttagagaaccaaatggaaaagagaagacagatacaagatgataagctagaatcaaaaggaccttgcgaccaattagacatgagctattaaggggaaaagcagtgtcaagggtaactcccaggtttctgagcaaatgagtggatggtggtgctgcttattttgggaagagaaaaggtaagaaattgaattttaagcatgtcaagttcaaggggcctatggaacctcaagaggagtgagttattgcatttatcaatgtccgaaggtcagaggcagtgtctgggtaagagacaaggattttggattcattcaccatattcagttgtagacatgaatggcggatgtgaccacagggaaagtgaagcaaaaaaaaatgttggcaatcaagggaattatgaggtttaaagaagctcataggctgggtgtggtggctcacgcctataatcccagcactttgggaggccaaggcgggtggatcatctgaggtcaggagttcgagaacagcctggccaacatggtgaaaccctgtctctactaaaaatacaaaaattagctgggcgtggtggcgcatgcctgtaatcccagctactgaggaagctgaggcaggagaatcacttgaacccaggaggcggaggctgcaatgagccaagactgcgccattgcactccagcctgggcaaaaagaggaaaactccatctaaaaaaaaagctcatagggagactgagaaggagaaactagagaagtagaaaagaaagcagtgaaaatggctgttacagaaagagagccaagaaagtttcaagcagggcaagagtgtgtttttggtgggttaatacctcagggaagtcccctaaggtaaagatgaaaatgtatttctttgatttagcaataaattgactggggagagagtggtttttgctgaaggcagtcttgcaaaggcaagattgcaatgagccgaagaaggagtaagaaggaataaaatggaaactgtgaaatataaaccactgtttcaagaagcttgttcagagaaggagaaaagtcggataatcttgttagaggcagatgtagaatatttaaaccctacaaaaatcctaatgacttgccaagcagtctaaggttttgttttgttttaataaaacaattcataacaaatagggattagacaaatgagaaatgagaatttcttagttgcaatctcaggagagatttttactacttacagccgaaactttattttcagtattagatggaacacacacttacagctcttgtcagggtattttgacaagtcttttaataaaagtgaagtaaaatatgaataataatagaattgtcatttctaacctcaggtgtatttatcttttaaaaggctgaaaattacttttataattaaaaaaaatagtggtagtagggaaaaaagtaaataaaaagctaaaaagattagcagttgcttataatttttctcaattgttgattcacaactcaccaaaaatttaaatttaagtggcaaatacctatttttttttttttttttttttgagtctcactctgtcacccaggctagagtgcaatggcgccatcttggttcactgcaacgtccacctgccaggctcaagcaatcctcctgcttcagcctcccaagtagctagaagtacaggaatgcgccaccacacctggctactttttgtatttttagtagagactgggtttcaccatgttgcccaggctggtcccgtactcctgggctcaagtgatctgcccacctccgcctcctaaagtgctgggattacaggtgtgagccaccatgcctggcccctgtctaatttttattctgcctccacaattatcctaaggattatgtccaactctcacaaacttcagaatgaaattaaatctaattcagtttagcaagtaaaggtcttacagcacctttactagaaagtctatgcagaaaggccaggtgtgatggcacatgtgtgtaggcctacctactcaggaggctgaggtggaaggaccacttgaggcctggagttcaagaccaggctgggcaacatagtgagacctttgtctctaccaaaaaaaattgtttttttttaattagctaggcatggtggcatgcacctatagacccagctactgaggaggctgaagcaagaggattgctggagcccaggagttccagattgcagtgagctaagattgtgccatagcactgtagcccgagtgacagagagagaccccatctccaaagaaataaataaataaataaataatctgtgcaggaattgaaaaattaaagaatggtaataaagatgctgtaaaagccaaaaaattatgaacaatttcttttttttctttttttttttttttttgagttggagtctcactctgttgcccaggctggagtgcaacggtgtgatctcagctcactgcaacctctgcttcccaggttcaagtaattctcctgtctcagcctcccaagtagctgggattacaggcatgtgccaccacaccggctaatttttgtatttttagtagagagagggtttcaccatgttggccaggctggtctcgaactgctgacctcaggcgatctacccggctcagcctcccaaagggctgggattacaggcatgagcccctgcacccggccgtatgaaccatttctttaggtgagttttgcttctttttatctgaccctgaagaaaataattggaatgaatacagtaattcccttccccttcccctttccctttcttttcgacagggtctcactctgtcacccaggctggaacacagtggcaccttcatggctcactgcagcctcaaccttctggactcaagtggtcctcttgccctctgagtagctgggactacaggcatgtgccaccatgcccagctaatttttgtttgtttgtttgttttgtagagacagagtcttgctttgttgcccaggcttgtctagaactcctgcactcaagcaatcctcctgcctcggcctcccaaagtgttgagattacaggcatgaaccactgtgcttggcttcctttttttctgatataaataatctgttttttaaaattgctgtttttgaaggccagagattttttaatgtttttttcattttctgagtaaacatatgtctcagtgtactaagtttttaaattcacagtggctttctggactaacagtgacaacattcagtcacaacattcatgtttataaatgtaaacatttaccttaggaacagtctttaaccagtaactgaacctcttgttcaatgttggttaaacagcaagatgggatattctgaccaaaaagcagaaaaccgattttaattaaaaatacttttaaagtttatgtagtcaattttctattgtcttgacacaaaagatctatacctctagtttaggtcactgagttttaagaatatctcggctgggcacagtggctcatgcctgtaatcccagcactttgggaggctgaagcaggcagatcgcaaggtcaggagttcaagaccagcctggccaacatggtgaaaccccatctctactaaaaatacaaaaattaactgggtgtggtggtggatgcctgtaatcccagctactcgagaggctgaggcaggataactgcttgaacccaggaggccaaggttacagtgaccaagatcacaccactgtactccagcctgggtgacagagcgaggctccgtcttggggaaaaaaaaaaaaaaaaaatctcaaaccactatagtggtttactatatttctagttactataaagaaactggaaatgtaatggatttgaaaataaactatcatcatgtcaaatcaaatacaccacaggcagctcttttgtacaaggaatattctgggcttttaactctcataaccctcaagagttagatattattattttgtattttacagtggaggaaactgaggctgagaaaagttaaagagtttgctcaaagacaaatagctagtagcaagttaggactcgaacccaagttttcccaaaaggagcttttgttgagaagataaacaaaagtacaaatataagttaccaccaacaaaaattaccacaaacttagttaaaaataacattataggaaatgccactatattagaaagcacttctgtgattactggtaaaacgtatcattcagatatgagctacaaaagttagaaaaaatgagaacttgctgacctggggcagaagattcagccggcaacaaattccagcttcaccacacactggctgtgtggcttgagggaaacatagtctcctcatctgcaaaatgaagataacatcaaccttccagagttattgtgagggttacatgaagtaccaagtaaagctccaagtagagggcctagcacacatagtaaacactacatactgactccttccttcttaggaaaggctctccttgggtctaagaccttgaacaatagattgagttgggatattgaaagagaatggggaagctcatttcaggaagaaaaaagaagcagaagtcagagatacagcaggaaaaattgggtttaaaatagtttacctgatgcagaacatttaaatttaagggtatataataagcctggaaagcagtttgggccaaattacatcaggcctcagtcaaagattttagactttatattataagtagcagggaatgacggagagtttggttcctttgtttacattatgctttattgaccttatgttttattataaagcaatacatgttcattgtagaaagtctgtaaattggccgggcgcagtggctcatgcctgtaatcccagcactttgggaggcagaggtgggcagatcacttgaggctaggagtttcagaccagcttggctaaaatggcgaaaccctgtctctactttaaaaaattaaaatttagccgggcgtggtggcgcaggccaagattgtgccactgcactccagcctgggcaacagagcaagagactctgtcacaacaacaacaaaaaaaaaaaaaagaaaaaagaaaaaaaaaatctgtaaattacagagaagtgtgaagaaaaatatacaaaacaccttattcaatagttaccttgagagataaatttttttattgttttatcctttggtggaattttttttcttttttcagtagctttactgaggcataattgacaaatagaaattatataattcaaagcatacagtacgaatatttgatatacatatacattgtgaaatgattaccacaatcaaattaattaacacatctttccccacacacagttactattttcctttggtagtattttgattgagttttttttttccacgtacatttgttattttaatactaataataaaatgtataagtacatggaaaacattaaacacatttacataactgttctttttataagaagatttgcctctcaaaaaaggatttgcatatttgagatggtcagatggccagtgagagttccccaaggctagaaccacacattttatagggtacaatggttgctaatctttatatgcatcttggcctatcatttcaacatatcgttgtaacacatttttcttttatttttaatatagctaaattatttaatttctttaaaaaatattgctatcataacactctccaaagattacctctggggacatttgggtgtatctttttcagtttgaaggtttgaacttgaagatagatggaataaaagtgggactttaggtggcttactctgaccaaagcaaattagaaagatgcgaggaaggagattatagaacaaggaagaccatattgggctatggtagcaattcaggcataggtcaataggtcaaaaacgggcaagactggtacagtgacaatggacatggaaagaaagcaacaaacacaagtaacaatacagagggagaattgacaggacttggtgactcacgagctatggagggtgaaggagatgagtaatgaaagatgatgctaaggtgtcacctttggcaatttatataaatttcaatttcctcatctataaaatggggttaacaattgtaccttcctcatagggttattgggaggattaaatggatgacatctaaaatgcttagcacaaaaacaggaatgcattcttagccaatagtggctgtcatagtttttatagatgttgaatctacatggctgggtttaagaataatgaaattcttaaataggaaagtcaggagaaaggtctgattgaggtagagaggtagagttgagctatagtttagacatgtcagatttaggtttatggtggacagttgattaaaaatgttcagcaagaagccaccactggcagtgatgtttgacagtgggtacattttaggaagacttcatgttcatgagaagcagatacctggagggtggataccgctgcacaatgtccacatgtctgcccgtaacctccacttaacgatcagaaattacctgatctaataagcaatctctacatatcgtacacttcccggctgagtggctctggtaggacagataccaaagtagtgaagcatttaaaggttttggaaccagacagatctgtttgaatcccgactcttccatttactgttgtctaattgcaggaaaaataattttcttagcttcacgttttcttatttacaaaatggagtaataaaaatttctacctcatagcattgatgggagaattaaatgagactatttaaaataaggtcaggcatggtggctcacacctgtaatcccagcaatttgggaggctgaggcgggcagattacctgaggttaagagctcaagaccagcctggccaacatggtgaaaccccgtctctactaaaaatacaaaaatatgaacggggcctggtcttgggcacctgtaaccccagctactcagaaggctgaggcaggagaatcgcttgaacccaagaggcagaggttgcagtgagcagagaacataccattgcactccagcctgggtgacaagagtgaaactccgtctcaaaataaataaataaataaataataaaacataaaaataccaagttgttttgttttgttttgttttgttttgttttgttttgaacagggtctcactctgtttcccaggctggaatgcagtggtaccatcacggctcacggcagcctcaacctatcccaggctcacgtgatcctccacctcagcctcctgaagtagctgggaccacaggcgcttgccactaataaactgttaattgttgtactttttgtagagacggggtttttgtcttattgcccaggctagtcttgaactcctgggctcaatcaatctgcccgcctcagtctcccaaagtgctcagccactgcacctggccataaataccaagtattgctattaatcatgcctctccttgaggttaatagttcgtttatatttcctctccattctttacggtgtcaaacatgagaggcactctctgctaactgctgatcactgtgcctccacaactttggttttcagcctctccccatggctcagttctttttggaactttgtaactcatagtttcgtgaaattccagaatgccaaacagcatctttggaggaagatggtctgttagtctttgtttggagagaacttctgtattagtttcctatcactgcttaaacaaattaccacaaacttagtgactgaaaacaacacaaatgtattgtctcacagttctgtaattcagaagtacaaaatggtctccctaataaaatcaaggtgtcagcagggctgcattcttttctggaggctctaggggataatccattccctcacccttttaagtttctagaggccacttgcattccttggctcatggccttcttcctccatcttcaaaaccagcaatagcagcttgagttcttttcacctcatcaaccatccctctggttcacttctgcctccctcatctcctattaaagacccttgtgattatattgggtccacctggataatccagaatgctctccctatgttaagatctgctaactagcaaccttaatttcctttgcaactttatctctcttgccatgtaacataacataggacaggttttgagaattttgatgtgaacattttgggggaccatcattttgcctaccgtaccctccacaaagaaaactccagggagatttgcccctgctttgtctctctgtcttgcaggacctaactgatcctctaaatcatgaaccatctatcacaatatgataattgcaataatcacaattgggaggcctttcatgataatatttttcttctggtctaagtctgattctgttccatgcttaaagatttatttgtagctaaatacaatgactgttaactaaaaattcataaagaaatagtgatcttggccaggcacagtggctcacgcctataatcccagcactttgggaggccgaggtgggtggatcacgagttaaggagtttaagaccagcctggccaacatggtgaaactccgtctctactaaaaatacaaaaattagccaggtgtggtggcagtcgcctgtaatcccagctactcgggaggctgaggcagagaaaaaaagaaataatgatctcaggaaatcctttccagtatgggggaaaaaaaggtttatcatcaaccattcacttttataaatgatatgaatgtccatttctttttttcttcaagtcagagtcttgctcttctgtcacccaggctagagtgcagtggcccaagtacagctcacagtagcctcaacctgccagactctagcaatcctcctacttcagcctccctagtagctgggacaacaggcacttaccaccatgtccagctaattttcgtatttatttatttatttatttatttatttatttatttatttatttatttatttgtaaagagagggtcttactgtgttgcccaggctagtctcaaacttctgggctcaagtgatcctcctgcctcagcctcccaaagtgccaggattacaggcatgagccaccacacctgactgaatgtgtattttatttctgaaacaaaaccactacacatgattgttaccaatatgtttctattttttttttttttagctgggtatacctgtaatacctgtagtcccagctattcaggaggctgaggtgggaggatcacctgagcccaggagtttgaggctgcagtgagccatggttgtgccactgacggcatgacagagtgagagtttctatttttttaacagaaccccaacagcggtgctttcattttagatccaattgatgattaatggacggcagagtatgtcttaagaaagacaggtgaaaaatatcaggttgcaaagcaaagcacgtaaatataccaaagccagaattttttttatttttgtaaggggtaaaaggccatgagtactattttaggagtaccaaaagttcaaacactgtagttggaaatggataaaacctcaatacctttgaatctgacactgaaatttagtatttctatcttttaagttcttttatctcaaggtatataaaagtgctccaaataaatatgtccaaatcttgggattttctttttttttgacatggagtttcactcttgttgcccaggctggagtgcaatggcgtgatctcggctcaccacaacttctgccccctgagttcaagcaattctcctgcctcaggctcccaagtagctgggattacaggcatgcaccaccacgcccggctaattttgtatttgtagtagagacagggtttctccatgttggtcaggctggtctcgaactcccgacctcaggtgatctgtctgccttggcctcccaaagtgctgggattacaggcatgagccaccacgtctggtgagcattaaaaattttgttataaatttcagcattaaaaaatgtgttaatggttgatcctaattttctagtgggtaggaggttagctttagtacctgattgaaagaaaacagcttgaaaaacaggagaggctagcactaaattgttttatgactttgggcaggagactcaagagaaggaaaatagagagcccaacaggtattgagcatctattattgccaagcactgtgtttgcatatattatttccctgagtttttacaacatttcctgtgggtcgccattgttacactttaaagatgaggaaatcaaggctctgagatgttaacagactctcccacaatcgcacagctaaagggtaacagcactgggattagagtccagtactgcctaactccaaagcccatgcatatgctttccaccaccctcagctgctcttgccttgtttcctcatctacaaaacaagggagttcagtcagataatctctgatgcccctcaagttctacctgcatggcctttgtggttgggaggagaaaggggaatcagggcagggtctccggcactgtgctgagtggtcttcttctgagtgggaaagcaatgaaaccacgtgtcttactggtgctgtactgactccctgtcctgtgaaagaaggctgctgctgctggcaacactgcaaatgacgatgggactcccaggcccacagccctcaaaaggaagtgagtcttctcattctcctttgcagggccactttttataaatttacatttccaaaaccaaatccatcaacatttactgttgagaattttattgtgcccaacactgagttaaatggtattgcaaggctctatatacaatagcaaggaagtataagatgtggtctgtattctcaggaacttacaactagctgggagaacacaacacacaaagcaatttttgaaggacactgtataatgcaggactgaattgtgtagtccagatgatatgtactacaggagtgcagagaaatgggcgttcagtgggggctacagcacccgtgagaactggagcagagacaacgttattcaccttgcattcttgactagtctttcttggccttttctgtaattgtgaaaccctggtatgactctttgacatagttcaaacattctctgctttgcaggctgcagtgatgtccttcatatcacgtcatcttagtgccacttcatctttattggcatgtgtgggaggaacaaaaccccagtggtatgcaaacaccgtcatggggacttgcttcaagccatgggaagtttcacgcaaagccagtttctcagtagggcaaatgttgtgtaaaagtacaagaagtttgagaaactagttaaaggcaaagcctgtcacagcaagaatgagatttgaatggggacactttcctgtctgtgtcagggatggtctgatggtctactcccagcccctcaccttcggagcccctgtgcttaagtacttcgctgacaacatggcccagaggcgaaaggaccttgtccaatgcagcaggaacttcttattcccaaaccctctgcccaccctcataggccagtcttttgataagaggctgtagacctgaaaaattattctagaatgttggatctaatagatttaatagtcactatatatttactgcatgttctgaaacaaggctggattgaggactgttttcatttgagctgaagacacaaaatgaatatacaggaaacagcagctaagtgtacctgacagattaatggcatcaagtgctaagccaagggtaattggttcagaaaaatgagacactgataagtacagaagtaatgagggaaagtgtcaccaagccaacgtttaggagagaccttaaaaaatggaaagaatctggattggcaggaaagagaaattatgacattctagaaatgatatagtacctactatttcatgtgatgaattataaattataataggaaaccattatcaaaggcaagaaaagtgaaagatatattcatggaaaaccaaagcagtcagcctgtctggaggaagggtggcataagaatgtacatagcaaaaattaatgggaagttaagatcatctgaataagatgaattcatcaacatacttaggctgggcacggtggctcatgcctataatcccagcactttgggaggctgaagtgggtggatcgcttgagcccaaaaattcaagactagcctgagaaacacagtgagaccctttctctacaaaaatacaaaacaatttagcggggtgtgaaggtgtgcgcctatagtcccagggagtatagtacttgggaggctgaggtggaaggacagcttgatcctgggaggtcgaggctgcaagtgagctatgatcactgcacaccagtgtcggtgacagagtgagacactgtctcacacaaacaaacttaccaaacatatatcaagtgctgattacactaggtctcttgctgcataattataatagtttacacctattaaagcttacaatgtgccttgcactgtgttaaagtgctttacatatattatctcatttaattgtcacgacagacctatgaggtatatgttacctcataggtaatgtatccattttacagatgaaactgatgaaacccagagaggctaaggaacttgcttcaggtcacatagttactgagtgggaaagcctagtattgaaccaagtaagtcagcccaaacacgggttccgagcacaatgctaaactgtctccacagatattactacaatctcataaacttccctatgacataggtattatcaccccagttttgcaaatggggattcaaggtttcgagagtcagtgaattgcccaaggtcattctgctgagtacggggctaggatttgaaagcagatccactaactccaagtccattaaacttcccattacaatatagccacctggcagaaatattgtctagtatgagatcagattagaggaaattttgacagcaaagaagagcaagaagtctatatgaatagggaagaacttcagggttttgaatagacatgatttgattaatgaaggtagtctaggtctggcctcagtctttcacaggtaattgaatcagggaaagggtagacatgaacagtagatgatattagaggaagtaaggacctagaaatgggcataggagagagggaatgacagaaacaagatcaatatttgaaggaaaacctgattgttctaggggctgaacagctgagagtgatgaaagaggagatcaaatcaaagaggaatttgcttctctatatctaaataacttcatggactattgacagggactgacagtttatatgagcagctgatttgtggcaaaaaaaaaaaaaaaaaaagaagaaggttgtttttggacatgttgcaatctgcttggcagaacaatgacctgcacattccagaggaaatggccagtaggcagtcagggaaatgggattggagctcaggtagagagcagaagctgtcaatagtatctgacaaataagctctgcaaggaccactgaaggggcagacaagtcacatcccaagaaaaatagggtttttttttaataatcagaatgcgccaggagtcagcagagaaccaaaatgcactataatgaaagagatcaggcccaagggcaagccacaggtcaagataagtggttagggacaatgcagagataaaaattaaagggatgcagcagcaaatctgatctcatcagtatcaaggataaatgaccacagaataatttcctgtcctgtttctggtattttggggtattcccctattgcaggagccaaatccacttaactggatgacgccctcagaatgaccctgcagaacaaccaggaatcttcctagcagggagtacacagtctacatcagcacagggagagaatgaaagttatcaaaaagggcctctccactgaattgtacatgtaaaaatggctaaaatggtaaatgacatttatgtagattttaccaaaatttaaaagggagtctatctcttgaaaagataaacatctacggattcccccaaaatctccaaaagttcacctaattaccatctcctggacttcccctgtttgttaaagatcttgatttccttgcttaagttggtggctatggtgctaaagggatgaagatacttaagaaaccatggaggctgcagctacctggtgcccttgtcccttccagtctgggaagggaatgggatagttggttgtggtcagtttgctgtggaaactcctcttctggcctttctgctccctctgtccttttttcagaactttgagaacatgacacattggccaatgctccaccctctgtgacctcttctgcttgacacaattaagaaaatgagccatagagcaactcagccaacacctggaagggacttacctgagacaggaacctgagagtcctgtaacttcagttcttgctcactgccctgtgcatatggccttagaatcctaggatcctctttctgactttacagagatcacctccaagcctatatcgaattcctttcctgatcaatatataatgtgttcttagttcagggggccttcacaaaccagggcaacccaaaggtgctcagctcctacgctcttggaagtagcaaggtggggctcctcttcatcttgtaagtaaggaaacagtggcccaggatcagttcaatggcttgcccacgggcatatacctggctaattgcagaaggggaaggagatgcaggccttctgatccactctccaaatctctgttagttagacaaagagatcccagctgaaatatttggaatgctatttttactgaagctttgctttcccccagatttagtctcttttactgcctttttctcaaaacatatttaaactgcttggaaatgccaattaggggtctaaaatagaatgataactgcaccgatcaattggggaagctcactggttacccacaaaaccatcacagaccgcctattatgctgtggctaaaactcggatccatgccttcccgcagcctcatatggcagagcaccccagtccctcctgtcgttgccccatgttggccttgatgtctgcctctgaaatccttgattaccaacgtcaacaggcaattggccagcttaggaggggccttccaaggctatggcaagatagaagaatgacagtacagctcatcataaacgtatttatcaggcaaacttcaggaaaaactggtttctcaggcttgccacctgaagcaaaatagttctgggtgaagcttgacatggtgtatatctgtgggtcaggtcagcacacacacagaaaaagaatcttttttgttttctctttggagattatccaaactataaagttaaccagagaaatgaattatctgttttagtcaagcctatatttctttccaatggtcattttctggaaatgcaggaattcaagtttagaacttctaagtgatagagtcatatactcataaaatagtagcactgtatgggacccggaaattgtctaatctagcgtctaattttgcagataagaaagctgaagtttcccattattaaatgaatattgtacttccatgcaggcagagattgcactcatttctttacaagctgaaattacactgttggctcccatggcactggcagccagcctaaataaaacccataatatttttcatataaactgctcagctagattttccgcattccaggtttatacataaatttcttaacattttgttcaggagtttacattttccctttctaattttactagtttaaactctatatgccagtctatgatttgaattctggcccggtcttaagccttataagtacttgagaaagggcaagatcatttgctagtgtgcactttacagtgtacctgtctttatttatttttgtatttatttacttatttattatgttttgagacaaggtctcactgtatcacccaggctggagtgcagtggcaccatcatggctcactgtagcctcaacctcctgggctcaagcaatcctcctgcctcaccctcccaggtagctgggaccacaggcacatgccaccatgcatgtagaaaaatttaaatatttctaaaatgttgcccaggctggtctgaaactcctgggctcaggtgatcctcccacctcagcctctctcccaaagtgctggcatgacaggcatgagccacagtgcccggctcccctacaacttcacttcttgctcactgccctgtgtgtatgcccttacagtcctaggatcctccttctgactttacagagatcacttccaagtctatatccaattcctttcctgatcaatatataacatgttcttaggtcagggggcctccacaaagcaggacaacccaaaggtgctcctgcacttagctattaggacaatagctaagttgtcctaaataaaatgctatttatgaaaagcatttaacttaggtttcccccacctagttttgtcctaatttaattcctcaaggaggtttggtaacttttcctcccttcttacatgaaggagctctaaaaggggtctttcctctataagggagaagaaactttcgtagcttgtctcctaccagaagtagaagtgactggagtaatgtggtaaaaggctaccctctaaactccagagtcagaagaaccctttcttttttttttttttttgagacacagccttgctatgaggcccagtctggagtgcaatgatgctatctcggcactcactgcaacctctgcctcccaggttcaagcaattcttctgccccaggctcctgagtagctgggactacaggcacacaccaccaggcccagctaatttttttgtatttttagtagagatagggtttcaccatattggccagactggtctcaaactcatgacctcaagtgatccacctgcctcggctttccaaagtgctgggaatacaggtgtgacccaccacgcccagccaagaatcctttcttatgtccatgttgatgtataggttagtagtttatcttccatcagttatgaaaactgcaggagtcaagaaatttaggagtagggaggaaagaaaggaaagatttcctaatctcttcatactcaaaaggatatgtgctatatgaaaaaggagaattgagtgaaatatctgtgattactttatatattgtaagtagcctagaaacctaagaattatacctgacttcttccttcccttcaccccccatatctaataacaagaatcactaacacttatcaagtacttactgtgtgccaggtactgtgctgagcattttataagcctgattaattgaatcctcaaaacaattaggattttaagatgagaagattggcacttttaagaggttacattacttgcttgaactcatatatcaaagattgatggagccagattaccacccaaattattgtgactccagagcccaaaagcttacccacaataaatattgtcctctaggagagccatcagaccatgatacaggtttgtcccttatgagacatagaaggaagaatgaaaggaagttcaagagggagaaagatgctgggtagaaggaaggacaaaggaaggttggtgggttgtgcggcaggaaggttaggtggagggttggtgggttgtgtggaaggaaggttaggtggagggttggtgggttgtgcggcaggaaggttaggtggagggttggtgggttgtggggaaggaaggttacctggagggttggtgggttgtgtggaaggaaggttaggaggaaggttggtgggtttcgtggaaggaaggttaggaggaaggttagtgggttgtgcggaaggaaggttaggtggagggttggtgggttgtgtggaaggttggtgggttgtgtggaaggaagtttaggaggaaggttggtgggttgtgtggaaggaaggttagctggaaggttggtgggttgtgtggaaagaaagttaggtggagggttggtgggttgtgcagaaggaaggttaggtggagggttggtgggttgtgcggcaggaaggttaggtggagggttggtgggttgtggggaaggaaggttaggtggaaggttggtgggttgtgtggaaggaagcttaggtggagggttggtgggttgtgtggaaggttggtgggttgtgtggaaggaaggttaggaggaaggttggtgggttatgtggaaggaaggttaggagaaaggttggtgggttgtgcagaaggaaggttaggtggagggttggtgggttgtgtggaaggttggtgggttgtgtggaaggaaggttaggaggaaggttggtgggttgtgtgaaaggaaggttaggtggaacgttggtgggttgtgtgggaggaaggttaggaggaaggttggtgggttgtgcggaaggaaggttaggtggaggtttggtgggttgtgtggaaggttggtgggttgtgtggaaggaaggttaggaggaaggttggtgggttgtatggaaggaaggttaggaggaagattggtgggttgtgtggaaggaagtttggtggaaggttggtgggttgtgtggaaggaaggttaggaggaaggttggtgggttgtgtggaaggaaggttaggaggaaggttggtgggttgtgtggaaggaaggttaggtggagggttggtgggttgtgtggaaggaaggttaggtggagggttggtgggttgtgtggaaggaaggttaggtggagggttggtgggttgtgtggaaggaaggttaggtggagggttggtgggttgtgtggaaggaaggttaggtggagggttggtgggttgtgtggaaggaagtttgggtggaggaatcttagactgctgtgcagtattaagaaagttcagcaaggacaatgtaacatcttggagctaaagttgcccattagaggggtcccacattccccaggaatgggcctgccttaatattcctgttgcactcagtcatggagtagccttcgagaagcatgagctgagcaggaagccgtgatggatttcagaatgtagaagttggggctgtaagtcaattatgaggtgcatttctttggtaacatcttacatcacactgtcttttcaagcaaatcttttagctttgtcttcaacaaatgtctccacctactgccctagttcaagcctctgtcaccattcacctagacaattccaaaaaatgttttgtttccctacttctagtcctaatacccttacaatgatttcccacaatgctataaggatgaactttatgatacataaatgcaactgtgtcataattcggcttaagaatctaggtggatgccaggccgggtgactcacgcctgtagtcccagcactttgggaggccaaggtaggcagattgcctgagatcaggagttcaagaccagcctggctaacatggtgaaaccccatctctagtaaaaatacgaaaatggccgggtgcggtggctcatgcttgtaatcccagcactttgggaggccgaggcggatggatcacgaggtcaggagatcgagaccatcctggctaacacagtgaaaccccgtctctactaaaaatacaaaaaattagctgggcatggcggcatgcgcctgtagtcccagctacttgggaggctgaagcaggagaatggcgtgaacctgggaggcagagcttgcagtgagcggagatcgtgccactgcactccagcctgggcgacagagcaagaccccatctcaaaaaaaaaaaaaaattagctgggcatggtggcacacacctgtattcccagctactcaggaggctgagacaggagaatggcttcaacctgggaggaggagcttgcagtgagccaagatcacaccactgcactccagcctgggcaacagagtgaaattccatctcagaaaaaaagaagctaggtggagatgtctttttgtcaattgataatgggtacaatgatcctttagcatatatatgacaacaatctcaccagctttcattaacaaagctaatttcaaaattgcctcatattctttttggtaaggtcatcattatatttatatatggagctatcccagttaccatatgtcatttatctgcttaaaaacctacaaatatttactaggataacacctaagcttttgatcacagtaaactaggactcccaggacccagccactttctacttctcctgtattatccctgctactcctttcctggcatttaatactccaaaaatacagtaccaaactgtctgtagcttctgctgtgctgtacacatcatcttcatgtctttgtttatactattccctctactgggactgccattgtctcttttcctcctcccctcctttctgtgcctatttgaatgtcattttagattcagctcagctaccaccagctttccaagactccaatacaccaactcaaagatcatttagtccaagctctgtcccaattcaggaatcctatggaaaccgttcaggcagaaggtaatccaaggaagagctcacagtatcacaaggcaactagctgtatctttggactgtgctcatggtcacataaagcaatgacagccacttcccattgtgttttatcagggagtctatcagttcctgtttctccatcttttctgggtgcagtggttagaataatatactcacttgaagctttaagatgaacggagagttagaagttgggaggctgactgagaaattctcttggcaaatcctatagaggtggaccaagtgtggtggctcacacatgtaatcccagcactttgggaggctgaggtaggtagattgcatgaggtcaggagtttgagaccagcctggccaacaatggtgaaacctcgtctctactaaaaaaaataaaaataaaaaaataaaaaattagctgggtatggtggcgcgtgcctgtaatcccagctacttgggaggctgaggcacaagagtcacttgaaactgggaggcagaggttgcagtgagtgcagatcgcaccactgcactccagccagggcaatagactgaggctctgtctcaaaagaaaagaaaagaaatcctatagaggtgatctcctgctttgaaccttcagatcttgggtggggacagaagtggggaaggtgaggatgaggaaggacagagcttgtcaacaagccattggtcatgtccttctgcttgtaatgtctgaactttctagcttttcatttctaaattccctgcctatgactcacagatgtttcaaggggccttcagaatgcctgtggactttagtaggtgagagccatgggcagaggaaagatgtagtagatgacaaatcacgtgagggttagaatttggccacggtgactgcagttgctaagattctaaatgtttccttagtgctttttggtaaatctctcttctcccaagatcgaaaagttgcatctagaactagatatatagatggaagttacctaatatggaggaaaaaatagtgaacaaaggctaatttgggaatcctaaactcaattgggattgtggaatgaaaagcatgatgaatatgagttttctttatccacatctaaagcaagcatcattttcccaattttgagtaggtactgcctgcttttatgcattttagagggttcagtgtggtggccgagtaagcactgggacactgtcaagtagtttcagtcaaaagttcattttggggaagcataaaaaggactcgtaatatgtatgaaaaaataagtaaaataaatatgaataattatgaataaaaatttcaccactagcaatgttattcacgctgcaatcatggaaataaaaacaacaataaaaaatactgagcattaagaatcactaaattatcttaccagccatcatgactctgtacaaacagagcatacaattaaatttttcactggaacttgagtattgatcatctgggaatataaacatgagagaaagataataaaaggaaactagtggctgcagcggctcacgcctgtaatcccagcactttgggaagcagagctgggaggatcacttgatcccagcctgggcaacatagagagaccctgtgtctctttaaaaaaaaaaaaaaaaggaaattagtttcattgtattttaaaatttgttctaaagctacattaattgaaacagttggaggccgggcacagtggttcacgcctgtaatcccagcactttgggaggccaaggcgggcggatcatgaggtcgggagatcgagaccatcctggccaacatggtgaaaccccgtctctactaaaactacaaaaaattagccgggcgtggtggcgggcacctgtagtcccagctactcgggaggctgaggcaggacaatggcgtgaacccgggaggcggagcttgcagtgagctgagaccgcaccactgcactccagcctgggcgacagagcgagactctgtcaaaaaaaaaaaaaaaaaaaagaaacagttggtatagtgcagaaatagacagatcaatggaaaaagctcaaaagtggacccacatgcaaacaaaattagtttacaataaaaggagcattccaaatcagtaggaaaaatattcaataaatgttgttggtataagtgattagtcttttagaaaaaatgaaaatgcatccatatttttctctgcacatcaaaaataaatcccagaactaagacttaaatataaaaatgaaaaaaccaaagtactagaataaaataatgaatttttaaataatcttgcatggagaaggctttttcttagtatgaaaacttggcaatatttgtctataaaatccagaagttgtcataaagaaaagattaataaatatgactacttaaaaatgaaaacttctgaataaaaaaatacaatcaacaaagtcaaagacaattgacaatctgggagaaaagtgggcaacacgtattatctatatatgttctcattcctttagtatagatgaagcctttagaaatctgtaaggtaggctgggtgcagtgggtcatgcctggggtaattccagcactgagggaggccaaggcaggcgaatcaacttgaggtctggggttcaagaccagcctggccaacatggtgaaacctggtctctattaaaaatacaaaaagtagtcaggcgtggtgatggcacacacctgtaatcccagctaccctggtggccaaggcatgagaatcacttgagcctgggaggcagaggttgcaatgagccaagatcatgccactgcactcctgcctgggccacagagctagactctgtctgaaaaaaaaaagaaagaaatctgtaaggtaaagccaaccacctataaaagaatgagcaaaggaggccggacacggtggctcatgcctgtaatcccagcactttgggaggctgaggcgggtggatcacctgagtcaagagttcaagaccagtctggccaacatggagaaacaccgttagagactaaaaacacaaaattagctgggcgtggtggtgcatgcctgtaatcccagctacttgggaggctgagggaggagaatcacctgaacctgggaggcggaggtcgcggtgaggtgagatcgtgccattgcactccagcctgggcaacaaaagctggaaactccatttcagaaaaaaagaatgagcagaggacatgaactggtacttctcagaaaaagaaatatgaatgcacccaatgcacacataaaaagaatactcaacttcgctgctaattcaaataatgcaaattaaaatagcagtaagatggcaatttttaaccagtcaaattggcaaagctttaaaagtttaataacaaaacatgttggctggcaagcagggaaacacattaccaatggaagtatacgtatttataatgcttttggagaaaatttggcaatatttcttttaaggaaatttccttttaattctcagcaaggcaagttacttctatacagaagcgtgtgcccttacagatggaacaatgaggactgcacatctggacaagggaggggaaggggttcttatcccagaagcacttggcccctgctgctgtgtcgttcccctattggctagggttagactgcacaggctaaactaattccgattggctaatttaaagagaatgatggggtgagtgctttggcgggagtcagggcagagcaggtagcaggtaattggaatgagttagggtggagcaggtgatcagaatgagttagggtggagcaggtgatcagaatgagtggagagaatgagttagggtggagcaggtgatcagaatgagtggagagaatgagttagggtggagcaggtgatcagactgagtgaagagaatgagttagggtggagcaggtgatcagaatgagttagggtggagcaggtgatcagaatgagttagggtggagtaggtgatcagaatgagttagggtggagcaggtgatcagaatgagttagggtggagtaggtgatcagaatgagttaggatggagcaggtgatcagaatgagttagggtggagcaggtgatcagaatgagttagggtggagcaggtgatcagaatgagttagggtggagtaggtaatcgaaaaaggttgctttacgaggaagtttagtttaaaagtagaaggcaaagaattgaacatactgcctttttgtctctgtctcttcctctctctctctgcctctctttctctctctctttgactccttctttttctgtctcttcctttccctcactgcctctctgcctctcctctctctcctctagggtagggacttgcacgagtggagctactctctcttcccctgagaaggaaggaaagggggtggggttgtgtcaggttcaatccttgaaattagtggaaggcccaacccctcaacactagggatgtctcgccttgaaatttggcaatatttctaaaaaattcaagtgcaacatatacaccacggaatactatgcagccataaaaaaggatgagttcatgtcctttgtagggacatgaatgaagctggaaaccatcattctgaacaaactatctcaaggacagaaagccaaacactgaatgttttcactcataggtgggaactgaacaatgaaaacacttggacacaggatggggaacatcacacactggggcctgtcatggggtagggggaggggagagggatagtgttaggagatatacctaatgtaaatgacgagttaatgggtgcagcacaccaacatggcacatgtatacatatgtaacaaacctgcacgttgtgcacacgtcccctagaacttaaagtataataaaaaaaattcaagtgcaaatacttttaatctagaggttcctcttctaggaatctgttctacatataaattcacacaagaacagaaatatgtataataaaggttgtatatttctgcattaaccagtaaaaataaaaagtaaaacaaagtaaattatgaaaggaaggaaagaaaagcaacaatgaaggatgaaaatagtgctctatactgtgatatggaataatgtccaacatatagttaattgaaaaaatgtagaacagtgtgcatgatataataccatttgtataaaaatgaaacggagatacctatactccttgtagtgcatagaaactttttagaaggatatacagtggttaactctggagcgtgcatcagagagatggggaaaatgtttttattttttatcttatggcctttttttattgtttggatgttttaccgtggccatgtattacttttgaaataagctacatttttaatttttgcaaatgaaaaagataattccatctggttcaggaaaagtgtctgtagagaacatggaaggtgtttttttcattttgccacctttctttttttgagagggtcttactctgtcacccaggctggagtgcagtggtgctgttatagctcactgcagccttgaacccctggtctcaagtgattctcccacctcagcctcctgagtagctaggactacaggcatactctaccacagatggctaatttttaagttattttttaagagacagggttgctatgttacccagactggtctcgaaatcctaggctcaagcaaccctcctgtgttggcctcccaaagtgtagggattacaggcttgaaccactgtggccagcccacctttctttacttctcttttttttttttttttattgagacagagtctcactctgttacccaggctggagtgcagtggcacaatctcggctcactgcaatctccacttcccaggttcaagcccttctcctagctcagcctcccaagtagctgggattacaggcatgcaccaccacacccggctaattattttttattattttttatttttagtagagacggggtttcactatgttggccaggttgttctcgaactcctgacctcaagtgatccgcaccccctcagcctcccaaagtgatgggattacaggcacgagccaccatgcccaacagcccatgtttctcaaataatatttattcaactctattgagtaagtgataggagtctaaattcaatctcactgtttatcattctatttgcccatccatcagttcttggtaatatgtgttaataggcatggcctgggaaaacgaagtgcactgagaatttttagtctaactgctgtgtgtccattacaggtatcactcatcttgcaaaatggatattgttcagcaaaattaaaaggcttctctagagtaaaatccatgtcttactaacatttcagaagttaatgttctttcccagatacaatagattggattaaaattttgattgaagaagggattaagataatttctggaacatatattgggcattgccatgtagctgcactacgtatttatggggacatcccaagggttcctttgtcacttgttgcatgtatgtgacagaaagaatctggaaggcaatgaagtcaggacacttggcctgtgatcctccagtcccacctccatctgaccaagggtgagacacttttaaagagtttttgttcggtcatcagatatcgggaagtgttactatatggcaggcccttacactcagttatattcagttctgtatgccataccaccatatagtatatattatgagtatggtataatctagtgtaataaaatgttaataaataaataaaatagtaaaataagaggtatagagagctgccaactgcgtgtgaacaagccaagttctctcagatttgtcactctcctgcttaaaccttcagtagctccccagtaccttcaaattaagtccacatcctaagcttggcattcaaggtgcttcgtcatctatcacctgtccacttctttggcctcagctcttgacactgctctcatctcttgagatgcctgtgttacactcaaatctaattatttgcagttcccccccattatttcacagaactatgactttgcaaatgtttctttacctgcctgcttggaaaaacatgtactcagtgtttgagacctggctcagaaatcagcctttctgtaaaggcttgccctggttcctctctatattttctgaataactttattatcacacttaacaaactatattgaagttattcatttacattcttaaggaagtttggaaatgaaatgtaaaataaatccccattagtgtataagctccttgagggcagaggccctatctagttaatctttgtatttctagtatatagcacactgcctgctcaacacactttgtaaatgaatgcatagataaaagaatgaatttgttatactatagctgaaggatttctttgtagtttgacatttcttaatatagtgacaaatgcagtaaaacctgcatctctcctggattccatgttatctctacctctgccctacaggcactactcatagcattacagtgaagttcctgtaacaattcatttattttaaaacatactaaatcagcaagcatatatcatttatatcttgacagtgtactttaaagcagatgcttcagtttttcttccttcacatagctagcatctctccagacaagcttagatagcaacctgttttctttggcaaattgattaatggggacattactcatatgcctggttgcatgacatttccaataacattgtcattttgtttatggagtggtgggtaaaaatatccaggaatttactaccagtggaggaaccacctgtttgctggaaacattaaagaggaaaaactggagaggcagctctcttggagaatgctgaaaaaggtctaattccagcacgagcctgccccacaacaaaccacctcccaggggcacctgtggaaacaggagaacagccttgccgtgcatcttagcactttggctggggactgaactgccttgcggggacctggcaaaactgcagaggtagcttttctcatgcctgaagggtagcaaagggggttggggagagctgcccagcactgtgtcagtggcaaggagtggatttaggagtaggaaaaagggagaaaaccatgaatgagtggagggttcggaagtggcagggcgtggtggaggcacactggggagtaggcagggacccaactgtatgacagaaaattgggcaggtgtaatcagcctacaccttccacctcatctcaaagacctcacagcatagggggaggagtgggcgaccatgaagagaagttatgatctcgtcctctggaagccatgggcaggaaggttacaagcacgtatttgggcctcacctgcagcagcaagaacagagcaggtgaacaggcacgttccatgctgagtgggaaagggaaacacactgaaggcttgaagttttccgagacaaagcaaagccaactgcggaaacctttaagaattagggaaaggatgctcccccctcccaagaactttctgtcttaaaacacaaaacaacagaaataacagaacacaacacaagaaccacgtgctaaaaggagaagggggaagctgtggcggaggagctaagtccaggatgatgacccgggtgctgaacaccacgggaaaagatcaaggtttcttgtgcaatccttccctgcatttgcgtcagccagcacaaggccatcttgaattggcagcggtcaattcaagaagcttatgtgaaaggcagcattacttaagacaaaatgactttctatcctacttctggagaaatatctagaagccagggcttcaatgtaaagcaaatctataaaattcacaatgatatgtatgttctcctggcaaaatgtggaaggagggtgttgctactttcgtgttttgaatctcattattgcgagggcagcaggagtgtcaggagagcccgtagctctaaactctcaggactttaaaattcctatgctatgttataaaataatccctgtaacagaatagttatataaactcccagttctaataatactattttattggggaaacaaggtgtttgtctaaagagctaatttttgaaaattaaaggaacaaagagcttagtcatttgtgtgaaaaatatgtatatgccttcaccaagttcctgtagatcactgtggttatgtgtccaaaaggttccagcagaaggccccagaaaatgttgggcagcaccaagtccagaataggaatgaaaacagaatatttattttactcagattaaaaacaagccccaaacaggacgggcatggtggctcacgcctgtaatctcagcactttgggaggctgaggtaggtggatcacctgaggtcaggagttcgagaccagcctggccaacatagtgaagccccatctccaaacatacaaaaattagccgggcaaggtggcatgtgcctgtaatcccagctacttggaaggctgaggcaggagaattgtttgagcctgggaggtggaggttgcagtgagctgagatcgcgccactgcactccagcctgggtgacagagcgacactccatctccaaaacaacaacaacaaaaaacaagcaaacaaacaagcaaaactatcattcacacacaaacggaagagcttgcggaggcagctttggtgactgtctctggaaaggggtgatgatatcaggaactgttcagaaaaggccagtggaaaactttatgagggctaggtgtgaggaagcatcttttcggaacagtgcctttcacctcgactaggtaaaagctgagaaatagcatcatgtgagtctataaaaaccataaacagtaggcatagaatcagcatgggtttgcttatgaaataaggatgaaagagtactctgaaacttttttgaaataagcttagaatacatttttaaaggactatttcatggagcaagcaaaaaaagtatctttcttttctttttttaaataattttattttctttctatttttaaaaatcttatagccttcagtttcatctccaaaaaaaattttttttttttttgagacagggtctcactctgtcacccaggctgtagtgcagtggcataatctcgactcactaaaacctctgcctttcaggctcaagcgatcatcccacctcagcctccggagtagctgggactataggtacgtgccaccaggcctggttaattttttctattaaaaaaaaatcttggccaggcgtggtggctcacacctgtaatcccagcactttgggaagctgaggctggtggatcatgaggtcaggagtttgagaccagcctggccaagatggtgaaaccccatctctactaaaaatacgaaaaaaaaattagccaagcatagtggcgggcgcctgtaatcccagctactcgggaggctgaggcaggagaatctcttgaacctgggaggcggaggttgcagtgagtggacatcacaccacttgcactccagcctaggtgacagagtgtgagactctgcctcaaaaaaaaaaaaaaaaaaaagtctttaccggcagcctgaggtgagaggatcacttgaaggccaggaagtggagaccagcctgggcaacatggtgagattccattacccaacccccacctcctctacaatttttttttttttttaatgctgggcatattagcccatctacttgggagactgaggcagaaggatcactgaggaacactgaagcccaagagtttgaggttacagtaaactatgattgtgccactgcactccagcctggacacatatatgcataacagagccaaaagtggctactaagcaaaatttatcaaacttttagggatggctgagcgcagtggctcatgcctgtaatcccagcactttgggaggccaaggcgggtggataacctgaggttgggagttcaagaccagcctgaccaacatggagaaaccccgtctctactaaaaatacaaaattagccaggcatggtgactcatgcctgtaatcctagctactcgggaggctcaggcagaacaattgcttgaacctgggaggtagaggttgtgttgagccgagatgcaccattgcactccagcctgggcaacaaaagcgaaactccatctcaaaaaaaaaatgtatatatatatatataaaacattagctagaacaactatgccctctaacaaagaactgttgttggtgacagaaatagcatgttaggttagattctaagtgacaacaccttcattcctacaagagataatattcacatgaacatttttggaaaccattaactggtattatcactaaaaattttataatttatcacaaaatattaggtgctatgttgttcatgtaacattgaattaaccaaagaatgacattaactaccttcagatttaaacaaatgttttggagaacaattctttgtacaagcagaaagatttaaagataaagcctacgatggaaatctttctatacagatgaaggaagccttttaaaattaaaggaggctgggcgcggtggctcacgcctgtaacccaacattttgggaggccaaggggggcagatcacctgaggttaagagttcaagaccagtctgtccaacatggcaaaaccctgtttctactaaaaatacagaaattagctgggcatggtggtgggcgcctgtatacttgatcttagccaaaggccgagaagcaataagggcgcctgtaatctctgctactcgggaggctgaggcaggagaatcgtttgaacccgggaggtgggggttgcagtgagccgagatcacaccactgtactccagcctgggcaacagagtgagactctgtctcaaaaaaaaaaaaaaaaaaaaaaaaaaaagtcaaaggaattgaaaatatgcttttatgctttaaaatatgtagattatataagtcaaaaaataaatatgtgtgactactatatgatcccaaacagaaaaatcagaatatccatagtattataaaataagccaaaagaaagagatatttacatctagcaatagacagtatataacttagagtcaagaaatgttgggccaggcgcggtggctcacgcctgtaatcccagcactttgggaggctgaggtgggtggatcacctgaggtcaggagttcaagaccaacctggctggccaacatggcgaaaccctgtctctactaaaaatacaaaaattagccaggtgtggtggcacacaccggtaatcccagctactcaggaggctgaggcaggagaatcgcttgaaccagggaggcagaggttgcagtgagctgagaccgtgccactgtactctagcctgggggacagagcaagactctctatcaaaaaaaaaaaagaaaaagaaagaagaaaagaaatgttgttagcacttaaatccccataaatatttatggcttttcgaaaatatctttatggtcataagtaggtttgatagcatttcaatagtaaatttccttgtatttttttcttagaaatggggaagattgaagcaaaaaatggaacagttaaggctatttatgaagtaagaaatggttcccctgctactcttgtgaagtttccaggtaccaaaagcaaacttcctcctaacgactcagggttccaatcttttctcccttaaaaatacaagatccagaagaggagccctgtcagatttccattcaacaaaaccgctgggcttaccaaccttacactggaaacaacaagctcaaaagtggactctgaaacttgctttttaaaaaaagcgtttcaagcgataagtgtaacgtgctacagcaagtttagacatctgcaggtctgatgcagtcatctcctgagggtttacccaacagacacacacagggccaggcaccttttcttctttagcagcagaagaaaaatgtgctctttattgccaaaaataaacactttttaaaagacgacttctgttcctcaataaatatcccttcctttctatagtggatctctggttttctccaggctgcctaattaactgctttgggtgtgttcctaactggagacagtgctgaggggtcagggccacagccttcattaaggagaaatgaaatactcctcctgtgtacgtaggaggtgcccttggtcccgccggccgctgccaccaccaccaaactaaatgatcaggctcttggtggtgaaggggttcataaatgctgggtagagaaaggaatattaggtttattggcagggaggggacagccagggtctaatgctattctcagaaggttactctcaaattagggacacctgggaatttgaagtgttagtggccctggggaaaggactggaaggatttataagccccttgaatgaacgccgtggcactcaatcttaacaccagaaatctaaggtacaactgaaaattactccttttggacagaaaggaacagaagggagaattggttttattttttcgggttgtttgttttttgtttttttttgagacggagtctcgctctgtcgcccaggctggagtgcagtggcgcaatctcggctcactgccagatctgcctcctgggttcatgccattctcctgcctcagcctcccaagtagctgggactacaggcggccgtcaccacgcccagctaattttttgtatttttagtagagacggggtttcaccgtgttagccaggatggtctccatctcctgacctcgtgatccgcccgtctcagcctcccaaagtgctgggattacaggggtgagccaccgtggctggccgagaattgttaaagaaggtactggactatactttctcagctctctcctacctccccgaccctaacccccatgggtatccagtttctacttgctgctcttcaaatgctgaaagcccaaccacagcaatcagatctactcagatcttccccctcttataacatccatcctccaaaaccatatattcctcttttctcccccatgtaaaccctgtgttaaattaatatttagggagcaggtaagagaaaaagaagcatatccatactaaagtgtaaatgactaatagggatgcttggaaagccctctcttacaaagggttgctcagttttaaacagttgcttattggccaaataaatacattttctattatttcctcaaataagggcgcattttattctttctcactgggcgagggacgtatatggcttagaaacagcaacagtaggccaggcacggtggcctgtaattccagcactttgggaggccaaggcaggtggatcacctgaggtcgggagtttgagaccaggttggccaacatggtgaaagcccgtctctactaaaagtacaaaaattagctgggtgtggtgacacattgtaatcccagctactcgggaggctgaggcaggagaatcgcttgaacctgggaggcagaggttgcagtgagtcgagatcacaccactgcactccagcctgggcgacagagtgaagactccatctcaaaaaaaaaaaaaaagaaagaaagaaacaacaacagtattttaagcagaaaagagtaaatagtacagtatcaagaactactggtgttgcatttgaagggaagcttttagtatgttggtgaaggggaagaggtgagggaaagtttgagcttggaaggttttagttccttgagcttcattttctcttccttatttttatgctgattgggtctctttttccttgtcaacagactgcttcagtacttcttggctttatttatttattttgctcctgctaacaagctggaggctgagttatgtgctcagtctgaaaatgttccttttgactgttgtctctgaactttctaaccaatacagagagtaaataggtactgtgctgtatgcaaatgtaggcatatttgtccgtgtaggccaaaggaggggaggcatgttgcaaaatgcctttagaacaaaaacaaacgtttccaatagagtattttatagccttttgaaaataagctaaacttttagaaaacgaaaagtacagaggaagacttatctataaaataaattggaaaaaaccacacacaaaacaaaacatgactaatacttcgacagtgagttcacctcaagcatttcatgaatttcacatgacccacccactttttctctgtacctctgaggattaccatattagcagcaataattactcttttgttcaagtgccagatttacatatcaacgtagccatggcattcctgaatgtagaatattgtactgttcgcctcgtttgtggtttctataataaggttaatttttgttcccttaccctcctcacttaatctcatgccaccccctacctttcttcaattagtggtttgttttttactttgaatagtttttctcctttcctttctcagtctctgtgtcatgatttgaactatcctcaaattcactgtacgaaccatgctgcatttaaaactttttatcacccagccatggatgatcaattctttgaaaagacaagccaaagacagagaagttatgaatgggcatttctaggatgactctagaataccttcttccccaagtttaggatgtgtggtaagatgcgtcagaagttaccatggtagatttcatggccatctttgtcttttttttttttttgagatggagtctcgctctgtcacccaggctggagtgcagtagtgcaatctcggctcactgcaagctctgcctcctgggttcacgccattctcctgcctcagcctcccgagtagctgggactacaggggactgccaccatgcctggctaattttttgtatttttagtagagatggggttcaccgtgttagccaggatggtctcgatctcctgacctcgtgatctgcctgcctcagcctcccaaagtgctgggattacaggcgtgagccaccacacccggcccatctttgtcttttccttggtaggcctttaaaaaaaattattgctatttctagattttattggagatggatctagcaaaaatttccagaattgcatcagacatttttaatttccaatggatgtttggaaagggttggacagttttaaaatttttcagactcaaacatgtcaaactggccaggtgcagtggctcacacctgtaatcccaacactttgggaggccaaggtgggccgatcacctgaggtcaggagattgagaccatcctggccaacatggtgaaaccctgtccctactaaaaatacaaaaattagctgggcatgctggcacatgcctataatcccagctacttgggagtctgaggtaggaggattgcttgaacccgggaggcagaggttgcagtgagctgagatcatgccactgcactccatcctggcaacagagctagactccacctcaaaaaagaaaaaaaaaagtgtcaaactaaatggaaagccagcttgggcctaacaagctattttaatgagcattctttctctgtgatgttccccaggggatatgagcccaagaagacccatgtggcccagggagtaacatgatcatcttggctctgtttagacacctgtgcccagcggtaaggggaccaggaggcagacagatagatgagggcatggaggcatgcagacccattaggagtgggtgtgcaccatgctacttagaaagttactacaagaaactccatagcagtgacagaggcttgatgcaacataggccaacagtgcctctatgtggggtgtctgagagtatatgaaatgtgtttgtgactgttggggagggagtgaagagaggagaaatgtatgtgttttttaaaggaattgcatgccttggaggttccttttgagaagatgatataggaaaaaaagattgagaaccgtagatatagaacacatccaggatgctgagagcacattcttcccctaaccatttaaaaaacactttgctgtgtttgctcttctaatcagtctgatgcgcagctttccctgcccaccataagttttacatcctcttaccttcaacttatcaccacatagatattaaacttgatctgtattattttttaccagatgctttgtttagtgaatggtctaagttttctgtatgtcacctcctggattataaagtccttgaggatttacactgtaattttagaagttaatacacctactaggtgcagtggctcatgcctgtaattccagcactttgggaggccgaggcgggcggatcacgaggtcaggagatagagaccatcctagataacacggtgaaacccagtctgtactaaaaatacaaaaattagctgggcgtggtggtgggcgcctgtagtcccagctactcgggaggctgaggcaggagaatggcatgaacctgggaggcagaggctgtaatgagccgagattgcaccactgcactccagcctgggtgacagagcgaaactctgtctcaaaaaaaaaaaaaaaagttgcatgggacacactttcctaaaagagtatttgcggtttatctgaaattcgaatgtaattgagtattctgtgtctatattgctaaatctgagaactctacctcagttggattttgcaagggttgagaaagcactttgtgagtctttgaaaaggtgtgagccaaagggctcttcaggagcagcattgacaaatatgcaatctttgtcaagttctcaaaggcccgaggtaggccaaaacaaaaacaacagtaaaaacaagctcactgactttattaaatgaggacacagccagttatttttaaaataactttattgagatataatccactcatttaaagtggtttaactacagttaaactacaatttagtggtttttaatatattcacaggatgtgcaaccatcaccaaaatcaattttagataattttcttttcttctttttttttttttttttttttgagtcggagtttcgctcttgttgctcaggctggagtgcaatggcacggtctcaactcactgcaacctccgcctcctgggtttaagccattctcctgcctcagcctcccacgtagctgggattacaggtatgctctcccaggcctggccaactttgtatttttagtagagatgggtttctccatgttggtcaggctggtctcgaactcctgacctcaggtgatcagcccacctcggcctcccaaagtgctgggattacaggcgtgagccaccatgcccggctgaattttagatcattttcatcacctcaaaaagaaacccagtactcattaaccgtcactctcctttccaggatccctccatccctgccattcttcaaccctagcccttggcaaccactaatggattttttggtctatttagatgtgcctgttccagacacttcattataaatggaatcatacaatatgtggcctattgtgtctggcttttttcacttcacataaagttttcaaggttcagacatattgaagtgtgtatatcccttcattttttttcattgctgaataatatttctttcctttttttttgagacagagtcttgctctgttgcccaggctggagtgccgtgatcacagctcacttcagcctccaactccagggctcaaacgatcctcccacctgggcctcccgagtggctaggactacaagcaccaccaccacacccaagtaatttttaaattttttgtaacacacccaactaatttttaattttttttgtagagactgcatcttactatatgggtcttcttccttcttctttcttcttccttcttctccttcttcttccttcatcgttcttcttccttctttcattcttcttcttcttttttttttttttaaatacagtgtctggctctgtcgcccaggctggagtgcagtggtacaatcttggcttattgcagcctctgcctcccaggcccaagtgatcctctcatgtcagcctccccagtaactgggattacaggcatgtgccaccacactcgactaatttttgtatttttttgtagagacaggttttgctatgttgcccaggctggtctcgaactcttgggctaaagcaatcctcccgcctcggcctcccaacgtgctgggattacaggcgtgacccaccacccctggccagtatttcttaatttgtatagtccacactggtttatccattcatccagtaaaggacatttgcgttgtttccactttttgactattatgaataatgctgctaggaaagaacatttatatacaagtttttgtgtagtcactcgttttaatttctcttgggtatgggagtggccaatattctgaagaactgccaaatttcttcccaaagtagctgcactattttacatacttagtttttgtttttcgtttttttttaaataaagaacctttagggtttcctcagcgtcccagaggagggcctgcttccggcaccccgccttcagggctgcctccgcagagcaccaaactcccgtccccgccattccaggccctggcacttaggagccaaaacctcaggtcaggcgcactttgggcctccagcccagccccgcctcctcagcgctagctagtaggcaaaaggaaaacagctgccccttaatgaggctatgtggacatcgtagttttttttccagtcagtagcgcagagactgtgataagaaaaatcacaattcccagaatgccgcggtgctacggcagccgaaggggccattccgtgtgcagcgctcccgcccaccctccggtctcggcggctctccagagcgtctgtaaacacccagagactgtcatggagggggaggaggaggcggcggcggcgaagggaggcgtttggggccgcctccagggtccgctctgccattcctgaactggtccctcgtccccgtgactctggcatcagggaagcgaactgttaggcgagaggaggaggcagccagaaccatatccccttcttcctcggggcgggggccgggccaggccggctgagccgggggagggctccgggagggagtgcctggccaggccggcctgtctgccgcgatggatgacagtaaggtaagtcttgtggtttgcacgcgccgccgccttcttgtcgctcaatgctagtcccgcggctgaacctccgctatgtagtccacgccaacacccaagagacacctgcctaaaacatccctgcgcctctccagtccactgcccgatggtacccagccaggaaatcagggaacaccggggctgcgtttttccaggaagggccctctctggaaatttttcactcccagggcgtttgctagctttccaggtagtgcaacccctagtccttaacttgcctgtcgagataagaaactactgtactttttcttcttgcacttttttgctgcctcctctctccagtttggagactttagtgcacgctgaaccagccttattccccttgacgattccccttctctcaggctcccttactcaatgccccattcatataatcagttcactccccctctgagctatttcctgtggttggttggaacaccgctaagctcctgttgctatttggccagtgtggagtttaacctccactagaaagccttctctaaaaaaatactgattttcctcttgttaactttaatagcccatcaccatccaatttccctgtccaaatcacttactttatgattataaaataatagataatgttcattattggttaatccaaatagtttatctatgtatagcctttttgtctttatttattaattgagacggagtttcgctcttgtcgcccaggctggagtgcaatggcgcgatctcggctcaccacaacctccgcctcccgggttcaagcgattctcctgcctcagcctcccgagcagctgggattacaggcatgcaccaccatgcccggctaattttgtatttttggtagagatggggtttctccatgttggtcaggctggtctcgaactcccaatcttaggtgtccgctcgcctcggcctcccaaagtgctgggattacaggcgtgagccaccgcgcctggccgcctttctctctttacatctacccacattagtgttgtttagttttatttcctgaagatagggatggtcaaagatttgtttattgatgtttcaggttgttttggatttggacttttttattttaaggaatcagacttctaaaatttgccagtttttaaagtaaaaaccgtccttctttgtgcttctcagcgtcttctgtttcacagtctttggcatactctttacgatagctttgtcctttgtttgggtgtctttttttgctgctgctgcagtttttgtttcacatatcctcagagagattcaaaaaatttccaacttctctgtgttccttgttttattctttccttcttgttttctcttcctcttcatgtagaaggctgtgaggaagtgacagatggaagggaaagcccagtgcagtactctggaattgttactcacctagaggaacggattgcttgtgaagtagtaaacccctcttaataggaagtggtatttccaagacagaaggggggcgagtttcaggaagctatcagctcataagagtgcttaatatgctcagtacacacattaattcccttgacaagaatcttgcccttgtttgtttacaacaatgcaacagaatgcgggataacattgtagactcttcagttttactatagtaacattcgtggggtatgatattggggaagtggtatttccaagacagaagggtagcgttctaaaagttttccagaaaaatcagcaagtaatttttttttttttttgctttgaatatttctttggggaggggacatcacacttctttcttttttcttttttttcttttttttttttttttttttgagacggagtctccgctgtatcgcccaggctggagtacagtggcacgatctcggctcactgccgagaattgctcttgggttcaagcaattctcctgcctcagcctcctgagtagctgggactacaggcgtgtgccaccacatccagctaaatttttatttttcgtagagacagggtttcaccatgttgatcaggctggtctcaaactcgagtgacctcaggtgatccgcccacctcagcctcccaaagtgctaggaatacaggtgtgagccactgcgcccggccaggacatcacacttctactcaatgaagataaacgtttttacaccttttgtcttttttacccctattatgccacgaattcatagggaataagttctagtagctcaggctgttttccactggtggagtaggctggtgcttcaattgaacccaggtacctttcttatttagtttccttttttttttttttttttgaaatagggtcttgcactgttgcccaggctggggtgcgttggtgtgatcacaactcactgcagcctcgaactcctgggctcaaagcaatcctccacctcagcctcccaagtggctgggactacaggaatgcacatccattcctagctaattttttgcagagatgagggtctcactggcttttttttctgatcattttccttcacacgtttctggaagctgtcagctcttaagagtacttaatatgctcaatatacacattaattctcttggcaagaatctttcccttttttgtttacaacaatgccaacagaatgctgggtaacattgtagactcttccagttttgccatagtaagatttgtagggcattagttttttttttttttttttgagatggagtctctctctgtcccccaggctggagtgcagtggcacgatctcagctcactgcaatctctacctcctggatttaagcgattctccagccccagtctcccgagtaggtgtgattacaggcatgggccaccatgtccggctaatttttttttgagacagggtcttgctcagtcgcccaggcttgatgcagtggtgcagtcttggctcactataaactccgcctcccgggttcaagtgattctcctgcgtcagcctcctgagtagctgggattacaggtgcatgccaccacaaccgattaatttttgtatttttcttagagatagggtttattagagcctgccatgttggccaggctgacagggttttgccatgttggccaggctggtctcgaactcctggcctcaagtgatccgcccacctcggcctcccagagtgctgagattacaggcatgagcactgcacctggccaactttttgcatttttttttttttttaacagagacagggtttcatcatgttggccaggctggtctggaactcctgacctcaggtgatctgtgtaaggtattcccttttaaacagtccccattccattgatgtctaaaatatcaaccttctttttttttttttctttgagacggagtcttgctctgtcaccaggttgtagtgcaatggtgcgatcttggctcactgcaacctctgactccctggttcaagcaattctcctgtctcagcctctgagtggggattacaggtgtgtgccaccatgcccagctaatttttgtatttttagtagagctggggcttcactaggttggccaggatggtctcagtctcctgacctcctgatccgcccacctcggcctcccaaagtgctgggattacaggcatgagccaccgcacctggctacaatatcacctttcttgtaggtttccatgtatgtggccgaaggaacaactccatgtgttctaaaaggcctggagaacatctgttggtgccttttctctttgcctttgtgttaatcattttggtgaattactggaagatggcagttccagccaaaaggcagaaataatatttcataaaagtctttggtagcttgatctttcagtgttaattttgaaattaaatattaacactgtatctattatcttgatgagaaaataatactaatgttatgggtatttaaggatggtagaagaacatactgttctttatttttcctaacttgagattcagaatatattctttctgattttcagttttttccttttcagacctttgaaacatttaacaactttctgaaagtcttcaataatttcaaataagtcgaagaaaaatacataggattttgggctacttagctgtaagatcatataaaagttatttctaaaactagcaatctggtggggtgaaggaaggttcaaaatgtcattgtttagcctgaaagagtgaagttaaaatttgagggcaagctatccgtgaattacttcctaaaggatacacaggtaagcacagtgaatttgattctcactctttattaattcattgtttttataagtacttagaaaccagcagctttgaaaaccttagtgagcatcaaaaagaaaattcatttaaatgtctctggatggagagtgcctctggaatactctacttgcactttgaatgcatgttgtagttgtagataagtaatatttacatgtcatgtataatactggactctccttcaacagtcaggcagtgtgaaactgtccttatataaggctttggcagctcccagccctgcgttttctgtgccctagttataatcccacaaaattgtactgtcctcctagtatatacagacatacacacaaaacacacttttccctcacattctgtatgagtcacactctctcgtcccattttcttcagtgtaagggaagatgaggattggggtttggaagtatggtggctgtgcccttgagagcataaaggatgataaactggctgacagcaagaccagggcaacaggaagaagacagagtaggcaggaacagcagttatagagaggtagtatttgagtgagtaggtcaggaaacatgatgatgataatgtgagggcctccctttataaagattttgtattctgagttgtttttaccagtggtgataaatgagtttgctgcgagttctccacactctgccatctagctggctggagtgagagcaggacagatttgaatggggaatagctttgcctcccaagtttctagcagtgtgcctaatacagcataaagtactcatttatagagattgaattgaattgaatcagggtgacattaaggagattgccctgatgtactcgggctttattaatcagtgtgctccagctgagcaaaccagccagcacatacttacaatggcaaatgagagaaataaagcaagagacagatttggcatctctaaagtgggggtttaggaaagtgttaagtagcagagctcaaatactgagtagatctcctactaggctagttgggaaggaaaaaatcttggctaatttatttaacttttttgagcttccatttccttatctgttaaatgtggccaataggtgaggccttggtgaagattagggttgatacatttaaagctctagtacagactctaacacatagtaggctctcaaaacacgttatcattattatattacctaacagtgattccttgtgctttactacggtgcagtaggtccctgagatgctcattttagtaattcttttttttttttttttttttttttttttttttttttttagtatttattgatcattcttgggtgtttctcagagagggggatttggcagggtcacaggacaatagtggagggaaggtcagcagataaacatgtgaacaagggtctctggtttttctaggcagaggaccctgcggccttccgctgtgtttgtgtccctgggtacttgagattagggaatggtgatgactcttaacgagcatgctgccttcaagcatctgtttaacaaagcacatcttgcactgcccttaatccatttaaccctgagtggacacagcacatgtttcagagagcacggggttgggggtaaggttacagattaacagcatcccaaggcagaagaattcttcttagtacagaacaaaatggagtctcctatgtctacttcgttctacacagacacagtaacaatctgatctctttcttttccccacatttcccccttttctattcgacaaaactgccatcgtcatcatggcccattctcaatgagctgttgggtacacctcccagacggggcggctgccgggcggagacgctcctcacttcccagacggggcggctgccgggcggagacgctcctcacttcccagacggggcggctgccgggcggaggggctcctcacttctcagacggggcagccgggcagagatgctccttacctcctagacggggtggcggtggggcagagacactcctcagatcccagatggggtcatggtggggcagaggtgctcctcacatcccagatggggtggcggggcagaggcgctccccacatctcagacgttgggcggccgggcagagacgctcctcacttcctagacgggatggcggccgggaagaggcgctcctcacttcccagactgggcggccgggcagaggggctcctcacatcccagacgatgggcagccaggcagagacgctcctcacttcccaggcggggtggcggccgggcagaggctgcagtctcggcactttgggaggccaaggcaggcggctgggaggtggaggttgtagcgagccgagatcgcgccactgcactccagcctgggcaacattgagcactgagtgagcgagactccacctgcaatcccggcacctcgggaggcccaggcgggcagatcactcgcggtcaggagctggagaccagcccggccagcccggccaacacagcgaaaccccgtctccaccaaaaaatacaaaaaccagtcaggcgtggcggcgcacacctgcaatcccaggcactcggcaggttgaggcaggagaatcaggcagggaggttgcagtgagccgagatggcggcagtacagtccagcctcagctgggcatcagagggagaccgtggaaagtgggagacgggagagggagagggagaggagggagagggagaggagggagaggagggagagggagagggatcattttagtaattcttaagtatatgctgttgtataagatttgtaacacctacactaccctttgctccagactatgctccagatgggacaggggcagtggggtgggacataaaatgaacttaagctctgtcattaagttagatagtgtgagaaaggtagtctcctgaggccacctccatgtttaccactaggaaaaagtgcttgtttttatgaaaatttcttcttggccaggtgtggtgtctcatgcctgtaatcccagcactttgagaggccaaggtgggtggattgagttcaggagttcaagatcagcatgcgcaacatggcgaaaccccatctcttcaaaaaatataaaaaattatccaggtgtggtggtatgcagctataatcccagctactcagaagggaggctgaggcacaagaattgcataagcccaggaggtggaggttgctgtgagccgagatcacgccactgcactccagcctgggcagtggagccagactctgtctcaaaggaaaaaggaaagtttcttctcccttgacctgctgcattcaattagaaaatagaaatgtgttattttcagaggctttgatcatagatagaaggttcttattttttattttatgttggactttattgaatgaacacatgaatgaattgaaatatcctaaggcgtcaagatccagttgagggactgatgcaggagtgggccaactactggctgcagcatgccaatgtgagctgccatttccctccacacttcttttctaccttgtgttctacgtgattatctggaaatgaggtttcttacactttccttacccttttaaccctctccctctgccaaagtcttctgattctttccagttctgagtagttctggttctcaaaaaaattttaatttggcaaaaaaatctctttgacattccctcatttatcttttggctccttaaccatcctctgctgcagttggagctaccttccttgggccgtgccttatagcccagacattttctgcttttcctgtcctcttactcacatcaacactttctagaagaccaagacaaaagagccatgttgtctattaaacaaatctctgacagtagacattaatgtgcttgctttcttttcttttctttttctttttttttttgagacggtctcactctgtcacccaggctgggcacaagtggtgcaatcatggttcactgcagcctccacctccctggctcaagcgatcctcccacttcagcctctggaatagctgggatcacaggcacctgccaccatgcctgactaatttaaaaatattttttgtagagacagcctgtgttgtccaggctggtttcagactcccaagctcaagcaatctgcccgcctctgcctcccaaagtgctgagattacggacatgagccaccatgcccggccgccttcctttcttgtctaggttacatgcacatttcaacttgagtacctctacagataattcagaaaccaaggagtaatttaaataccacagaaaccagttgaaatctaagtttaaataaccttaatctaagtttaatctaagtttaaataaccttattcagaatgttttgtcctcttaagattttcagaaaagtttatttattaattcattcaacatttgttggacacctgatatgtacgaggcattgtgctaggcattggagttgcaaagatgattaagagtttgtaactgttctcagggaacattttattgggtgaggcagacaaatagaaaagtaattacaatacagtgaggtagaaaatgagggcaatagaggcaaagttcttttggggcagtaagagtgggtgcttaactgtcgaggaacgtcagacatgggtttacagagtaggaatgaatctttaaagaactggagtcccctccaaaacaggaaagatggaatatcctgttgtaaagcatcttgcacagtaaagtaagtattttggtacagctagagaaggatcgacagactttctgtaaagggccatgcacaccatatggtctctgttggaattattccactctgccattgtatcatgaaagcaaccataagcagaatataatgaatgggcatggctgtgttccagtaaaactgtattttcaaaaactgggccaggcacagtggctcacgcctgtaatcccagaactttgggaagccaaggcgggcagatcacctgaggtcaggagttcgagaccagcctgactaacatagagaaaccccatctctactaaaaatacaaaattagctgggcatggtggtgcatgcctgtaatcccagctactcgggaggctgaggcaggagaattgcttgaacctgggaggcagaggctgtggtgagctgagatcacaccattgcactccagcctgggcaacaagagcaaaactccgtctcaaaccaaaaaaaaaaaaaaaaaaaaactggcagcaggctatatttgagttgccagcagggcggtgatatattaaccctgagctacagcgtaaagcagaagtagaggtgtggtcagagatgaggatgaaagataagcagggaccaaattacaatatacctggtaaacaaggctgacaaatttgggtcagtatctttcagagtggaagagacctggtgaatcagattctttcgggatagggtctgggaatttaaattttaataggcttcccagttgagtggctcttatgtgtaatgaggtttgaaaaccaaggccataaatgttggggagccattgaagggttttaaagcagaagtgacaaaatctgatttgtgtttttgaagaaaaatgccaatggctatatggagaacagattagggtgaaaatgtaggaactgggacaagaccagaggcagacggtccgattatgaaagaacatgggttttagcatatgactggagttcaaatctcattttcaccctttcaaactgttgtgattttggacagattatttaatctcttcagatattactttcttcagatacggattgggtgtgttaataaggaccttattgagttattgtgagaattaaatgtaatatatgtgtgatcccataccaaaataacttaatacatactgagttcaataaatcctggtcttttttgaattctcactggcatggttagattgcacagaagaaaggcctggactgaagaccatattagagactttacaatgtaagttgcagttgatgcggcgtgcataaaattctgaaaagataaagagtgaagagaatagagagctaaagagaaccctggaaaactctaaagtgatcagaagattcttgaagaataggactcagcaaaataaactgaaaagagaggtcagtgacgtaagagaaccagaagacagggctgttatgccatctaagagtggagagacttttaaaaagaggacttaccagttgtgggggatgagggaggggataggggttgagagaggagaggcagaagttaactctcaggctagagatgcctacttgatctttctcctgtcgactagaaaaactggcagaaaggttagcagcaggaagatgtgagtagactttgctgctttctgtagatctggcaaatataaaaagagaagaagcctaacccacagctgtgaaggaagttatgggagccttaacatcaaatgaaaacgccactgcttgttttttttctttaaagtggtaaagagcagtggctagccacattcatatttatcttaatttttctttaatccgtgggagataacttttctctttatgtttttaagagaaagacaaaacaagccctcctgttttcctttttggctgaggctgctggtacttcttcatctaaatacagtagttctcttaactttaacaacttgaaacttttattagttgccttaattagagcatcaggatgtaaataagtgtaaaaagggtgataaaagaagagttcttaattgcttttcagattttacatccctgagagggagcatttctttgtaacaacttcttttttttttttttttttgtaacaacttctttaaagttgttggtgatagtagtatcagtttaaatcactttcaaaatattgctgatttttctttttcatttcattaaattatcaatcttttaataaatatctcttaaatgcctggctctgtgctggatactatggggttgcaaaagaagtagaaaacacagcttctgtgcttgaggagctcagactacttggggagatagaaaaatgtgtgagtccactaaaaaaaaaataaagcatataaattcagtgggatattaactctgtgttccagaactttgaagaaaaatgacttatggactgagggtggtggtcagtgagagcttcagagaaagagggctagagctgatcttaacaaaataaaacaagatttgcccttctggatggtgggaggatagagggaaaatagaaatgtaggtatagttagaaatgcaggggatggggttcaggctggtggtctctagggagactggcttgagttgatagagagggtgcctgctggggataatgaaagagagaactggctttttgtgggaatcctggatgcagtgggctgaatggtggcccctaaaaagatatgtccatgtctgaatccctggaacctgtggttatcaccttatatggtaaaacaatgaatattaccttgtatggcaaaagatgtgattaaggattttgagaagaggagcttatcctccattatgtggatgggccgtaaatccagtgacaagtgtccttataagactaaggtagagggagctttgatggacagatgaggaagcagcgtgaccactgaggcagattgcagtgatgtggctacaagtcaaggaatgctggcagccaccagaagctggagaggcaaagaatggattcttccccatgacctccagagggaatgcagctccaccagactgccccagtctggacttccagagccagagaataaatttttgttggtttaagccaccacatttgtggtaatttgttacagcagccccaagaaatgagtatactggatatggtgacttagtaagtagtgctgagccagaggtcttttcttgaactcgagggtgacatggccaggggccattagagaaaatttattatttctataatgatcaggtattacttttttacagggaagaaaaacaccctaaagttattaaaagaaaggttaatctggcagctctttgcaaaatgaattgactagggaagtggggtggaaacggagagatggtggggagatgcactgggaacctattgtaacaacctgtgagtagtgccctgactggtattagggagtcagtgaagcaggatatttccctgaccctttcacgggactcacaacgggtgcctcatatactcagcccaccactctcaactccttgcaggagggagcatgtgagcaaatgagtgagggaactggagtgaatgagcacgggaatcggccagctgctttggtgctagcaggagtgaactttatgcaggcccaatggcagcatccaggtaggggtgcctgagacttccgaagccccagagggagtgttacagtgctctttgagctctgccatccgtggatagctcaactgttaatagctcagtggactctttgccttttcttgtgaggcaactgccttccaccagcaaggacaaagggccagtgtgacagccttttgtatctgcacttgtggctcccaagctcttatccagcgtccaggtaaaatgaggtcacacaaatgaattgaaggatggtgaatgcaggggattttattgctgatgaaagtagttctcagcaggagggggaactgaaaaggggatgggactggtaggtaatcttcccttgaagtccagctgtctccagccagactcttctctgaagttatgccgtcaagccattcctctgaagtcaagccacttctctctgacatctagccgtagtctcgtctaccagtctcgtctgggggttttataggcacaggatggggtggggcagggccatgggtgatttaggaaaaggcaacattcgagtgggaaaacagggatgtaagttctcattttgggccgtcatttcaggcttttcggcttgaggatggggttttgtcggggacccacccttttctgtctagaattttctgtcccctgtccctctcagtaggaatggagaagaagagagaaatcagaggtttataaaggaatacattggcatcactttagtgggtgagcatggagaatcacaatagcagagggaaacttcaatgaggtgtaacatgaaaaagtttgttagttaacctcctcagcacaccccttaactgagtgcctaatatcaaagtgagttacattaaatgaatgactgtatagcataaatacagcagtgcatttaatgcacctgtcagtgttagagctttttcaggaaattatatgatcagattaatgtgtcctgtctgagatgtggatggtaataggcatgcttgattaccttctgacaggttgccatgatacaaatctagggacttgggttctagtccttgctctgatggaagtctctggactaaaatcttgtcatctatgaaatgaagagatcacatatccttatctgtgtctatgtatacacatccctccaccaccagcattcttgtctatattgatattctgctatctgcaatgttattgtttatttcatatctgcttcttttcactagtctaaatacattaagattaagtgtcctattgttttgtatttatccctagagttttacagtgtttgggacaaagtgggtatttaataaagggtcattgaataaaggaattaatgtgctcctctttacctgaaaaagatgaggataatagtgcttacctcatctgaggtaatgtgaaataacatgagatagcgtgtagagtgcctcactcaaggccttgttcataatgagcgctttctgaccacacaccctggtttagccccgaatttatgtttttattctgtttgtcctgaaaaatgggaggtaaatggtccaagaatctttggaataggattaaatgtgggtgctggaggcttcctcattttaagaagccccagttaactcctaaagagcatgcaactataattatatgttctctttctgtggaagttaaacttgttgactgtgaagcctaggccatccataatttcctcaggcctttgcagactgatttctgttttgtctttcgctgtaatggttaattatagaattatcagcaatccctcccttgattaaatccagttttatcttaattctcaaccttaaaactcatgagttagaaccttatgcttgacccctcccctccagaatactcattcttctcataagcttctgtatctgtgctaccttgattctttcctttcagctatttttgctttttcaggctcactaggcaaccatgtctttttaaaaaataatagctttattgaaaggtaattcacaaaccataaaattcacccttttaatttgttcatcctgtgattcttagtatattcacagaattgtgcaatgatcatcactatctaattccagaacagttctatcactccaagaagagactcttacaaacaaactgtggtacatccctctggcagaatactatttagcagtaaaaagaaacgagttgctaggtgtacctgtagttccagctacttgggagggtgaggcaggaggatagcttgagcccaagagtctgagaccagcctgggcaacatagcgaggccctgtttcttaaaaaaaaaaagaaaagaaaagaaagaaagaaaaataaataaacaagctatcaagccacgaaaagtcatggaggagccttaaatgcatattgctaagtgaaaggagccattttggagaaggcaaaactgtagagatagtaaaaagttcagtgattgtcagggtttcaggagagggaggaagagagggaggaatagatggagcacagggggtttttagggcagtgagacgattctgtatgatactgcttatcaaaattcatagaatataccacaccaagagtgaactctaatgtaaactgtggacttcagttactaataataaatcaatgttagttcatcaattataataaatgtaccacactaatgaaagatgttaataataagggaaactgtgagagtggagaggggatagtataggaactccctgtactttcttcttaattttcccgtaaacctaaacagctgtaaaaaaataaagtctattgatttaaaaaagaaaaaaagaaactctgaggccattaacaggcactccccattttttcttcccttctcagccctaagcaaccattaatctactttaagtctctatagatttggaataatacaatatgtggccttttgtatttgtctttcacttagcataatgctttcaaggctatcagtgttgtaccgtgtgtcagcacttcattccattttatagctgaataatgttccattgtatggatatactactttttgttatctattcatcagttgatggacatttgggttgtttctgctttttaggtatcatgagtaatggtgctgtgaacattgatatacaagttctaatgtggacctatgttttcctttctttttggaatatacctagggctggaattgctaggttataaactttatgtttaactttttgaggaactgccaaaatgttttccaaagtggctgcaccattttacattcccacagcaatgtatgaggatttcactttctccacatctgcaccagtacttgttactggttgtctttttttttgagacggagtctcactttgttgccaggatggagtggtgcaatctcggctcactgcaacctccaactcccgggttcaagcgattctcctgcctcagcctcccgagtagctgggcctacaggcgcgcgccaccatgcccagctaattgttttttatttttagtagagatggggtttcactatgttggccaggatggtcttgatctcttgacattatgatccgcccacctcagcctcccaaagtgctgggattacaggctaagccaccatgcctggcattggctatctttttgattatgtaaacatcctagtgggtgtaaagtgatatattttgtggttttcattcacatttccctgatgactaatgatgttgagtattttttcatttgcttattggcatttgtatatcttctttggaggaatgtctatccaaatccttgcccctttttaaaattgggttgtctttttattattgagttgtaagagttctttatgtattctagatacaagtcccttatcatatttgtgatttacaaatattttctcccattctgtgggttgtctttttaccttgattatccttgaaatacagtttggtagcttgtgcttatcatatctaagaaaccattgcctaatccaaggtcataaggagtaaatcctctgttttcctctaagttttatagttttatctctgacatttaggcctttgttctattttttttaaatttgagacagggtctcactctgtcatctaggccggactgcagtggcacaaacccagcttcactgcagtcttgacctcctgggctcaagagatcctctcgccccagcctcccaaagtgctgggattacagtgtgaaccactgcacccggcttgttcaatttttaatttttgtatatggtacgaggtagtgatccaacttaattattttgcaagtggctatccacctgtcccagcaccctttattgaagagactattctttccccatttaattgctttggcaccttgtcaaaaatcaattgaccataaacgtaaggatttatttctggattctctatgcttttccattggtctgtatgtctgtccttgtgccagtattacactgtcttgattactgtagctttctaataaattctgaaatcagaaagtgtgagccctccaatttgcgtctttttcaagattgttttggttattctgggtccctcgtatttccatgtgaactttaggattagcctgccaatttcagcaaaaaggtagctgagattttgataggaattttgttgaaactgtagatcaatttgaggagtattcctttcttaataataataaatcttccagcccactaacatgggctgcctttccatttatcagatcttctttaatttcttttaatgatattttgtggtttttagtgcacagatttgacactccttatgctaaatttattcctgagtattgtattcttttttaggctactgtaagtggagtcattttcttaatttcattttcagattgttcattgatagtgtgtagaaacacaactgatttttgtatattgatcttgtatcctggacccttgctctactcatttagtagctctaataggttttttcaggggggcaagaattcttttggattggattttctatatataaaatcatgtcaccttcaaggagatagctttactttttcctttcctttccctgaatgcttcctattttttcttggtagttcagtgttaaatagaagtgatgagagaagacaagattgttgccttattcatgatctttgggggaaagcattcagtattctaccattagtaagatgttagctgtgggttttttgtagatgtccattatcagattggggaagtttcctcctatttctaggttattgagtgtttttatcatgtgaagatgttgaatttctgtcaagtcctttttttgtgtgtgtgtgagatgaacatgcaagttttgtcctttttttcctgttgatacagtgtattatagtaattgatttctcagttgtcaaaccaacatttattcttgagataaatcccttttagtcatggtgtataatcttctttgttgctagattcagccttctagtattttattgaggattttttgcatataaattcacaagaccatattggtctgtagttttcttctgatatctttggttttggtttcaagtacatattggcctcgtggagtaagttgaaataagctttctcctattccactttttggaagagtttgtgaggttaattatttaaatatttggtagaattcattagtgaagtcatgtaaacctaggcttttctttgattactaatcgaataaaattttttattactgattgtgtcttgttattgctatagatctaattcagattttctatttcttcttgagtctgttttgctactttgtgtctttctaggaatttgtccatttcatctaggttatctagtttttttggcatgcaatttttcctagtattcctttgcatcccttttatttctgtagtgttagtaatggtgtctctttcggtcatgattttagtatttttgagttttttctttctctaatggtccgtctagctaaaggttggtgaattttgttgatccttttgaggaacaatcttttggtttcattgatttttctctgttgtatttccattctttattttattcatctctgcctactatttatcattacattctatctgtctgctttatgtttaatttgctcttcttttgctagtttcttaaggtggaagattagattactgatttgaaaccacctttcttctttaaaacaaacaaaaaggtgtgttccgctccctctgaggaatgctccagttgtaccccatgagttgtggtatgttgtattttctttttctttcatctcaaagtatttttctaatttcccttgtaatcacaattgccatctattttcctcaaagtatttttctaatttctctcataatcacaattttctttgacacattggttatttaagaatgtcttttgttttttaactgtcatttattaaatactgattaccaggtactaagaattatatgacacagttccaggtgcttactttgaaaaagtcatgacctttagtttagcttgtcttaaaagagaaagtgtttaaaacagggagttggaaaattgggacctttagtcttgcttgtaatcagtagactttaacacttttgacatataatgaagacagacttagtatttcagaaaccttactgatgtctaacatctttaatagcccacctttgtgaaagaagctctctgtgaagggtaagaaaaatcactggctagcgggtttcttttctaagtgattggaggtagggagacaggtctttattgtttcccttgggctcactgtccgcatctcacaaatgtgctctagggcagaaaaagacataaaatggatagtgggtaaagaggtatactgttttaaagccagctgtttaaattttcacatgactctatgtcagtagaaataaaattagaacaggaaaaaaagctagatgtgtggggttattttcatagttttctttggagtttatgtcggtacatgaaagtcagtaattttgtttacccatattaatatgcttcctcacagaagttatcaggaaagagcaagggaacaatgtggttatcattgagtttgtgaaaactatgaattgtgaagaatggtcttttggcccaggaattagtgggcttgatttcagttttagctgctggttcttggttcctaattaacgccccctatctgttcctcagtctttatggcttatgaaatatataaagtttagtagttaaggcaactggtactaacctacatttgtgtaatacttttttctcttttatttttttaatctcctcaaattccttttaccaaatactttttttctttataaagtagtctcatatacattgttatagctaagatttacaataatcctgtgttatacttactctcttagaactttaggcattagctgttacaaaaagccaaaacatttggtttattactgagaaaaagttaagctagagaagtggtgattatgtagttttaaatgtaactttataggaaatgacataaaatacagaaaccttggattcatatactatgcctttctttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagtcaggatggtctcgatctcctgacctcgtgatccgcccgcctcggcctcccaaagtgctgggattacaggcgtgagccaccgcgcccggccagcctttctaatttaaaaaaaaggaataacacagttccaattaaaatattttgctgccataaaaactaaacaaagggttatagcttttattttatatttttatgattgctaggtttgtttcaaaaatcagtgaagtccatgaagtacactgtgttctctttctggcgtctcaaaagcagctactcctgaattaattaaaaagagcaatatatgaggtattggattatagtgttgtatgattaatgactcattttactacatgaagaatagatgtcattatccatttatttcactacagacatgagttcttgatgtaatatataagcttttcaaaaagtgtattcaatagtaaatacactttgttttaactcaggttgatttcaaaatattttattaaaattatgtgattgatgagatataagcataattttaaatttaacccattttaatatctggatgaactaggtcatcctgcaattgctttcaaatatttggctctgaagaaagtttcattatttttatatatatatataaatttttttaatttttattttttattttttactttttgtttgagctggggtcttgctcttgtcatctagcctggagtgcagtggcccgatctggacccactgcaacctccacctcccacgttcaagcgattctcctgccttggcctcctcccaagtagctgggattacaggtgcccaccaccgtgcccggctaagttttgtatttttagtagagaaggggtttcaccatattggccaggctggtctcgaattcctgacctcaggtgatccacctgcctcagcctcccaaagtgttgggattacaggtgtgagccaccacacccagctagatgtatattgttataatgtaataaaaacatgacgattgggccaggcccggtggatcacctcaggtgggcacctgtaatcccagctacttgggaggctgaggcaggagaatcggttgaacctaggagcaggaggttgcagtgagctgagatcgcgccattgcattccagcctgggcgacaagagtaagactccatctcaaaacaaacaaacaaacaaaaaacatgacgatgatgcagaagagaaaagctttaaaagaccaggttttgaaaacttgaaactaacttggaagcagtactgaagaacctggctttaagacggtgatggaaaggacagattttttttccccagagccttggagtaatctgtgtcatttcagagccaccccacaaaaatgctagatacaatggttggccatcatgatgtgacagaagtttggtaaatgtggctgattcacatttaaagcttggttttcttgacctaactattagacttagtaatgatctcatctttttagggtacttagcattgtgaatgtgatactaatagtgatttcaaacaaatcagagtttttgtttccaaacagatattgaccctttgagttttgctatctgggaaggcacctacatttattctaatgatttgccagtgtttgaattttgcatcttctcttttagaattgcctttaaagccttagcaatattcctgtcaggacactaaagatataaaatgtttattcttcgagggcgattttcagaaagagctagacatcagtcattcagaaccatgtcagaaaaataaagtggataatcagattgggaatttaaagaatagtgtatagttctaacatattgtgttatgccttataaaacttataaaaacaggctccaatactacttttcagaaaatctttgaactgtggcattattggaataaatgtaccccctttcaaggtgactgcattaaagaacacttacttgatgtgtaagttcaggttcaagtgtttagtaattcatcatctttaccatatagttacatcttgcataaaaacttgggaaggtttcaaagctaaacaatgaagaagattaaattactttggcagtcacctaataattgtgcctaggcaggtaattgagtaacaggaatattgagaggttgctttatgacatcagtgggagcagggagaaatctactgagacagttgaggctttctgtttgttcctttgggctcaacaaatttgagggaatttatagccaaattccttaggatacatatttatgtgtgtatatatatacgattttatacacatattttatattttattatctaatttgaaaatcataaaaatataggtgaggaaaagctatttataattacacctatcagagaagtcttcactgaccttgttaacttcctttcttctatgtattgtcttataatgttgagatcataatgaacttacagttttgaatgttgagttctttaaatgtattttgttgcaattatttttctcaaggcaataaaaacttcttcatgagtccaggcacaatggctcacacctgtaatcccagcactttgagaggcggaggcaggaggatcgcttgaggccgggagtttgagaccagcctggtcaacatagcaagacaccatctctacaaagcgattttttttttttaattagccaggcatggtgatgctcacctgtagacccagctactagggaggctgaggcagaagatcacttgaactcaggaattcaagaccgcagtgagctatgatggtgccactgtgctccagcctgggtaacagagtaagcgagaacctgtctcaaaaaaagaaaaaaaagtggggcctggcaccatggcttactcctagcaccttgggaggccaaggcaaatggatcagttaagcctaggagttggagaccagcctgggcaacatggtgaaaccccatctctaaaaacaacaacaaaaatagaaaaattagccaggcatggtggctcatgcctatagttacagcgacacgggaggctgaagtggaaggatcacctgagccctggaggtcaaggctgcagttaaccatgattgtactactgaactctagcctgagtgacagagtgagaccctgtctggaaaaaaaaaaaaaaaaaattgtcatgaacaaaatatttagtagacatttttcttatctatctccatatggtttgtaaagtttactggtgagctaaataaataaataaataaagtttttattatctccatatggtttgtaaagtttactggtgagctatttaaactttattatcaaataaataataaaaatgtatattatttcttctttcacattcatggtttcaaaagtgtcagaaaataaattagggaaagacccagaaggcatttgatgggattatgctttcttagttccgtagggcttcactcacgttttgtttataaatgttctctttgctaatatgcagccatattcacttttctgtacacagaactaaggaaaaaattatttcttctctcgcttgctgaaggtggttggaggcaaagtaaagaagcccggtaaacgtggtcggaagccagccaaaattgacttgaaagcaaaacttgagaggagccggcagagtgcaagagaatgccgagcccgaaaaaagctgagatatcagtatttggaagagttggtatccagtcgagaaagagctatatgtgccctcagagaggaactggaaatggtaagaaatcgtcagtaaacacatgaaaaaatcaccttaacagtcaaataaataatacattaaaatacgaaaataccagttatcacctgtccagttggcaaacattggagagaatattaatctgttagccaggatgggggcaaataggcatcttcatacactgctggtgggagcagagtgtacgtgactgttaacactaagggattgtttatgagagaagaaaatggaaaataacccagatggacaataataaaggactggttaaataaatgttactacatccatgtattagactacttcgtagccagtaaaaatcacaatgcacatatatttactgatgtagaaagatacaatatattgctaagtagacaaagcaatataacaatatgtaactatgcatagcataccatttgtgtttaagtgactttatttatttatttttattttttattttttatttttttgagatagagtcttgctctgtcgcccaggctggagtgcagggcgcgatctcagctcattgcaagctctacctcccaggttcacgccattctcctgcctcagcctcctgagtagctgggactacaggtgcccatcaccatgcccggctaattttttttgtatttttagtagagatggggtttcactgcattagtcaggatggtctcaatctcctgacctcatggtccactcgccttggcctcccaaagtgctgggattacaggcatcagccactgcacccagccaagtgattttgtttattttacatgttttattcactcatccattcagcctttgggcagtggctgtaaaaatgtgaaagagagtagataaaacagaattgaaactccattattgtgagctgagggaggaagtgacagaagagagagatgatattactgtgatcattacacaactgggacaggcttctacaggtttttagaaagtaagacaacaaggttggaacatgaagaggagggacatgaacagtgttgtatatattgtccagatatatgctattcagtagatttttttgatatgttgaatgtgacatgctatcaattatttcttactttctgcagtgtaagccacttgagggcagaatctttggtcagctttgtctttgtatacccccaaagtccctagcatgcactctggtagatagtagatgtttaatgatcacttgttaaagagagaaaggaaattactaacatttatttctttattttgggagtagaaataatactgtgacaattattaaaaaaaaaaagattaattctaactagtggcacactgtggggagatgtccttttaaccacaggggccttttaaatctgagcaacactccagtacatcaaagacaattcagcagcagtttttccgcctcttctgaaagatggcagatctcgtacatgtcctcagttataaataggtaataccatggagggtgggattcccagcagcgaacgtgacctctagccatgggagttcctatgtctaggatttctaccagtggttcctgaactctgacaagtaaaagttaatttaaatatgttttaaatttatatttatatttaaaattaaatatgtttcagtacaagcagtggtgcatggcaatggaccaaggaaaaatcccttctgaaataaaggccctactcactggagaagagcagaacaaatctcagcagaactcaagcaggcataccaaggctgggaagacagatgctaatagcaattcctgtaagtgccatcaatgggagaatttatatttaagagagtgtctcggttgggcgcagtggctcatgactgtaatcctagcactttgggaggccgaggtgggcagatcgcttgagcccaggagttcaagaccagacagggcaacatggcaaaaccccatctctacaaaaaaatacaaaaattcgctgggcatgggggtgcatgcctgtaatcccagctatttgggagactgaggtgggaggatcacctgagcccagggatgttgaggctgcggtgagccatgatcatgaaaccctgtctcaaaaggggggaacaaaaagagggtatctcaaggtagggtatctcagggtagggtttctgttgaccacttttcttagtatgtctttaaataaaatgttgatgccatttttaatacactaataagcaaatgaaatggcattagattctggccaggtgtggtggcttatgcctgtagtcccagcactttgggaggctgaggtgggcagatcacttgaggccaggagtttgagatcaccctggccaacatggtgaaaccccatttctattaaaaatacaaaaattaggcgcagtggtgtgcgcctgtaatcccagctactcaggagtctgaagcacaagaattgctttaacctgggaaatggaggttgcagtgagctaagatcatgccattgcactccagcctgggcgacagagtgagacctcgtctcaaaaaaaaagaaaaagagaaatggcttagattctaaatattaaaatgcattttacatggagtctataaagagcaactgataaatttatcgaaattttattattaatagacttagtccataaatgggagtggcacgaatctagctttttgttaataataataccttttatttgtattttgatttacagtttacagagtactttcatttatatttatcttaaatattccctccattgattgtgttaaggaattatacttattttatagatgaaaaaatagcagaaaggctggctaaggtgcccaaggtcacacagctttaatggtagaacctgtcctcacctaatccaggctgtctagtgcagtagcccatcatcgtaaggattgtttttaattgaggtaaaattcacataacataaaaattgagagccatttagtacattcacaatgttgtgcaaccattatgtctacctagttatgaaacttttaatcacctcaaaagaaaatcctgaacccattaagcagttattccccattacccacttcccccaacccctggcaaccatgaatctactttctgtctctatggatttacctattctgtatattaatattttatatacctggagtctatacagtatgtgactttttgggtctggcttctgtcacctagtataatgttttcgaggttcatccacattgtagcatgtatcatcagtatttaattcctctttatggtcaaataatatttatatatatacagttgtttatcctttgatggacatatgtttttacctcttagatattgtgagtagtactgctgtgaacatgtgcatataggtatttgttttcatacctgttttgaattcatttgtatgtatacctaggagtcaaattgctgggtcatatgacaattctgtgtttaatttttgaggaatagtcaaactgttttccacagtacctgaaacattttacattcccaccagcaatgtatgtctgctccaatttgtccacatctcatcaacttattttccattttttaaaactatagccatcctaatgggtatggagtggtatctcattgtgtttggtttgcatttccctaatgcctaatgatgctgaacatattttctatgcttgttggccattcgtatgtattctttggggaaatgtctaggtcccctgctcatgttttaattaggttgtttttgttgttgagtggtaacagttctattgggggaacctgcccccaatatttcaatgtaggttctttctattttccataaatgtcggccaactgagaaataaagagagacagtacaaagagaggaattttacagctgggccgccaggggtgacatcacatatcggtaggaccgtgatgcccgcctgagtctcagaccagcaagtttttattaagggtttcaaaaggggaggtggtgtaagaacagggagtaggcacaaagatcacatgcttcaaagggcaaaaagcagagccactaataagggtctaacaaagatcacgtgcttttgagggaacaggacaagggcaaaagcagaaccactgataagggtccaacaaagatcacagggcaaagggcaaaagcagaaccactgataagggtctatgttcagcagtgcacatattgtcttgataaacatcttaaacaacagaaaacggggtttgagagcagagaagcggtctgaccacaaatttaccagggcagagtttttccccaccctagtaagcctgagggttctgcaggagaccagggcgtatctcagtccttatctcaactgcacaagacagacatttcccagagtggctgtttatagacctccccccaggaacacattcctttcccagggtattaatattaatattccttgctaggaaaagaatttagcaatatctttcctacttgcatgtccgtttataggctctctgcaagaagagaaatatggctctttttgtctgacccagcaggcagtcagatcttatggttttcttcccttgttccataaaaatcactgttattctgttctttttcaaggtgcactgatttcatattgttccaacacacattttacaatcaatttgtacagttaacacaattatcacagtggtcctgaggtgacatacatcctcagcttacgaagataataggattaagagtaaagtaaagacaggcataagaaattataaaagtattatttgggagcagataaatgtccatattaatatgaaatcttcacaatttatgttcctctgccgcggctccagccggtccctctgttcagggtccctgagtttccgcaacagagttctttattgtggttataaaacctttatcagatacatgatttgcagatattttctccccttctctaggcttcttttcactttgttgatagtgttctttgatacacaaaatattttaattttggtgaagtccaatttatctatttttgtttttttgttactcatgcttttggtgtcatatctaagactccattgccaaatgcacagttatgaagatttacctgcctcatgttttctaagaattttatggttttaactcttttatttgggtgattgatccattttgaattaatttttctatatggtataaagtgggagtccatatgttgcatgtgagtatctagttgtccaagcaacatttgttgaagaaactggaaagactttaaaatgaatatgtcctatgttgatttcttcattattgtgattgctctgggagcactttaaatagctataaagaaatgtcacaaacctttattattattattattattattattatttttttttattttttttttttttaggtcaacctctgggagcacagaacaatgtttcaatatttttttttttgagaagaagtctcgctctgtcacccaggctggagtgcagtggcacgatcttggctcactgcaacctctgcctcccaggttcaagcgattctcctgcctcagcctcccaagtagctggggttacaagtgtatggcactgcacccggctaattttttgtatttttagtagagacagggtttcaccatgttggccaggctggtcttgaactcctgacttcaggtaattcacccgccttggcctcccaaagtgctaggattacaggtgtgagctaccacgcccatctagaacaaacttcttatgttttcagtattttttacaaaattgaagaaatcggctttttgataacttttattagataacatttgtcttcatctaggttgacaagtgcactaaaatatcagactccaccactatacaattcacccacgtaaccaaaaaccacttctaccccaaaagctactgaaatgtttaaaaattaaaacatttggcttcatctaaattaaattaatggaaaaaagccaaatcagcttttttttagtctgtatttttaaaaattagccttactgaagatactaaactgaaaaaaaaaatttatgcatcttaaaacagattaatcaaactttattgactctaaaaacattcttacattggtaacttttatttttcagggtgaagattatataaagatgagtcagtgattgaagccaatattctgattcccatggaagatggatgggcaagagtgtacttcttggctccatttactacctactgctcagtagtcatctctgtaaatctgcaatttctaccaaaatgtgtgatcgtagatctcaaaggatcttgctttaactttcaacacttagaaaatctacaaacattcagacctgtctgggttggtattgccacccatgacatttaacatgttgtgatgcttgaaaacacaggagtagagaaaatcgatgaagattgtatttttgcaccttaactccacattgctttattggttaatttatattctttccatgtaattcatgtaattgtatgtctgtgtgtgttttatgtgtcaccacctttcatgtttttgattgccctacaaagagaaaccaaatgagctgattactgactataagttctcagcctttatggacctaatcttatttttatttacttgagtaatgtttattctctgcatgaaccatgatttctcctgtgagccattccagcataagctgtgaatatgtattaacaaatatatacatttctatttttataatccataaggatatgcctgttttaaataacatacatattaacaatatctatcaggaaaaccctcaagacagcttctagttaaaacctttgttgctgtcctctcaaactatatttataaaaatttgctagggccaaatccatacttgcagaataattcatcaaattttatttttaagtgaaaagtaacctttcaggcatttcagcagcatacattgacaatctagggtatatatgtatgtatgtttcttattgtatgtctatatatgtatgtggggaggacaggagtgaatgttcacacacttttcttgcgtactcaactaaattggagaatgtttctgaagaaaattggatgaaattagctgctgagattgagtttctgccttaaaatctgaaacaaaaaaagggacaaattgctggtagatctactgactgtagccatcaccagaacacttagtttcttcccagacatgaatttcctgacaggctctgagccagaaacacactgtgggcgtgcatctggttcagccctggatatgcctccactgtggagggaagcattggaactggagttgtgcacagcaccgcagctagtgggcctggctgggggtgcagaagggcagggtagttctttccatttccccttgcagctacacttactttctccctgactaccaaatggagtgacggttgaagaatcaagctcataatatgatacacccagacagacccagaaatcttttgatttccccagcgagatacttaccactctctcttctctttcccatggttaaaacaggagttgtgttctctgtcgctgctaaattattcttcacttgagtgaagcaaatatttagcttccaaataaagtatattttgttctgaactggcagtttaagaggagataccgtagtctagattgtctttgaggtagaatatatgatggaccacatagtttaagattacaaggtactttccctcttctctcaggccatgcatttgaataaagtgcctcccttagcctgagctcctaaagacctcttgtacttggttgcaaactcagatctctagtctagtctagtctagtctagtctagtcatgtgtgactgtgtactgagataccactagcccagtttgctgggtctctatgttttggaagttgggggtttaataatatttaatgtctttttaggatcataaacataaataggtttgttgatattcaggccttcagaatttaagggttttaaatatagcattcagattgtaattggtatgtttttgccatctggtccactcaattgtatatttttattttgcaaaacaacccaaaacttactttatgttgctttgttcagtaccttttgaattcccccagaagagttgttttcaaaacaaacattccagaatgaatgtcgctcttcaatggaacgtctttattgtgcttgaagtatttcttctctggttgtaattctaaattacagagtcatttgagctttctcccctcccgctagtatctttacaggagcagggaagagcagtagaggatgtataattttgggcgaagttaaattacaatttatttgaggttattcctaaacctatttatttggtgttttggaggagatcacacactaagagaacgttgattgcctcggctattgtgctggctggacactttggtcacttttgaagcatgttaataaatgtcactgattaaaacagctggagcatttccttccctttccagtgaaggagcagcatagtgaaatcctggcacccctcacctttttgtgatgacaagatggctgacagtcacggagtccaggagaaggtgctgctctccttgctttctgagtaaacagagtaatgttttttttcttattttcccaaagaaagaaaagggggaaaatatatttgtatgtttagaccagccaaattctgtcattattttagtatcaacctgctgtatattagagcaactgaatataatatggaataagtttgaccaggtcaagttttaggatatagttgaatttctttaaaaagttttctattttatctaaaatctttccattatatctaaattagaatgatcatcctgcgcaaattcagattactgtttgctggctaattgacagtatttctcagcatcactatgtagcattctgttttagcatctttgaattatgatcatttgatttggctaattacaaaaagtacaggtttaaactggacttagcttgagttaaaggcaaagaaaatctaaaaacataaatgttatatttcacaagaaatcagttgcatattatccattacatatttagttttaaaaggaggagtcaccttgaattattttctgagtcaccttgagttatttgatctctcagcctgctttctcatctgtaaaaaaggggggaggataactttcacagggtaattggtaggctaaataggagttacagaaaactgttaaatagggaagaactacattaaatttaaatattcacattatgcctgtgtttgactattgttagcatttaagtcactaaagatcaatatatttaatgagttggactctaaatatgtggtactgtaggtatcacatttcccaagtctttttagctatatcatgtctatcttcggaatggtatagtcgggggccctttttatcaataatagccttctattaattagactaattttaagaacaactaatacttcaactggcaatatcatcctataattatccacataaagtagtctttcaggctgctaggtaacttggctgtcttctattccatccgttttatttaactacacgatggtcatgaatcagtggcaggactgccttgtaaagttgtgctgattttgcactgcacaaaagtacatagttaaggaggcgaatggactttaaaatctagttcacattcccctcaacaagctacgtgtggaggaaggggctcttgccttctcaccaaggtgtacatgtggcacaggtctccccagaagaggtgtctttttctaatttgcccaaaggggatacctgtcttaatacatccaccagggggtgcctttttaaaaatgtgcaaagccgtggtgtgttgcagctggcttttgctggctccccagaggagaaccaattgtgtgcatctcttcccaacttgatgttcagtgacatcaggttggtagcttttaatggacaatggtaggagtatttgtatcatagaagttagtaaatgctgcaaattgtggatcccccaccccctcagtcagtttctaacacaccactgaaaaaggcccgatgtaggctagcattgcatttcccagagcaggcacactggagtcctaaaatgtgtatgattaaaggacacatagacctggaagaactctttttataaagctgtaggcagcttggagttgtccgtatcaaattcagattggttcacagacatatggtagttctgactcagaaactgttacgggtcacagaaaaatacacagtccaactctagaaatgactaggaagtgaatcagctgaattactatttttgagatggagtcttgctctgtcacccaggcgggagtgcagtggtgccatctcagctcactgcagcctccacctcccgggttcaagtgatgctcctgcctcagcctcctgggtatctgggattacaggcatgcgcccccacgcccagttaattttttgtatttttagtagggatggagtttcaccattgctggacaggctggtcttgaactcctcacatcaggtaatctgcctgccttggcctcccaaagtgctgggattacaggagtgagctaccacgcccagccgaatcagctgaattcttaagccttagcataaaagcaggcacaactaatacacctactgtgttgtgatacagttcaccagacactcctggattgaggagggctggagctggacagtgaactctggcttacaggccattttgactttgcagtaagataaatatttgggcaggaaaattttcccatgatccaacagatcccaatccaatcttactatgcctcggcaaccctttcctgagaaggacagcagtgcctggcaagcacattataaacctgagtccaggtttatccccttgtgtaatcaagtccatgggctggatgtgacaacacatgtgcctaagctaggtaggcttgaatagtacagaatgaaataggccaaaaggctgtcccaagcccacactgagtttcagatcttacctcttaaatggaacagagaccatgcttgtcagcaccacaagaaaagtttgtacaagacttgtggcaataaatagatacctctaaacctgctcattctcaggccaggacaggcctcagctgccacaaaggaagagagagaatgttgaaaaagtaaggaagaaagaaaaccaaaagatggccaagccttctttcagaaggaggaagatagttcatatgggggctatattagtccattctctcattgctgtaaagaaataactggcagagcttgcagtgagccaagatcacaccactgcactccagcctgggcaacagagcaagactctgtctcaaaaaaaaaaaaaaaaaaaaaaaaaaaaaacaaaaactgagactgggtagtttataaagaaaagaggtttgattggctcacatgtggttctgcaggctgtacaggaagcatgactggggaggcctcaggaaacttacagtcatgatggaagacaaagtgagagcaggcatcttgcatggcagcattgggaccagggatcgggggtaccacacgcttttaaataaccggatcttgtgagcactcactatacagcaccaaagggggatggtgctaaaccattcatgggaactccaccctcatgatccagtcacctcccaccagtccccacctcccaacactggggattacattttgatatgagatttggtggggaccagatccaagccatatcattctgcccctggcccctccaaatctcatgtccttctcacattgcaaagtataatcatccccttctcagtagccccccgaagtctcaactaattccaatattagctcaaaagtccacagtccaaagtcttatctgagacaacacaagtcccttccacctatgagcctgtacagtcaaaaacaagttagttacttccaagatacaaaagaggtacaagtattgggtaaatactcccactccaaaagggagaaatcaaccaaaagaaaggggctacaggccctatgcaagtctgaaacccagctgggcagtcattaactcttaaagctccaaaatctcctttgacttcatgtctcacatccagggcacactggtgcaaggggtgggctcccaaagccttgggcagctctgcccctgcggttcagcctccatggatgccctcatgggctggtgttaagtgctagtggcttttctaggtgcatggtgcaagctgttggtggctctaccattccagggtatggaggatggtggctctcttctcacagctccaccaggcagtgccccagtggggactctctgtgggggctccaaccccacactttccctcctcagtaccctacatgagggctctgcccctacagcaggcttctgcctgcacatccaggcttttccatacatcttctgaaatctaggcagaggctcccaagtctcaactcttgcaccctgtgcacctgcaggcttaacaccatgtggaagctgccaaggcttatggcttgcaccctctgaagcaccagcttgagctgtatccagacacctttgagccatagctggaggtggagtggttgggatgcagggagcagagtcctgaggctattcagggcaacagggccctggacctggcccatggaaccattcaatcctcctaggcctctgggcctgtgatgggagaggctgtctcttagatctctgaaatgtcttgagggcttaacctcattgtcttgactatcagcaattggttgctttttactaagtaaatttctgcagtgggcttgaattcctgccctgaaaatgggctttgtttttataccacatggccaggctacaaatttcccaaacttttatgctttgcttcccttttaaatataagttccagttttatgtcatttctttgctcatgcacatgagcatatgctgttagaagcagccaggctaaatcttgaatgctttgctgcttagaaacttcttccgccagataccctaaatcatcattctcaagttcaaagttccacatatacctaaggcaggagcacaatgcctccgaattcattgctaaagcataggaaaagtgatctttgctccagttctcagttaagttcctcatctctgtctgagatgtcatcagcctggccatctctgttccatatcactatcagcattttggtcacaaccatttaacaagtctctaggaagttccaaaccttctcatctttctgtcttcttctgagccctccacactcttccaacatctgcctgttacccagtttcaaagctgcttccacattttcaggtatctttatagaaataccccacttctggtaccaattttctgtattagtctgttctcacattcctataaataaatacctgagactggataatatataaagaaaagaggttcaattggctcatggttccataggctgtatggaaagcatggcagcatctgcttttggggaagcctcaggaaaaagcaggagcaggtgtcttacatggcagaagcaggaccaaaggggtggggaagatgttacacactttttaaatcaaccagatcttgtgagaactcacactatacagtaccaaaggggggatggtgcaactctgccctcatgatccagtcacctcccaccagacatcacctccaacactggggattacaatttgacatgagatttggtggggacacagatccaaatcatatcaggagccaaagcaaagatgaaagctggcaatgcctgttttcttgttggagtaacctcacctttttgccactccagacaaaaaaagaaaaacccatgtgcccatgagccttttgaaccaggcagagtaagaaatctacctagcaataaccaataaaatgtctttaaagctgactgtagtgcaacagtcctcttcctgaaatagtggggagaagggagacttcagcacaaatcagaagaatacagactagtgtaagaaacaaaccataataaatctgggctcaggagatgataactcattttagatgatacaggggtaaccagctagatatatttgaagtaggaaattggggaagatggttccaaatacatgggactcatcacagggttcctttatttttatttattactattttcgaggcaaggtcttgctctgtcactcaggctggagtgcagtggcatgatctcggctcactgcaacctctgcctcctgggctcaggtgattctccaacctctgcctcccaagtagctgggactacaggtgtgtgccaccacacctggctacttttttctttttaatttctattatggatatgctgggaataactggctgattttttaaaaaaaatttttgtagagatattttgttatgttgcccaggctggtcttgaactcctggcctcaagcaatcctcctgcctcggcctcccaaagtgctgggatcacaggtgtgagctaccattcccagcttcctttaaatgaccacgcttagtgaaattaatgttttcagatcattaggcataccattatgtgactggaggtgacacaaaacatcaagctaaaatgtgcttatccatttgttattaggttagatgaaaacagaatggctctacaagtctgatatgtgccaatatcattttaagtaaacatgactttttaggagctttttttttttttagtaaaaaatgtaaccagttgtgtactgatagatgtttaacacctgacgcttggttgaggggaggcctaatttgtagtatttgccaatttctggggtggaaatattcccaccatagttggtttcaagctactgtgttcttaaccagctcccaaagtttttgaaaatttaggattggctcttgcaagtgtgtatgagccaattgtacatcatgggataacatatatggcataaagatgggatatcagttaggaatctcttggctgcaagtaaagaatacacaactaaaattgacaaataataaagacctatctcacataataagtctgaggactacagtggctcaacaatgtcattaaacagtttacaaatgtcatggcaaagtcaggaagttaccatatatgatctaaaaaggggaggcatgaatgatccaccccttatttagcatataatcaagaaataaccacaaaaatgggcaaccagcagcccttgggctgctctgtctatggagtagccattcttttattctttttttttcttattttgaggaagagtctcgctctgttgcccaggctggagtgcagtggcgcaatctcagctcactgcaacctctgcctcctgggttcaagtgattctcatgcctcagcctcccaagtagctgggattacaggtgcccgccaccatgcctagctaatttttgtatttttagtagagatggggtttcaccatgttggccaggctggtcttaaactcttgacctcaaggaatccatccgcctcggcctcccaaagtgctgggattacaagtgtgagccaccgtgcccagttcattcttttattctttaccttcctaataaacttgcttttacttaaaaaaaaaaatgacattaaaaacccagaatctttccttccttctgctccaccatcctctgcagattggctgtcaccctcagcttacccactcatggttgtaagacaactgctccaggcatcactctcacaaccatgatctaaggaggaaaaggagttttttcttgctactgttaatggtggagggtctccaggttcttgacgttttgaacaaagaattggacaaaacgcacaaacaaagcaaggaaagaatgaagggttttactgaaaatgaaagtacacttcacagtgtgggagcgggcctgtgcacaggggctcaaagactctgttaacagagtttttgtgagcttaaataccctctacttggggtacgacctatgtaaatgaagaggatgaagtaaagttacaaagtcatttactcagtgtatgccctatggagaggatatttcctgtcatagctgaaatgtgaatcagccttatgttccctgcctccagaccctatttttctgcctcactacttcatcttatcagggagaaaaacctttcccagatgccccctcaacagacttatctttacatctcattggccagaagtttgggctagatgaacaccaataagccattcactgataagagggaatggaattgccatgattggcttaaacacagttaatcccttaaaaccaactaaccttgacttcattgctacttcacacctgaacaaaatcagtgctgttggcaaggaagggagtggctgttaggaagtacaaccaacaatgtctaccacaacaaatgaatgcagttaactgtggaataaaccagagatcatcagtaaacaaatgactgagctttggtagaacttcctaaattccaatcaaggtgactttggtagactctcaagaaagcatacctaaatgtgatataatttattaagtacaaaccaattctgccctcttatgagaatatatgactagatggaggatgatcagaacaaagaaaatggaaatcaaaagagtcagaaggtggtagagtttattcagcactcttcagaaagagactatgaatatggcatacaaaagtctagttgtcaaagaggtacatgtaaatattgagctgagatggttcgttaggtcctttcatggcctgaatgaaataaatatatttcaaaaatacttcagtactatagaggctgattcttttttttttttttttttttttttctttttgagacagggtctggtctgttgcctaggctggagtggaaaggcatgatctcagctcactgcaacctttgcctcctaggctcaagtgatcctcccaccccagcctcccaagtagctgggactacaggcatgctccaccatacccagttaatttttttgtagagatggggtcttgccatgttgcccaggctggtctcaaactcctgggctcaagtgatctgcctgctttggcctcccaaagtgctgggattacaggcgtgatccacagtgagccactgtgcctggccagttcccatttgatttatttatttatttatttatttatttatttatttattcattcatttattgagatggagtctcgctctgtcacccagactggagtgcagtgatgctatctgggctcactgcaacctctacctcccaggttcaagtgattctcctgcctcagcctctcgagtagctgggattacaggtgtgcaccaccacacggctaattttttgtatttttagtaaagacagggtttcaccatattggccaggctgatctcgaactcctgacctcaggtgatctgcctgcctcggcctcccaaagtgctgggattacaaacgtgagccacgacacccggcccccattttaaattaaatacttctttcctttgacaaaattaattctagatgagcaaagatgtaaacattctacaaaaccaaaaccagtcaggcatggtggctcacgcctgttatcccagcacgttgggaggccgatgtgggcggatcacctgaggtcaggagtttgagaccagcctggccaacatggtgaaaccccatctctactaaaaaaatacaaaacttagccaggtgtggtggcacatgcctgtaatcccagctagtctactcaggaggctgaggcaggaaaatcactggaacctgggaggcaggggctgcagtaagctgagatcacaccactgcaccccagcctgggtgaccaagcgagactccatctcaaaaaacaaacaaacaaacaacaacaacaacaacaacaacaacaaactcaataacctttacctctagagagaggtactgggagacaagcctagggtaagagacagatttagttttcaccacatgtcattttgttggggcagacagcctctaaaatggcccccatttccccgcctctgatattcacacccttgcttggcccctccccttgagtatgggcaagagctataactcacttctgaccaacagaacacaggaaaggtgatggaatgtcacttccatgcttaggttacataagatagcaacttctgtcttgatagcagcccctctcgtttgatgctttatgaagcaagctgccatactggagaggcccatgtgcaaggagttgagggccaacaaccagcaagggactgaggcccttgatgaattgaattctgataacaactacatgagcttgaaagcagatcctatctcagttgagccttcagatgagaccccatcctggttgacaccttgattgcagccttgtgaatcagaagattcactgttaagcagttaaactgtgtccagatttctgacccactgaaactatgagatcatatatgtgtgtggttttaagctgccaaaaaaaaaaaaaagccccaaaacaaaacaaaacaagacaaattagctggacatggtggtgtgcaactgtagtcccagctattacatttggagggcagaggcaggaggatcatttgaacatgggaggttgaggctgcagggagctgagattgtgtcactgtactccagccagtctgggtgacaaagtgagaccctgtctccaaaaaataaacaaacaaaggctgcagcatcaaatcttgcctgctggcctgccccacagatttcaaccttgccagcagcacccataattgcatgaaccagttcctaagagtaactctccacccaaccatcatctatgcatatttcctgttggttccgtttctctggagaaccctaatatgggtaagttctgttatttcccccattttaatcatggagaaggcggggtctgagaacaatttgcttaaatagctggtaagcagaacctggacatggacccaaaaagtttggctccagagcccttgaaaataaccattatactattctgtaactaaggacaactgtgctggctgcctatctcactggagttttgtaccttttttttttttctgatttgtaaagggtcattcaagtgcagtgcatctgcttagagaaccagatagcatggaagtgaaatgacccttgactgatgagcagagacccatccgttcttctcagctgttgtgctgccatcctccccaccatgcaactcttcacagctactattttgttgtccagcggtctatgctatggtcttattgtccttcctgagcaagcatagtcagggtcctgctggccaaatgtacagtagtcttttaaaggagactgttctttggaagatactgcagggaaacagaatagagaggattcattcagaattcccctcaaggagtttgaatctatatctaggggttgtgggtaaataactggaactgccttcctgactgcctgctgggaaccagcctatgttcccagacctccagacctgcatcataatcctcaaaccagatacatgcgaactcctcactgcagagcccagcatttgttggaggtctttcttctgtggaactaaactcacacattcttcaaattattggtgaatccaaattgcataaccctacacatagaacttaattagggttcacagagagtctgtaaagcaattcttttaaagaagcttcttctggccaggccagtggctcacacctgtaatctcagcactttgggaggccaaagcaggaggatcattgaggccaggagttcaagactaccctgggcggcaaagcaagattccatctctactaaaaaataaaatatatatatatatttataaaagaggcttcttctgagaaagaaaatatagagctcttgaagtgttcaattgtccaaaaaagttcagaatggcccggattgtaggggcttactttaaaatacatttaactgcctgcttaccagcagcatatgaacattcacttgtagggaaactctagatacactgcgatgaaaaagtccatgaattctctgagtcaatgatgaaaagagcggaaaaggaaaagacaggccctggcaagtgtgggtggcactaatgccagcttggtggtctgatggagttttttgaaaatgatcacatttgtagaatgggtttaaaacaatattttgactagtgatttcatgtctgaaaagggtattattttggaatttcctccagtgtttaaatgctttgtgttttgaacacactgattgattacttaatctacagctgcttctgggtgctcagcaattttccctgtcttgttgctatgagacgaggacttccctgaattcgccagtgtgacaggcatcgtgaagaggtggtgggctctgcccacaagtcacagtgccatcaagcggtcattctggaaaactgttagaggaagtcggtttgtttccactgttctctaattatggcactctaaggtcatcattttcacagatgaattagcaggttaaatgaacagtgaaggcttatgtattcctttcatattctcctgcacacagtttggatttttaaaaatcgaatacatccagcccggccaacatggtgaaaccccgtctctactaaaaatacaaaaaaattagcagggcgtgttggcacggggcctgtaatcccagctactcaggaggctgaggcaggagaatcacttgaacctgggaggcgaaggttgcagtgagccaagatgagtgcagtggcagatctcagctgtaacctccgcctcctgggtagctgggactacaggcacacgcaccacacccggctaattgtagagatgaggggtctcactatgttgcccagactggtctcaagctcctgggctcaagcgatctgcctgcctggcctcccagagtgctgaggaataaataaaactaatgtattaaaaaataaatgaatcaggccgggcgctgtggctcacgcctgtaatcccagtactttgggaggccaaggtgggtggatcacgaggtcaggaattcaagaccagcctggccagtatggtgaagccccgtctctattaaaaatacaaaaaatagctgggtgtggtgacgcatgcctgtagtcccagctgcttgggaggctgaggcaggaggattgcttgaacccaggaggcggtggttgcagtgagctgagattgcaccactgcactccagcctgggcgacagagtgagactccatcttgaataataataaataaataaatatataaataaagccacagcaagccaaatggtaaagttgaaagaaagttgaggccaggcgcggtggctcacgcctgtaatcccagcactttgggaggccgaggcgggtggatcacgaggtcaggagatcgagaccatcctggctaacacggtgaaaccccgtctctactaaaataaaaaaaaaaaaatacaaaaaattagccgggcatgatggtgggcgcctgtagtcccagctactcaggaggctgaggcaggagaatggcgtgaatccgggaggcggagcttgcagtgagccgagatcgcgccactgcactccagcccgggggacagagggagactccgtctcaaaaaaaaaaaaaaaaaaaaaagaaagaaagaaagaaagaaagaaagtttaaccggtgggtaggggacattgcaggttagccctaacttcacatctcttggtctcaatttccgcttctaactaatgaagggcttggcctgggtctcccaacatcccttctgctctgaaagtgtctaattccttgcttcttttacatatggtttttagaggagcataacctggaagcggatcctggtcaggtctccccagctgagcctggttatgtgacttcagagtgagcttgtgcaaatggcagcaaagatggaagggcggaagagggtctgtgcccacagggggaggtgaaattgccagcactctctggcaaacgactccactccccacatgcttggtggagatgggcctccaccaaggacaaaattgtcattcctgagggagaagtctggcccggggtatcagctccgggcatgggggctaagcctgtgatgaaaggctcacaggcaagcgcatctgtgcaggatgtgcttattgactcagcagcaggctggacattaacgtattcgatgaagatgagaagaaagggagaattcagattccactcaaaggatgcatccctgtcccttccctcctcaccgacggtttacgagaacctggagccaggtaggagaactgcctctactgtggagcctgcttccaactgtttcctttcttgtactcctgtttgaagggccacatgattctgggtgtgtggtgcacctcattgtctccctgtggcttaattctggttcttgtggagtaaatgtgagatgtagtgaatgctgttcttgtgttgagggacttaagcaaattttcatccatctgtgcattatgtaaagcctcttccaaattcaggataagagaaacaccaggaatgctgaatattaagctaaacaaaaatacagtgaattaccaacaccctgagagaacatagctgaattaatacaggtcacacgactttggggctctcttgactgtgacttaatactcttaatttgtcattatttgggggattaaaaaataccttctggccgggatggtggctcgtgttgtaatcccagcactttgggatgctgaggcgggtggatcacttgaagccaggagtttgagaccagcctggccaacatgggaaaacactgtctctactaaaaatacaaaaattagttgggtgtgatggctgtaggcccagctgcttgggaggctaaggcatgagaattgcttgaacctgggagatggaggttgcagtgagctgagatcgtgccactgcaccgcagcctgggtgatagagcgagactctgtctcaaaaagaaaaaaaaaacaaactgtttacacaagagcttgtatcacattgtctcactgaatatccacctactgtagtaaactcccagaacgttagacacaatagagcttagaaatcacctagtgtaattcttttcagtttaaaccgagacctataaatatataaaaacaaaatggaaacaaattaaacttttcacactgtaactcgaaaaaataatatttcacttaaaaagacaataaaactacggcagggatctcttctacattttaacaagtctgaaccatgaaattcaagggctaagtgaggtaaatatctggcacattttgctgttttagagccatttgctgatgggataagaatgtgaggaggatgggaaaagggagaaagaaaaatatgatatattatttctctctttggaatctgcaattgaacaaagcatctcaacttaaaaacatcagctctgtaaatgttttgtagattaaatattttgttattctttgttccaaatatcaaaacgtaatcttgtctcattcccctgtgtctgggaggtaggaaggcacaggtttccctccttattgcaaacattccgcagcacaagtccaagaacctagctacagccaaggaacaggtgaaggccagctcattacatttcaactagaccctttttaagaatcaccagtgaaccttaaattcagctgattttttaaaattgaaaataaaaaagaggccaggtgcggtggttcgtgcctgtaatcccagcactttgggaggccaaggcaggcggatctcctaaggtcaggagttcgagaccagcctggccaacatggtgaaacccccgtctctattaaaaatacaaaaattagcttggcatggtggcgggcacctgtaatcccagctacttgggaggctgaggcgggagaatcacttgaactcgggaggcagaggttgcagtgagccgagatcacgccattgcactccagcctggacaacagagtgagactctgtctcaaaaaaaaaaaaaaaaaaaaattaaaaaaagaaaaaagaatggccacattctcttagacctttgacttccaccaaggcagtggtcaggaggccccttcagggcctggatgggtttggcgcctcgtgtcgtctagggagacatctgaaatgtcaaggaaagagcaacagacagacatgcggttagaggctcgagtttgaataccagctctgtcacattccaacttgggcaggtcacataactattgagttccagtttgctcatctataaaagggatgataataaatatatcacagaattattgagaggataaaggagataatgcatgtagaattgctgaacaactggagttattatttgcagctcttgttaactagggcgtgaaaatgcataccagtcttgtctgtaaaccctttattgtttaaataaaaacattttttaaatgtgctggctggtcctcgatttgaaataatggagatctgggaaccagaggaaaaaaattccctagttatcacaggcaaagaagagtttgaggttggccagggtatggtgctgtgctctggagagagatgagggagaacaggctctggctagagaaatggcctccagtttctacaagaatgaggaagacagtccttgcccttgctgtcctggtgtatagggtagtgctgcgcagctgaaagtctcggcttgaattgcagagcacagagaaatgccatctgtcatttctgtctttggcattttttagatatgctagcaacagcacctgctcatttacttgtatataactcaaaaatgggaggtgaatgtcctagacacagcctagatgggacacaggtgtgaggaaaacattgcattaactttgcatttttcaaggcttcatcagctgcttagattaaggaaggataaaaacaagagaaagagcaagagaaattaagcaactcgtatgctttcttcccctaagaatcctgattaaaatccaaccacagaagacttgccagcaagttccaatatatggcgtgctttccatagcagatctggctagtggttacttggaggaaggtaacgtgacaacctatacaatattaactcatcctaaatgttgcttagtgaaagaaatataaatctctgagataggtgacacggggatttcatttggaactgaagcccatagttataaaaattcagtaaggaggagaaaaagaaaacaaaataaaactagattgaatcattaatcaaagactgtgtgtatggcttaggtttatgtttttgaaccaacagtaaatagtaagaaagcattttcttttttatgcatgtaactaatatattaatagtaaaaggactgttggctaaagttcaaagtgaacgcttttcctaaaacataaaaagcaagtaaaataaaacccacaaaaactacagtaaacaaatgaatgcattttacaaaataaaacatttcccttggaaagttgagtgaaaacaaatatgtaaatagcttctgtttttatagttaaagctttttaatctctggtgcataacaattgaaagaatgagaacttagacaaaagtatttggtggatttgagttaatgggccaagcaagctttttttccttggcttctctgtcaaatgagtcatagatcgagtctttggtaatagttttggccatggaagggatttctgaaatgccaacgtagttttttttggccatccttgaacttgttgtgatagtataggcattgcttcggtaacatttcatagaggacatgcaaaaagtctctttcatccctctccgaaaattggcattataaattgaatacagagtaggtttagaggctgaagaactaaaggatatccatgtgatagctgtgaaaacaagggaacttttcttatagtcttgttcatgggggtgccatagctgagctacatgaaaaggcagccaggagagcaaaaacaacagatttaaaatgaggaacatcttgatagttttcacttttgtccgagggacaatgttcattgtcctcctcaccgttcggccatctgtgcctattctccaaatatattttatgaccttttggtaaaataaaattatgaggacagatggaatcacaaagcccaccaagaagtggatgacagtgtaggcagtgccttcccaagaggaggggaggaaatagttacaatgactgtcccagttggagccatagaaaaagagcacaggggtcacaaagcctgcatcaaagacccacgatgccgcaatcattttcttggctttttctctggacaccttgaagctcagaggatagacgatggtgtagaaccggtctatgcagatggagaggagaacgtagatctggacacctggagtgagatattgaaaatatcgcacaaccttgcacgttgcactacccagcgtccaccttccagtggtgaactggagcaggacgaaaggcgtgctggcaacgctgatgagaaggtcagcacatgccatggagaccacaaagtagttggtggtagactgagtcctcctactcctatggatgaccaaacaaaccagggaattgccgaagatagaaaacaaccacagaatcccaaagaagatgctggctgtggccacttccccgggtttcagcacatagtgaaggtctgtttggttgctcatccaactgtgctcctcacttaattccatcaggtattggcttggcagaggtgtggctgtttcagtgcagctgcggttttggaggggcaccagaagtgtaggaataatcaaatgtggcttgctgttatccattctgtgagcaaaaaccatattcactttttttctcttaattctggttggggaaaagaagaatgaggcctcctgttaaaaaggtgtcatacagattggttatgattactcaggctaacgatcttatttgacatttacattgattgtcatttgtctttgtgtaggacttgagcgttggcaggaaaacataactactatccagaaaaaattctggccccaactttgttttcattttaggagctgtttcagcagatctcagctcaggctctctctggcctcaccttctcttgacccttagtcataccgagctcccctcctacacatatccttgttcccttcactcatcagggatcacagaatattagggatctcaaatctggctcatggtaacggtgttaccaccaactgaagatctgctggaattctgggcaagtatgtgagaagttcctaattgtcctaaggttgcaaaagaggaaagcttgggcagatgaaaacacacagattttgactatggaagtagctaacagcagtctgtgaatgtagacaggctagctactgggaagggtgctgtccttacttagtgtagattttccatcacagaaggattatggtaacacatggagcagtcaacactgctacatgagccagaaatagctcctaatttaatgacatctgaaaatagcttgctttttctaaaagacgatacagttcatgcactaatagcttgccacctaccagtgacatatattttgatgctattctgttgttattgtttcataaaatactgactgaagaacatacaagatgtcctctaagaaatgtaaccaggttacgggagaccttatggcagtcaggtgattaaaaacaacaaaaaaatgtaactgttagctaagcacagtggggaacacctatagtcccagctactcagaaggctgaagcaggaggatcagttggtccagaagtttgaatccagcctgggcaacatagcaagaccctatctcaaaaaaaaaaaaagtaacttaaaattactaagcactttttaaaagcttataaagcttacaaatcttagatacaaaagaatattttaaagtttagcctttattttgtactttttgtattattcagtgagaaaaaaagtcacactgtttaaataggcaaaaagattaaatagttgtgggtcattcaattaaaattgaggtgattttgctcacagattataaaggcttaatttggtctgaatccaggaaacaaaaagagaaacagtagcaatttaatccataataaccataataattatggttattaaggtaagataaggataaacattaatattttcaaaaatgtgcccactaaaagtaaaagcccatgtggggttacagccaccattttgcagagattccatctggcctgtggcacaaggggatgtggctccagcaacaggcttttctagtagtcactagtttctttcctggtgggctcctgtgtctgcacctcacaaagaaacatttctcaagtgacagtcaggattaaataatagttcataatgaaagaacggttcttaatgactaatattttcttttttttgagacagagtctcgctccgtcccccgggctggtgtgcagtggcgcgatctctgctcaatgcaacctccccctcccaggttcaattcttgtgtctcagcctctcgagtagttgggactagaggcgcgtgccaccatgcctggctaatttttgtatttttagtagagaccgggtttccccacgttggccaggctggtcttgaactcctgacctcaagtgattcgcccgccttggcctcccaaagtgctgggattacgggtgtagcaattgcgcccagccctcattttttctttgagggatttttgtactaatttgtggtagagaaagaagtgttaatatatataatcttcaccaaaaagctatattcaatacaagtctagtgctcaaggcaatatactcaatgcctgttctatattatctttaggcttttttgtccatgaggcaaccttacttaagaaagcttaagtaagataattaaaattttaaaaattaaaaaaaaagtttttgctcaccacacagaaagcaaaaataattaaacattttgactactaaaagatctttaagcatgctgggaaaatgatagccaatggtaagaatagcaaccatacactttccatataagaaatcagggccaggcgcggtggctcatgcctgtaatccgagcactttgggaggtcaaggcgtgcaaatcacgaggtcaggagatcgagactatcctggctaacacagtgaaaccccgtctctactaaaaatacaaaagattagccgggcgtggtggcaggcgcctgtggtcccagctactcgggaggctgaggcaggagaatcgcttgaacccgggaggcgaaggttgcagtgagctgagatcgcgccactgcactccaggctgggcgacggggtgagacgccatctcaaaaaaaaaaaaaaaaaaaaaaaaaaagaaatcaggacataagatctaaaattagcattgtcctagaaaatctggactgcaccctcatacatataagattgaaatcatcttttcgccttcatgtgtgtaaaacctattaaactttttaaaaaacctgttaagatttaaagtttaaaaataaactaaaacagacaatttccccagacagaaaactgttctaacttttctgggatgcctgtggcctgaataaaacaggagtccacacaggcacttttccttaatgcgcatacttgaaaacctgtgaacttccttctgtctctttcttcctctaacaacaaaactctgcaaatgaaactcaagctcaccgctttaactaaagcccggaggcggggggcccttccatcatttcctccagctgctttacacccatgagtctgtctgcccatttccccagcccaaccacttggaagcagaggatcccaatgctcagaaacaggacgagggagcccgaggagttcctgagtctagatttcccctgctggtggcataagttctcactccacctaaaatcgctgcagttctgaatattcattcaataagccgagaaactgggctaggtattaagaaaacaaagatcggccgagcgcggtggctcacgcctgtaatcccagcactttgggaggccgaggcgggcggatcacaaggtcaggagatcgagaccatcctggctaacacagtgaaactccgtccaactaaaaatacaaaaaattagccgggcatggtggtgggcgcctgtagtcccagctatccgggaggctgaggcaggagaacggcgtgaacccgggaggcggagcttgcagtgagccgagcagcctggggcacaaagccagactccgtctcaaaaaaaaaaaaaaaaaaaaaaaaaaaaagaaaacaaagatacgtaagcagtgtgccatattataactcaatttgataataattataattcactgctaagaacagaactttgtacaaggagctaagtaagacaaaaatagggacccagttttgcccgggtaaggggaagaaaaggaaaggcttcacagaagaggtaaagtttgagctgggagcttagaggatgaataggacttcttcaggaagacaagtgaataaaacattccaggggagagagatagcatgtggattgaattttggggtcatttttctgggttgatcttttttggggcccttttcccctcagaaacatagtttccttcagaccatgcctcccagagtatatagtttctaaatgccctacaatcaaactgatctaaatttttcccctggttacaatgagaggttatatttgctgcattcatgggcagaaatgcggtcagacagtggataagaatattagcatatccagaatggttgtggtacccttgctcatacagcatcttgttagtcctttactgcagcattttccaagtttgtttttctctagcttagcaatacagtagattggagtcttccaggcagccttaagaaatattgatgcctgagtcccagcttcagggattttaatttaattgctctggagtgcagcctgggtgtcggatgtttcaaagttcccaggtgatcctgagtgtagccaagattaagatctgtgctttagaaatacctccatgtttctgtcttctccaataaactgtggactccagtagggagatggggatgttattctttttctccatgctctacagcttccactgaagttctttacattaataattgcttattcgatgtttactaaattggatctgtaaggacagagaactgaaataaatgactcttactctatgtgcctctgctaggagaattaaatgcacatagaaaatcactatatattctcagagaggtgaaacattggggattatggtgataggggaaaacatgactcctgataaaagcagggcaggtgaaactgaagctaccaggtcaactgctatatgaaacagatatctcatctaagggaaagccaaggtaatttaggtgtcctcagacaggttcttgcactttcctcccagaaaaaagtctgccatattataactaaattctagggtcccaaagtaaagtttcagaaaggcctcccctgctccattaatttagataaaaatatatcttcaagggggtgtttctgaaatataagatctggttaattagtaattctgttcagagccatccatatgcagtaattttagcagtgacaagaaaggcttcttcacctctttcctgttcgacctatctcttcccagccagttctgagactaccatttgacatactcccttggctgaggtattgaaggtccttatttatctctacctatatatgatctaaaagaggaatcattcatttatcctattatctacttctcacccatccaagctttaagattaatacatgagtggggaaaatggtagatgggttgtcatagcacagaactgggggccaggcatggtggctcatacctgtaaccctagcactttgggaggctgaggcgggcggatcacctgaggtcaggagttcaagaccagcctggccaatacggcaaaaccccgtctctactaaaaatacataaattagccaggcgtggtggcatgtgcctgtagtcccagctacatgggaggctgaggcaggagaatcgcttgaacccgggaggcagaggttgcaatgagctgagatcacgccactgcactccagcctgggtgagagtgagactctgcatctcaattagaaaaaaaaaaaaaaaaagaactggggactggttacccctgtaatgatgggatcctggggcacctgggaggagaatgtaccctatcactttgctttgtaatttttattttgcatgtttgtctcccccattaggttatgagttccttgaggataaggactatgtctttacttctatatccctggggcacatagctattaaaaaaggtttaatgaatatatgaatgggtggatatgttagtaaaaattatccaatacttgaaaataaggcaaaaaaggacatatactcttaagatcttgctgggacattcttaaatgggcctctctctctgggagaatgtacctgtgcttgactttgctatttaatatttgactagagctgagacattgtgaagatatttatatgttaacttgtagatttctttctagcagaaaataataaccccaaaggttatggacttactgccctctaggacattagccagtttagtgtttacctagcaatcttatgctgaaattctttttaaaaaatgcctataaagatgcattcttcaaatgctcttggaaccagctttattatatcattggttccttcggtattatgttaataaatctttaacatatgttcattcaatatttgtaaaagtcatgattctaactttttgaaaatcatactttgttggatgcaatggatggatgaatgactggaagctaataagagggagcggaggaccacagagaggaatggggcatggatgacaaactttgcttcacaattctgcatcaactgttggataggttttttagttagtctattttttaagtctaaaaataccctaacaactaactttttgtcctcttgagattataaagattcacaaacattctcacaaggtataaagaccatttttatttcttgagatttgtttaaaaatttaatgtcaaacaagaatttttataatattgattttttacatgatttggttgaaaaaaaaaaacagaaacattttctgtagaatgggaagtatctgctggacctacatggatacatatgggtatttactaatgagcagtaagattacaatcatgacagtagttatagcattaatactaccaagagttaatacttatttttgtgcttactatgtgccaggcactttatatgtgtaacccctcaaagtaggtaaaattactggccttgttttacaaatgaaaaaaactgaagttcttccccaaagtcataccgttggaaagtggtcactccaaagcccttgctcttaactaccatcagggtttcctgaccagtgagaccacagagggctggatctgaattcagagagtcaaattggctgtacatgggtaagtctttcttgactattcattcaaagagaggaatacaaagttattccctatagcctcttgcctacccacagatacatctgttcaatatgctagctcagaaatatgtgacatagtgaacagttttaaaaaatgatcactcccacaacgcactgcacagaagcttagcatcaaaagtgcgccagacatgctggcctggagaaatagcctttcttcagaataaagagtgtgagagtattggcatttcaacatgctgcataattaactgttgccttttaaacagaatgaaagcagaattctagacttcaatttgaattgaaatgaggaaaaaatttgatcaattgtattatcccaagtaggaaattatcttttaaaattttagttgtttaaattcaagaaataccacggtacggagattttaaggtaaacccttcattgttgtgtaggcttgatttgtttacatgtgaaaatgagaaatgcctgtaacactagtgggctgggactggcttacatagggaaccctgagccaactgtatatacatttcttcccaactccaggctcaaagacatcatgttggcatcatgaagcagccatggtaggagtatggcaaacaccaaaaattgaagttttgtttttttcccccctctgcagagccagttgttaaacatttacccgcacaccacttccagtagggcagggctttcagggcagcctatcctaagtcctgaacttacacacattgctgaacttaaaaatggctcaggaggccacacaagctcttctgaagcttcctaactgactctcttgctgtgtggccttgagataaagactctggtgtatgtgtgcttgtgtgtgttttatagagatgaggtcttgctatgttgtccaggctggtcttgaactcctgggctcaagcaatcctcctgccttggcctcccaaagtgctgggattataggtgtgaaccaccatgcccagctgagaaaagactgatatgaacattaggtgatttataaaactacataaggctaggtagccaccagcatgactgtgtggggtaacaggaaaatcagagagggtgagacatgttcttacaatgtcgactcagatgaggttgctagataaaatacaggatgcccaggtaaatgtgaatttcagataaataacaaataatttttttgtaaaagtatgtcccatgcaatatcccatgcaacattttactggtgtcctgtattttcatttgttaaatctggcaaacctacacccagaatgtaatcttctgctaaaaaaatctcatgttttaaatctcacagtgtaggcatactgcaaagtggatatgtatgtaggctttgaagtcagttgcatcctattcctgtcactcactcactagctgggtgaccttgggcaagttacctaaccctcttgagctccagttttcttctgtaaaatgaagatagtcagttcctatctcatttgattattataactagatgagagaatatacacaggacttagatgagttaatacatgtgcatctgcctggtatgaggaaaacaacaggtgttatttttatatacagttctacaaaacacctagttctgtgtctggaacaaagcaactgcttcaaaaattagtcttttaaaccatatgacaaacaaattttagtaaccatattacacatcacatactatagtaataatactaacattggtcacataatttagctttgtcaagggtaaatggcttttgtgaaggggcctgggtacctaatcatcatttacaacaatgtttttaagggggaaatcattgaggccaaataaataaacacattttctccaagttgtggatgattttatgtgacatgttgtccagatcaaactttttaaggtatcctacatcaaaatacataatacaactggattgaatacgcctttttcaaaagcccatagaatctattctgcttaaattatttccattagaggctgggcatgtaatctcagcactttgggaagccgaggtgggcagatcatctgaggtcaggtgtttaagaccagacaggccaacatggtgaaaccccatctctactaaaaataaaaaaaaaaaaaattagccgggtgtggcggctggtgcctgtaatcccagctactagggaggctgaggcaggagaattgcttgaaccagggaggcagaggttgcagtgagctgagattacaccactgcactccaacccagacaacacagtgagactccctctcaaaaaaaaaaaaattgtttccattagatattttaaataattgcaaaagaacctcacaccaatgaaaacagagcttctttccaccacctgaaactcctggtgccacaagcttataggcctggaattttctctactggtctttttcctttcctccttttatataatatatataagtattcctccataataatccagctctgtacctttcaaactgtttcctaactggcatcaagcagtttctcaagctcagactgggtatattttctttttgtttggaaactcgatatgctttcatgggaacataatttttttttaaacagagatgttttcaaaacagcttcttctaacttcacaaaatagcttaaaacaaccatgaacattcctggctcagaaattctgcctatgtagatttaagggactattactctcctatcacatttgcctctttctttacccttcacatgaattcaaaaaatcaacctctctcacaattacagcatcatcctttaaagtgaagatccctattaaaatataaatgtttcttaaagaccagttgtacatttttttcagttttatattttatcagtagtgatttctgagacctattcattctatctctgaaatctacgattagtgaaaatgaaaacagaagagatgccaaaagcaaaagccgtgaggaccatcagtaactgagagaattaagatggggtgtcattatgagaagggccgggtgaagggtgaaaggtgaagttgaagaagataaacttcacctccttgacagttttgtgaaggaatggataaccactggtagctaccctacccaaaggaataaaacagaaaggagcctgagctttaccccacatgaaggtttaagttgaccacaggctgcagtcctcccctaattccttgtaaacaatgttgcatgacaaaaatgttaggtcgtgttggcatctctttgggggtgaccacccccacggatgtataaagaatactatctaatatttctcttcccaactgctgcttagtagcttagtagagttccgtgtatacaggacacagctgcaggtttaatactgaacttccctacctccctacattcacacaaaatctgaaaagtaagatacaatgtaaaaaaaacaagtgcaaaaaaatttcaccctggctgggtgtggtgactcatgcctataatcccagcactttgggaagccgaagtgggtgaatcacttgaggttaggagtttgagaccagcctggccaacatggtgaaaactcatctctactaaaaatacacaaattagccagacgtgatggtgggtgcctgtaatcccagttatttgggaggctgaggcaggagaattgcttgaaccccggaggcggaggttgcagtgagccaagattgtactactgcactccagcctgggtaacagaacaagactccatctcaaaaagaaaaaaaaaaaattcaccctaagaaatgaccattttgttatgatggcatatgcaaaatagtcttcaatcataacatttatccattttttaaaaagatcacttagtgtggccagagttgtgttcattgctggggacacagacattataataactagacagacaagatccctgtttttatggagcttacttctaacatgggaaacaaataataaacagctaaacaaataaaaatgtcaataattcagaaatgattagtgctatgtagaaaaagaaaacagaatgagggaccaagaattgacgggaaatggaatggcagatggctggttagctggttacccaatgaccattcccaactcctccctctcctgcctcttaagaggctaaaaaggtaagataataatttccccaccatccctttcagttaggtgtggtcacatcaatataatcttcttctggccagtgacaagagaaagtctcctggcagggtgttgggaggttcttggaaaaatgtttcttccttgataaaaggaaagaggtgtgtagtgagtattctcatgggcctgactgcctctctgcttcttgccactgtaaactgtcacatgaagatgtcagggcactgggtggtatcttctgaggtcaggggaagtcctgagactcaccgggacatagtgccctgacactgtggtgctgctaggacactcacctccagacttactaagtaagcaaacaatgtctttatggcttaagccactttgagttttgttactcatctctgaaagcaccctgtctgaaacagggtctggttttagatggagtggttagagaaaggttctctgaagaggttatatggcagctgaaaccccaacgacaggaagtccgccataacattcaggcagaagaaatgatgagtgcaaagaccctggtgtaggaatgagcttgttatgtggctacagcatatgaataccaaagaaaatgatacctgatataaccggaaaggtgggcaaaggtaggatgacacagggcattgtagggcatggttttagtctattgaaggaaaattcatcgcaggtttcaggcaaaggagtgaaatgaatatgccattttttttaaccccctcacgcacatttatgttttaaaaatacaactttagttgctgtgtaggtggccaagcatagaagcagggagaatagttaacaggctattacacccagcactttgggaggccgaggcaggtggatcacttgaggtcaggagttcgagaccagcctggccaacatggcaaaatcctgtctgtactaaatatataaaaattagcccagcatggtggtgagtgcctgtaatcccagctactcgaaaggctgaggcaggagaatcacttgaacctgggaggcggaggttgcagtgagccgagattgtaccactgcactccaacctgggcgacagccagactttgtctcaaaaaaaaaaaaaaaaaaaaaaggctattacagcctgggcaacatagtcagaccctatctctaccaaaaaaaaaaaaaaaaagtaaaaatttgctggttgtggtgggaggctcccagctacttgggaggctgaggcaggagaactgcttgagcctaggaggttgaggctgcagtaagctgtgatgctgtgatcacaccactgctgatgatggtggcttagaccagggtgatggcagtgtaggtggagaaaagtagatgaatattgaaaatattatggagacagagccaacaagattagtttatatgtgatggggttagggaatggggatgacccctagttttgagagcctgagagcaagagagaaaaagtttagggagcttgaaatcagtaatactactatacacaagttaaattcccactagatatccacgtagagatatcagttggctattgaatatgtacatttggaaaaatctcttttgaaaacctgtgcccatttgaatcaattcattcatcactccataaatatacactaagatcatactacactccagaatgtactatgttaataattagatatacaatggtaaaccaaactgtatccctaccctcatgaagatctagtataattagttgtagaggggtagagagtagtaaacagataagaagaaatgaatgtattaagttgtagtaagtccaatgaaagaagagtaggctgctataagagagcatggtgaggaccctcccctgggctggggtcagggaggcaatggaagcagcagcagagatgatgaagaatggctcatctaaggtagaccctccaggacccctgctgctgacagatgacaagagagtctagccaacatgccgccttgggtcccagccgtgttccaggtccttaacaacgttctaggctccttgaggcctggacttaggactgttgtgatagtctgttgtcctggaagcaattcagaggtttttttatagacaaaagaacctaaatcatcacgtggggagcaggttagagagaaagagggataagtggagccgagaggaacaaagtatccccatagattttgttctgtgtaagaaccccaggacctaggaaggggaagagagtctcagtaatgtttgccattgatgttcccatcagcctggtaggatagagccttgccgttatttaaaggaaataatgtgagtagtaggcagaatggttccccaaagatatccatgccctaatccctggaacctgtgaatgtgttatgttatatagcaaaagggattctgcataataattaaggttatgaaccttaaagtggggagactatcctggattatccaggtaggcccaatctaagcacatgagcccttaaatgcagggaactttctctggcagcagcaggagaagtcagagagactccaagcatgagaaagaattgacatgctattgcaggctctgagatgcaggggcccacatagagggaccaggatgaggcctctaggaggtatgatggctcccacctgatagccatcaaggaaataggatcttagtcttacaaccacaaggcaccggattctgccaacaacctgactgagcctggaagggcagtcaacctcagagcctctaaaaaggatcacagtcctgctaagatcttgattttagccctgggagactctaagcagagaactcagccaaacccacccagacttctgatgtacagaactgtgagataataaacagtgttatcttaagccactaaatttgtgttaacttgttacagcagcaatagaaactaattcaatgtagcatttcttatataatttaatttgagtactaaaattcataccagtcattctatcaccttctaataccctactagcacctgaaatattagaaaaccaaaaatcttaaagagtatagtgctttctacttcaccttacacattgggctgggggctaagaaacctgggttctaattctgattataagcactgaacaagtcaagagaccccggtcttattttttatttcagcataaggaccttaagtaaatcaacctccttgaacctctgtttccatatctacaatatgcatgagttggcctagatgatttctaaggtcatttcagctctatgagcaaaaagtgacaggtggacattgttatctgagatgagctaatttaatttataacccaccactttcatctggcagagagctcatcctgagagtgcattttgatgggaggagagggaagttgtttagggctgctggggcccagcactgagagtttttgatatcaaggatcagtagcatgggtctccaaaggaaagatgaattttacctagggtccagcccagctttccacagtaattatcctagatgtgtcaacaacttcttactgaagattccttgcaagaagtggtctggtcaaagaggacctgccacctgtgtttgctttccattctatctaataccaaacctctcagagaagagacacatttctagaacccccgagtgtcctctgtcagtttctacacgtttcttcccagtatgaggtctttcaaattctgaagaaaacaatttggccaaggaatttgcacctcactaaattcaattcactacagcaaacattttttgaacacctgctgtgtgctcattgagttagtgggaaccagttgttttggaggtaaatgtttggtttcatttctaagttctgacttcagtatcaagaggcaaagactagacttactaaagtcaaagcaaagaacaacgaagtagttgagatttacagctatttgaaaaggaggtgaaggacttgttaagaagcgagtataagcactgagcaggaagttactaagcattatttctcaggagcattcaccttctgtctcacatcttattcacatcaacattccgggtaaattttgatctgtaccactgtcctcagtcagggttttctagaaagcaaccttcaagtttatgaagcagatgttaattttttttttttttttttttgagacagagtctcgttctgtctcccaggctggagtgcagtagtgcgatcttggctcactgcaacctctgcctcctaggttgaagcgattctcatgcctcagcctcctgaatagctgggattacaggcatgtgcaccacgtgcagctaatttttgtatttttagtagacatggaaaatgaaaaatgaaagtctttccacttatatttgtatatttgctctattatttgagaattttcaattctgcgttacaccatgttggccaggttggtcttgaactccttgcctcaagtgatccacccgccttggcctcccaaagtgctgggattacaggcatgagccactgcgcctggccacagatgttaaatttaatatcgcattaacatgtattttttcatggacaaattatgtgactatatgaaaacatggctgaacatgtattttcatatatttcacatggataatatatatattcagtatattagacagtttataaatgatcatttctcagtgcttcttaattcaatcctctctgcatttcagtaatcgttgactcaaatcacctatgctggctaggcagggtggctcacgcctgtaatcccagcactttgggaggccaaggcgagtggatcacctgaggtcaggaattcgaaaccagcctgaccaacatggtgaaaccccatctctactaaaaatataaaaattagctgggcgtggtggtgggcgcctgtaatcccaactactcaggaggcagaggcaggagaattacttgaacctgggaggcggaggttgcggtgagctgagatcgtgccactgcattccagcctgggtgacagaacgagactctgtctcaaaaaaaaaaaaaaaaaaaaaaaaaaatcacctatgaagcaattttcaacctttcttcttcagagacacatcacaaatgtgttcatatgtgtgatatacccccatatatccagaattatgtgcaattctaggagctcgacctgtaattccaaccctttaatctccatctaagaaatcatactgaaaaaaatattgttatgtatatacccttaaatttattccaattaatttaaaaaaaccaatgattatttattagtaagcagttatttgcaacatgctctgtttaggacatagcaatatattttgacacctttgttgatatgcacggtcctgatatgccacaagtataacatgaaatctaaattcttgaaggctaaggtgcttggcacagagaaccagagaaaggtaataagagagaaaagtgcacttattctctctgctgggcaactgtgagcttataactagttctccgagtctactaataagcatttaataagaatctactaatgagcacttttcttgatccataaagtcactattgacattccagcaaagtttcacggcctgcccccaatttgaagatttatttctctctttggatatagaacaaaataactttatgtacattttatttcactttattttactttattgggttggtgcaaaacaaattgcagttttcccatgaaaagtaatggcaaaaactgcaattactttcgcaccagcctaatattttattttgagacagagtcgcactctgttaccaaggctggagtgcagtggtgtcatcccaactcactacagcctctgcctcctgggttggagagattcttgtgcgtcagcttcatgtgtaactggaattacaggtgcacgccaccacgcccagctaatttttgtattttttgtagagatggggtttcgccatgttgccctggctgttctcaaactcctgacctcgagtgatctgcccacctcagcctcccaaagtactgggattatagacatgaaccaccgtgtctggctctttatgtgcatttttaatatgaagaggctatatagtatggtggctgagagcacaggttctagactagtggttctcaatcagagataattctgcctcacagtgaacatttggaaatgtctagagacatttttagttgtcatgtctgagagagggaagtgttactgacatctggtaggtggaagccaaggatgctgctaaacattctacaatggtttgggcacagtggctcatgcttgtaatcccagcactttcggaggctggggtgggagcatcacttgaagccagaagtttaagacaagcctgggcaacatagtgagtccctgtctctatcaaaaaaaaaaaaaaaaaaaattagccgggcatggtggtgcatgcttacagtcccagctccttggaaggttgaggtgggactatcatagacctaaagggaaaaaactaacaagcacaagatagggtatgttagccctaggagtttgaacctaggagtttcaggctgcagtgagccatgagtgtactactgcactcgaggttgggtgacagagtgagaccttgtctctggaaaaaaaaaaaaagcccaaaacactacaatgacaaggacattccccgacccccaccacgacaaagaattatctggccccaaatgccaatagtgctaaggttgagaaagcctgctctagagtcagcctgcctggggttcaagtcacttataatctgtgtagctgttggtaaattattttacatgtttgtgcttattgggtgtcttcaacaataaaattagaataaataataacaatactcactttattgattttctatgataataaaataaattacacaagaaaggagctaaggacaatgtctggaacaaagcaagtgctcaacaaatatttgcttttgctttcattatatgcattgaaaaaaaattgagaagaaatacaccaacattttaacagtgattgtttctaggtggcaagatcacaactgatttttattttcattatccttttatactgctttatattttccaaattttctagaatgatatttgtattactctaatatccaaaaacatgttttaaaagaatgcagataaaagaactttatttgtgatatagtaaaaagagcacagaattaaaaagacctggattcagatcctgactctacctgccgtctgtggacattgaataggtaagttaatctctttgagcttcagtttcctcagctaaaattggggctaataatgcatatcatagagagttgctatgagaattaaacatgacagacatgcagtgtctgggagagtataccaaaggaaaggctccaggagatgactgctttaaaggtttggccaagggaaaatgactccacaaacagggaaacatattcatgatggtaactgcccttttgccttttattttttgttttttgagatagggtcttgctttgtcacccaggctggagtgcagtggagtgatcaccgctcactgcaccctcaacctcccaggcccatgcaatcttcctacctccgtctcccgaggacctgggaccgcaggtgtgtgccaccacacccagctatttttgtagatctccctatgacttttttttttttgagacagagtcttgctctgtcacccaggctggagagcagtggcaccatctcagctcactgcaacctccacctaccgggttcaagcgattctcctgcctcagcctcccaagtagctgggattacaggcacctgccaccatacccagctaatttttgtatttttagtagagatggggtttcagcatgttggccaggctggcctagaactccggaccttaagtattctgcccccctcagcctcccaaacagctgggattacaggcgtgagcaaccatgcctggcctaaggtctccctatgtttaggctggtctcaaattcctgggctcaagcaatcctcccgccttagcctcccaaagtgctgggattacaggcgtgagttatggcactcagcctccctttttctttttaagccatcctctcagcacaactcccatgtcatccaattttttgccttggctgatggagaagaaactacgtccacactctggtccttctctctcctctcccctccctacatacaccctaggaagggatctgatcattcccctggcaggccctgactcatttggcagggtttacttgcaggcaagctgttgtgtccgaaaggcaggacccaggtatcactttctcatagtctttacccatgctcattgtccctcttcttatttctgctttcacccctcacctctaggttgaaatcatacttggcaaggcctctcctcaaggggaagcctctccactttctctccctctgttctatcctcccatttagctggttgagtaggttgcccccttttagactccagagggatgtgtaggaagcccagctaggcttccagatccatgcctcatgtgtgtgctagccctgcttatctgagaagccctgcatgtgtggggggcatgtagcacttgccagctggtttgtgcttccgtcagggctgttgtctgttttgtgcagctcgctcagcaggtaatgtttgaggtgagcagcatgagctggtagaattcaaggacacacactttatccacaaccccttaatgatttaattagatggaaaaatcatagattatgtttgtgtatattatcaggagggtgactactttaagccttactatcttgctaacttgaatttaaatcctgaccaagctttcaaaatgccccaggaaaatcttcttcattcaggacaatcttcttcaatcatgccatggtttgggaaaggtagtctgaccctaacccacactgatactcaagatcccagagttccctaggaaatagtcctgcagtcctgtgagctttctatacagagttctaaggactgggagtcagactggattaggagagaattgcctgaggcaggagttgacttctcaagacattcactctcaaactgaattaaactgtttcaacgctgggagatggaaccacccaaaacatcagaggaaaataagactgttaggggtgcttccatttagatatgaatgaaaatatcaggagaacttcattctaaatataaataaaaatgtcagggggattggtgatctccaggaaataatttatgtatactttctaaactgtaatttgtagctgctccagggccagcctaactatataaacttcaggcataattttgactgttgccaagttcttactacacatgtgtctcctcactgtcctctctataaatacatgcaaaataaaacaggcatggactcccaaattggcaccagcagaatatgtcattgttttgagtcttctcagtcttcattcacaagagtatattgagagttcaccataaaccaggcctggtgataagtgctagaaatccaaagaggaaaggataccatccctcaagaagctcacttcatgtgactataatagcatcaaagtgttacttgttccagaaaaatgtagatttcagcagggatcaaatgcttaagctaaaagactaaagttcaatattgtaggggacacaattacgtcttaaagtactgcgcaatgaaaccctgaagggaactggtaacttttcttagtttttccatagcttataggaatcagatcagtcatcttttattatcaaaggccagaaggaaatctacacagatcaaaaaaaggaaatctttatacctcagaaatttctagcagttaaaaaaagttattagcaaatctcctcttttacccttaaaaacctaaaataatttgcaaaagatacctattcccttattttaggtataatatcattttaaaaaataaatccagtcagtttgatattataatttatatacatagttttagaagtttttaatctattttattttgagaactaggtaggtgcttttaaagaaaatatgcttaggctggccttgctaggttctaggatggaagagtgtttctacgttcgattttttaaaaaacccatgatataattctagatttcttttttcttgagacatcaattggtcaccatagtaacatagcgttttactacagagatctatacagcacaagggaaacagaacggcaattacttactgggttacttgggggtacagaatgtgactacagggataatttaagattaaatatagatttctttggggatctgttttagcaaagcaagctgattcaatcttctagtagcgtcagctgaacaaaatttgaagccaaattgactgctgacatcatttgaaataatatgagcaggcaagcagcatagctcagtggttaagagcacaggctttggggtcaagtttcgtaggtccaaattctgcttctactgtttgctagctgtgtgaccttgggaaagttccctaacttctctgtgcctctgtttcttcatctctaaaatgtgggtaataaaaccttcctcaaagggttgttataaggattcaatgactgtttgtgcttagaacagtgccttgcacattagaaagaactttcttaagtatttgttaaataaagacaaaataaaatttaaaggggctcctctctttgtgctgaaaatagtcaaagacatgaaaatttgagttcacggctgattattttagcctgtaactttggtagattcctttgagaacttccccagggtcttgttgctagcatttctacaagatgtgaaattctgtggcagtctactgtcctaaatcagagctgggaacaatcacaagcacccctggttccaggaacatcagaaggaagatgatcacacagcacaaaggaacagcacgcctgcccacttcagctccccaagccctgccaataacctctgggaacatgggcatagaataagcagctgaaaaaggatgaaacagcttttattacagtgatgatgaaacctagttggtttcggtaattttttcccctctttccaggcttcaaggggaaaaaatccttttcatcaatgagtgctttgtttcattaattatcactatacacaatttccatccaatttttcaactgacacatactctgatgaattttcattttacagaactacctaggcatcttttctggactggtaacaaacctaaagcctctaaccagcatctaaggcaggacaaaatctccaaattgcctggaaaaaaagaaggcattatgtcctctgagccaaatttcagtcgcaataccaagggatccctatcacataccttcatccggacttgatttcagagacgttctctttagatcttcttggtcaggaatagcccttgcataggagtttggagaatgccataaaccaccaggaaagcctggaaacacattcatttctgtcctctgccttccccttggctcacagcctgcttcctgttagggagacaagatgacgctgtgcagggtagactgttaaaccatcttcccgcccccagccccactctcttgttgcccctcccttctcctttccaaggctctggaatgtgtcacatgggaaatggatcatgtggctgaaggggagaatgtggccatcttctccctcccttcccccacttttcctttcaggagcaaagcagcagaaatctctgtcttgattggctcagaccaaaaatctccatatgaaaaggggaagattcaatcacccaaacctccttccttctctattttcttttttttctatctgaagatttatcctgaccattcagagttgctcagtatgggagataaatgatgctttcttaacctcaacccctctctttctttcttacagtcagtatcctgacctggcaaggtgttccttaacctcccctctggatcccccttagcacacatctgggacaatggagcgttcagcaccacggacagcattacaccctcttcaagtgcttgttaaagccatttgtctatttcactctcaagtaaataaaaatattttttaaaatttccctgaggtcctgtgcctaaacataaaccacaccatatgtttagggctctgacttcccctactatcagcttactgttaccttataaacacaaacataattttcaaatttccttaaacccaaaagaccatcccatacctacctccctgtccccatcccatcacccatcctcactctttaaatatggtcttttttttttttttggtgggggggagggagattcctgtaacatagtttactgcatgcccaaatatctatgcttatggggaaaaccacagaaacacataggaattctggggtgtacaagtctagatgtcattagccccatccctaggcctcaggcagggctgaactggagaggcagggagggagcctgcttggagctgttttgtgcagggtctatcctgctttgctgacgtcctagttgccatggtgctaggtaactgctgaagaggatgatttcttttaaaaccggtcgccatgggagcctgctgactaaagaaaggaagagggaaaaggactgaattgctgaggagggatttaaacagtattctcagagccaaattggattgctgtcggtcctaaatcttgaaaggaatctaggaattagtatggacactgcaatagttactctccccatcctccactgcttctttccttaaaaatctagttaggtgcaactgaatgaaaattccagcttcacagattgaccctgaaatgccatcacagggtggtggaaagaactcaagaaatcaatttctcctcaggttagaatatctgacttttgggaagccattatctaagtcctaacagccttaattgggagatactttagagccacacctgactgtcgatgctaggaacaatgtgtggattctttataacactatggaagaaaagacaattttttaaatgtgagttgtcaaattattttaaataaatacaaattttattaatacttggatagcatttggattactccaagtcagaaatacaaactggctatacatttgtctcataacactggcatataacttgttgtttctaactcagaatcctaaccaaagcaattcagaatatttattttttgaaagacgaatgctgacttgcaatgtgtagaaatgaaaactttgtaagcaaagaggtggcacaaggaagctggagtataattttcaagaaactgaaggtccttcctggatcaacatcctcatcgtattttctacttttattttaggaggagtgaggttaattctagtttttctatgtaagactcagagaaattcaactgttaattttaacacttgacattttaagaaaattcatttatcaaaaaagttagatattgaagaaattctttgagtcagcaggttggtgacttggatatcatctcctctcttagtcaagaataattacaacaataagaacaactaatatttaacatgtgccaggtgtttacatacattatgtcatttaatcctatcaacccaacaagatgagtactattactggcatttctgttttaccgatgaagaaatggaggcttgggggaataagtaatgtgcccaaagctgcatagtgtgggagctaggatttggaaccactgactcagcctccagagcaggcatagtgtactatgctattctgcatcatgcatagtagactagattaaaataactggtcaatttaatgtgttgtgacttactactatggccccttgacataagaaatcacaaagattgctttaaattatttgagacaaaaaaaatgaccaacatatttattccttccaggatgactgcatgtatatattatggcttaatgatatttaaaatcatcttgtaaggagtcataacccaaaattttattaaggatggtcataaaacatgttacataatatactaattctgcttaaaatatattgccaaagttataatcaccaaatttacttttgacattggaagaagataaagaaacagttgtcttccatccaaatgcacaaaattccacaatacttgtgcaactggggtaatattttgaacatgagtaatgtgatcttctcatctgcctggggaatccatttgccttggagatagtgttttggcactgtttagatgttacaaaaggaatggaaaaaaagaaattaatatttggcttctgaaattcaaaatagaaacaagacaataggcttgaaatccaggctattgttttgaaagccagtctctaaattcctttatttctgcccttagcttgtcatcaaccaaacctggaagactttgctcagtgttctgtactatagacctctggcttcaggtaaaaactttccaaggggtcccaaagcatgcagagttttatgggaactaatttctagatcctcaacttctacaagtatgcattctaaaactgcttttctgagaactggtgcagtcgagatgtcatgctggttcttggtttccacttagcttttcttccatcttacacagattgctgaatctctcttccacctttacctcaaatcctgcgttgtctgaatttaaaaacctcctggggaccaaacacaggaataactgaaaatattggggatagtactgagaaagtgaatagctccaataattaggtaacaaatccttttaaaaatcaagagctttccaagtgctttcaacaaaattggaaacaaaccactacccagtggtccactgagaaattcattaaaatggttttcttaaaacaacgctcttaccaggcacggtggcatgtgcctgtggtcccagcaacacagaaggctgaggtgggagaatcgcttgcacccaggaggttgaggcttcagtgagctctgatagtgccactgcactctaatctgggagacagagctagactccgtctcttaaaaaaagaaagttcttctttacagaaaaatgctagttaataaatacagactactatagttagaacaccatttttgcaacccccagtgaaataattgactcaggaaaagatcacaaaaggtgttcaaagtataagatgaaaagttgttgaacgggttatttgtagattacttataaagtgcaaagggatgtgtgtcctttttcagtgaagagagtgggagggggggtcatcatcttaaccaagtgaccaaatttagcgttactaatagtgagacaagctgaaattatgtgcctaacatgaaatgatgtaacctactcaatgttactgaagtattctttctaaaaatgtttaacccgaatataatcaaatctgtacatataatgtcgagtttttttttttaataaaaaggcaagggttggagaaacaagttataagatattatgaggaaataattggccaaatcaagaatgcataatattctacaagagaactagcatggactcatcaaaaagtcaaatcatgaaataaaaggctgcctaccacagtgagttacctccatgttgagagcagtgctcagggtaagggatttctgccttgactccctttttgagacaactgcccaagtccctcaaacctcattccttgcatttctatggctgttcaggccaagtccacaatagcatggtcagacacagatatgacaatcaattattctaagcctttctgttctcttgaaggatgatgctgaactaacagccagtaggcctgccacaaccaagacaaggtaaccccacagcaggggccaggggtactgagtctgccaggggaggtggccaatactccctgggagatttgtctgaatccaaaggtgggccacgagttcaccatgagttcaccagctgcaggcttcagcatcacaggacagcatgttccccagggatcaggcagacaaggggtatgtattaggttgttcctgcattgcaatgaagaaatacctgagactgggtaatttataaagaaaagaggtttaattgtacacatttgcaggctgtacaggaggcatggtgcccacatctgctcagcttctgggtaggcctcagggagcttttacttatggcagaaagtaaaacagaagcttgcatgtcacatggcgaaagcaggaccaagagagagagttgggggtggtgccacacacttaatacagcagatcttaagagaattcactcactatagtaagaacagcaccaagacatgagggatctgtcccacgacccaaacacctcccaccaggccccacgtccaataccgggtattacaattcaacatgatatttggcagggacatatattcaaactgcatgagggtgtcatcctggaaacttgaaagtacctcagtgcatactctaggtccagaatgaagccaggaggtaccctctctctcatcagtgccacaaggatatgtaattatacccccacttccccccaaacaaatgaaagtcatctacagaaaaaagtgacaggacctctttgggaggtattatgaaagatgaaacatttcatccataggatactaatactatctaaaggaactgaatgaattgaactatatttgaaacaggattagacactttttttttttcctgtaacctaacaggttgtggtggttttaaaatacatccacaaattctttgatatgccttcaaagaatgcatctaaggtctggctgccacattagattttagatgtgaaacctaatccacctccccctgaatgtgggctagacttagttacttctttctaataaatagaatgtgacagaagtgattctgtgacagtttctacctggctctcaccttcttggattacttactctgggcaagccagctaccacgtcataaggaaactcaagctgccttgtgaagaggcccacacatagcaaaccgaggcttctcaccaaccagcaccaactagccaaccttgtgagtgagctgccttggaaggagattctccagccctagtcagtgaccatacccctagctaacatctcaactacagctttgtgagagacccgaagccagatggcctagttaagctgttcccaaattcctgatccacagaaactatgacataatgtttttgtttgtttgttttcttttttaagctctgttgaacttgatattattcttccaagatattaaactgtagggaattttgttatgcggtaatagatgactaataggtgaaaactctagacaaaataaaggacctacattttcatgagatatctgtagcgagttaaataagtgtctttgctatatatgtgtattcctaatgtggaagatacatggttttattaggacaaaaaacattaagaaggggagaacataattaggcacataacactgttgtctaaggagaaaaatgaatccccttaggttgagatggatttattatgactcagaggaagtgcagggaaatcaagaacaaaaagtggcagccagacgttagattagacaagggtcctgaaagtggtcagacccaaggtagctactgactctctttctctaggagaccacatggtctactgcctccaattctctctgtttcttcattagctgcattcaccagcttctcttgagatcaactagttctgcttgtcccttattgtattactggccccaaaatggctgcccctaaatggtggccttggatctgaaattcacatgtccttataaattcaatgcttctgtcagagtgacccagtctctcaatgttctgactctaaattcttaggaggcagagtctgtttgacccagcctaactcagatacagagccagatccaaacagctgggagaacaggatggagaagagttcccatactatcttctcagcactctctaaaaagggctgttggcaattttgcctttttgtaattctatttgagcaagttggaagtttaattagctttccaatcaaccaaatttctgcattcgagtcttaaccatatataagtgttactgtggcttcaaagaaaatatggattctgaagtagtgggttttgattgagttgactgtttttaaataactctttggattttaattgtgatgcagaagttatagtaacaaacatttggttttgtacagacattatttccacgctggtggataagctcaataaaggtcatatcccaaactaaaaaatataaaataaaataaaataaaaaataaaaaaataaaaagggctgttggtcaattttataaaaggcaaagtcaaacagagggaggaatgactgatagatgaaatgactggtctcttggtgcatctgtttctaaaattccgttaactttccagaatgagcctgccaatagctctggtctaaactcaacccctgtgacctccatttcacctccatttgagtcacctgctgaacaagcatgcccttcacactgcttgtattgcctccgtggcttagacttgacagtttctctgccttgtcctctttgtgaacatctactcctcttttcaaaccctgctgggttttatcttatctgtagttctatttctctcccactctgtatccttccaaaataagttagtcacattttccttttcaccatagtactttaattttcatatatactacttatacgattgcatatgtcatattgcattgacttcatagattcttgtaaggtggatgtcatccaattcatctttatacctctaggatctaaaacagcaaagtaggtgctcagcgacagtgtaccagcacactgaataagcatgacttttgagattaacctaaaaccacctaattttcattttccactgtccctttgaaaacacccttcaagggtgtctggttgcaaggctggttcttctcttatccctgaattaaaacttgggtggtcccattactttttctggtcatttttagttaagagatgttaataactaaaatatccagtcctatataacaatcaaaagttggcacctgacttagtttaggcatttctccctcctcccagtttgtgccttctgtagtagatttaacaaaacagtgtggccacttctcttttttcctgacttgtttccttagatcttgcccctcctagtttctgatccctccagggtttgagaggaggatgagcaatacgtcttactttgttggtactaacatgagctgccatcagtttccctgtacctcacaggtattaaagactgattccttatctcaatgggcacttacgtgggtttagggggacaaaactctacttctatgaatttttcaactatagctcctttgaccagctggccacttatctaactccagaaagacctttagcttttccctgctgaagtctattcctctctttgagtggtcatcttggtcaggtccagtgatgactcgctgctggcttctcttgtctttttttttgtaatattagccaggttaatggcggggttttgccatgttgcccagaccggtcttgaactcctgggcttaagcgatccttctgctttggtctcccaaagtgctaggattacaggcgtgagctactgcgcctgactcaaatttaatttcttgtaccccaaaaagaggcagaaagaaagacggactggataccctcatttatagaaccagaaccccatactggtacaatatgaaagtttctgaaaaaggtccaacaggtatttgatatccacaaagcacaaaagacctaattatagttgttttttttgtttttttttttctccaactgggcttaagcccctttctcctttgctttctgagcaaaagtactactggcctccagcagctgaaaaagcccttaagaaactgaagcattacttgtctttggctctagtcctggctcactctaacccataaaaacctttaaagacagagaccaatctgtctagcattcctatcggtcccaggaagattctctgtcactcatgtgtgcctgcttttcaagaaaaggaacccaattaaagacaggtaacttcatgtggcaaaagatattcttggccattatcactaccttttttgtcttatattcaataactaaagtagtatggtgatttcaacttctgagttatttataaacctagaaaccagaattgtcctactagcaagtaacttgtctcttagaagctgaaattgctgaccatgccacttgtattccaagtgattctgtgttccctgaaaggctacaaagacaggcttgaacctcacctttctcatctgttaataataacaaaaccacttgtgtggtcagagctgccacatcaaccctgataggctaccggaaaacacttcattatcaatgccctgctgcacatgcattcccatgtacagcagcctctcattggaaaagaacacacatttcaatcatgccttgatgccctccccaaccaatgaggtattgcaggttgtaaagatccgccccaacccactactgccatcagccctgctgatggcccaagattcaccatgtgtaatgcaataaagacatcattatctgtgttgcctgtgctagatcaaaagaccagcttgggagactgacactcttctatctctacagctaagcctgtgtatcctggcaattatactaatggctttatcaatgacctttcccaaattagtacgttaaccccattcttatcacagtggccttcctcctgaatagagctcatgatgccctacttatctgcctgtctcaagctctaaacttcattcctccaaacgtgttttccaaaacggagtcttgctctatcacctaggctggagtgcagtggcacgatctcggctgaccgcaacctctgcctcctgggtttaagcaattctcctgcctcagcctccggagtagttgggattacaagcgcgtgccaccacacccagctaatttttgtatttttagtagagatggggtttcaccatgttggccaggctggtctcaagctcctgacctcgtgatccccccgcctccgcctcccaaagtgctgggattacagacgtgagccaccgtgcctggccctagagggaactcttaaagcagtggctctcaacctttgttgcaaaatggagggttttaagaaagtactgatgtctgggctccactcgcagagattctgatttaattggtatagagaaaagccagggcattaggatttttttaagctcccaaggtgattctaatgtgtgggcatggtagagtacctgtcttttttttttttttttttttttttttttgagacggagtctcgctctgtcgcccaggctggagtgcagtggcgtgatctcggttcactgcaagctctgcctcccgggttcacgccattctcctgcctcagcctctggagtagctgggtctacaggtgcccaccaccacgcccggctaattttttgtatttttttttttttagtagagacggggtttcaccgtatttgccaggatggtctcgatctcctgacgttgtgatccgaccgcctcagcctcccaaagtgctgagattacaggcgtgagctaccgcgcctgacccggtagagtacctgtcttaaagctccctaaatacagacggacctacgatgcacagagcatccacaattcaactgataggtggcatgtactttacactaagttctatgctacctcattttgtcattacaataatcctatggcacaggcactattatccttattttataaattgagaaactgagattcagacaggacacacagagtgactggcagaccctaaagtcaaagcccaggtctgattcccaattgtacacactttatatgacatcatatcgagatgtcatgcctctcagagctggatgatcccactccctaaaacaagacacccaggcttcaaccctgaaatcctattccattgcctccatggatttttcctgcagcattttcctatgcacttcacacatacagcgcagctgccaggatatactttaggctgccaaaatgaaatgaagtcactttcttggtaagtgattaccatgcctggctctttactgaagtacttccattctatatattcacactgggatccttctccatcactgctagcttcaatcctgtggctttccatatttagtttttcttacagatgaagtgatactctttacctatcagccattcctttgttggagtaaaattacgtattccatcagcattcttctgccttgtactccagatagtatacaaagaatcaaattatagtagctaagtggcatagaattgctgccgatatcaagatggactctaatatctagtgaactgggaggctagaggctagaagtatgtacttctgtaaggtgtcagtgacacatctgagtaatgtggtagctaaatgccaccatttcattccatgaaatccacatttcattctggctaaagggtaaagctggtgagaggtgggaggggccaggaggctccatcggaaggaggcagacacttcaggtgttgggtggtacctttaagatgttgcggggccaaatccaatgccggtgcaggtgtcccatatatcctgagagacaaaaagaggtcagattggtcagatccctcgagacagttcccaaattcctgacttctgttaccgcgactgttcttcgcaattccacctcggcctgtgttcaggactgtggcttttagaatcttcctcattccattccattaggggcgtcccgatttccaccttatatacaccatgtactaaatgcatgccatttctgcctgtttacaaacatgcataagttcacactcttttaagaaaaatgtcctctactgtcaacttctttctagtctggcctcccaggtaggctacagagctactgccttcatttatctctcaaatcttcccatcttctccttcccactgtattaccttagctcacactcacatcctcttggtcaccagccaaaaaataaataaaactcctttgtcccttcagatttctctcttattctacaacctcattaatcggctctcccgctcccactcctttactacttcagtcgctgaaacctcccctcacagagttcacggccaatataaaaacggaaagaagggatgaccatacgagcttgtggacttttgcctgcaaaatctcatagaatgtggtgttgtgtacgtgaatccatcagatcaacgcgacggacactccccaagggccaaatcggaccgcctctcactaggcggaaagttttgaaacttttgcgcgctaaaaatgatgagccagacgcatgcgcaaacgtgcactcccggggtggcgcttctcctcaggcagatctcgcgtggtttggtgatggccggctagtatgaaggttttccgtggcgttgagatcccacccgcccttttttttttttttttttttttttttttttttttttgctgccccagtggattaggattagtgctgcagtcaaatgaaaaagatcaagacaaaaaattaggctaatataactagccgacaggctagcggcatttctctggggccgaggaattccacgaagaagatctctgcgaggcccagaaggccgcacaactacttcttcagaaacaaaattttttaaaaaagtaaaaatagaggaagtcagccagtttatcaccttggaaccagcgttttgtttggcttttccgcttttcactctacgaaaaagcccattggcggctacccaggttaccgtcctgttgccattgcgcctgcgcggcggtttgtttaccagtccaggcgaagcgctgtgtcgcggttctcgccgccccgagcgccttggtttgctcccttgacgtgtaattcgtaatgaaagtcatgttttcatttgggaacacggatcggaggtttaaaactggacagtttaagtgtcaacttcagaccaaagaaaataatggtagggaaaacactggacactcagaaatcggtgccgcgtcagagctgtcacggaagatgtttctaatgaacctgaggaaaacaatagcaccaccctaaccagaactaaaaagtggcaagcagccacagttaatgaaactcataggtggcatttagttacttatttagaatgtaggcctagttatggtaaaaatgcaaataagaccaaacctaaggtcctcttgctcgagcaaacctcaagcaaaacctacatgatttaagactgactcttgaagcgaagtaaaaaaaaaaaaaaaaaaaaaaaagcagccatgcaaaatttgaaacttggagacgactctagaagcattaacccaagaaagcacaagccaacaaacaaatttttgaaatggtttgaagagctcttcaaagtcagtttcaggtggcttagaagaggatgttgcttataaaatgagatctgatggaaacttgttttacagatatgactggattcgtttgaaaacaaaaaaaaaggcaggcaaagtgactttttaaaaagtatttttatggaaggatttctaatgatacattttaatgtgctcaaaaaacaaccttaaataactggtagattcagccaaacctggatcattgttatcttagagctggataagagcataaatgttaacaatttggcaattttattggactctgttatgtttttgaatggtgaatttgaagacttcaacttgtaacaagaaattttctaaaaggaaagtgggattttcaagacatatgaaattaagcagagaatatgtatggacatgtgaacagatggaaccaaattttgaaagctttgcatgtgtccagcatcggtcacagaaaatccttttatctcaagaaactagcctctggattttctcacgttcaatatgataaaactcagtaaatccagcagcttgaataccttttaacacaaatttgtaccaaaatgagaagtaactttaaaattccgctccattatctagaggtactctgacttggttaaggtaaggtgaaaatcggttttccaagccagtattgaactggcattttcatcatgaagaaaaaaaaaatgcagataaagtgaatgggtatcttgttcactttaatgattaagactaactcagaaagctggcttactttgtcaaggcaaacaaccagtattaaacaaactgaatactctcattgcacataatgagaaggcttgaatgaaaattaagtatgggagtggaagagctgataaagaacagtgacttctttgagactcctagttcatttacatgtgatgaaaattatagtgtaagaatagtaagttgtcaaataaaacatttttcttcactgaaaaaaaatctttggtgagtaacagaaactgactgatggattggtaatttagtctgccccgtgactcagaaaatatacttaccaaaatttccactgtcagtagctgaaaaagttaatcatgccatttctttagccagtattctgggcatactcccctgtgattactctgatactgtaaagtaatgaaaaacctgatgccatctgtatccacatatttatgtgaatctgagttctcgaattattgtgaccccaggacaaatgaaagaaattgccaaataatgaatctgatatgcatccccaattactcaaacttggttaaagcaacacaatttaaccttattaactgaatgataggacatttttttcatgatcgataacttaaagcattttttttttctcaagacggtcttgctctgtcacccagtctagagtgccatggcttgatctcggctcactgtgacctccacctcccgggttcaagcgattctcttgcctcagcctcccgagtagctgggattacaggtgcgtgccaccacgcccggctaattttttgtatttttagtacagacggggtttcaccatgttggccaggctagtctcaaattcctgacctcgtgatccgccagctttggcctcccaaagtgctgggattacaggcatgagccactgtgcccagcccattttatatagcattctacagtcactcctaactaatacatagggaacagtttgggagatagggaatagggaagatgaaaaatttggtttatcacagtcagtatgagcattgaaattagcttaatctccagggaaaagaaagaatgaatttggccaggcacagtggctcacgcctgtaatctcagcactttgggaggttgcagtgggtggatcatgaggtcaggagtttgagaccagcctggccaacatggtgaaaccctgtctctactaaaaatacaaaaaattagccgggcgtggtggtgcacacctgtaatcccagctactcgggaggctgaggcaggagaatcacttgaacctgggaggtggaggttgcagtgagccgagatcgtgccacagcactccagcctgggcaacagagcaagactctgtctcaagaaaaaaaaattgaaaacatacatattagggccaaattgcagggtttgtgtatgaatccctaataagccaaataaattttgcttacttttagctctgcactcaggtcttaagtattgggggtaattcagtactcttgtcatacctaaagaaaggatgtttctgctggcacaggcccatgcctatagtcccagctacccaggaggctgaggcaggaatatcccttgagcccaagagttcaagtccagcctggacaatatagcaagatcccatcactaaaacagtgtttcaatcagagggaagagaatcttcagcacgagaggggaaaagggagaaagaagggcaaatttggtttgtgactggtcaaataatgcccactgaggacaggaagcagatgcactctacttcctgctagggaactctgcccttgcctccatctactggcatgtttgcatggctgacttcattccatttacatctctgataaggagagatacctttatggtctgttatcttcaatgtattaaagagtctattatcatagtcacaagatagctgccgcagttccaaacatcatgttctcatatgaaatgtttcaaatagaaaagagagtatgagccaaaaaaagctttctttctttttttttttttttgtaaagatggggtctcctcatgttgctcctgctggtcttgaacacctggcctcaagcgatcctcccacatcggctttccaaagtgctgagattacaggtatgagccactgcacctggccaaaagctttctccttgaggcctctctcttcttttttctctctctttctttctctctctctctgtccctttattttttattttttattttttttgagacagagtctcactctgttgcccaggttggagtgcaatggcatgattatggctcaatgcagccttgacttcttgggcccaagtgattcttccacctcagcctcccaagaagctggaatcacaggcatgcaccaccacacctggctatttgttgttgttgttgttttgttagactctctcataagggcaaaaaatgtttcccatatgatgttgcagacttccctttatttcttactgcccagaactatgtcatatgactacctttagcttcaagggaggcttagggaagtatgtacagagaaaacaagcatgtttttttaatggtgcactaaaaataacaggacttgtgggaaatatagggttagaagcaggtcactcaaaacctttgcaactttgttagttgagggctataaaaattactatgctaataaaaaatacacaattaaattccctctgacacttgtactcaatatcacagtcatcctttagggccatgctgtccaatacagtagtaactagccatctgtgtttattgaacacttagatgtgatagtccaaattgagaagggctgttaagtataaaatatacacataagattttaagaatttagtataaaaaataatgtaaaaatctcaataaattttatattgattacatgttgaaatgtcacttcaacatttctttttacttttactttttaaaaatgtggctcccagaaaacctaaattgtcgaatgtttctgttggacagtgctgctttagtttcttgaatcctggggcacatgattcttccttggatgtatatgcccttgagggtattaattccaattaagagcagtttcatcaaaattaaaaatccgatcgaggattttgtcttttttatcaatcagttttcccccaatggggtaaaatggttttgcaccttcatttacactttgcagtttaccacagaacttaatgttgtaaaaaactcttgaagccaccaaacaagcctctgtttgcaccaaaggaaggcattcttgcagaattttctgctttttttcttaacatctttatatgttgctaaggttttctctttaattgtgagaagcttgtccctgcttgccccaaaatgttagtgtgctgggaaaaataatgaatgaagcaatgtaatttctgaattatattaacattatctccccatttgttgcttgcccattagctaataatgactatatctggcatataaagcttttattgtgggagataggactgccagtagacaaaagggagagaaaatcctaatcctataatttcaaagagttggtacccaattatgggatattttggacagtgtcctttctattcaccaagttaacatttagttaatcgccccatttgatttactcaattacccctttctcccagctaaaatccattgagttctaaagaaccatttcaaaggccaggccaggtggctcatgcctgtaattccagcactgtgggaggccaaggcaggaggtttgcttgactccaggagtttgagagcagcctgagcaacatggcgaaatcctggctctacaaaatatgaaaactttagctgggtgtggtggtgcgtgcctgtcatcctagctgcttgggagcctgaggtggcagaattgcttgagcctgaagaggtcatggcataatcatggcattgcactccagcctggtgacagagtgagaccctgtctcaaaaaaaaaaaaaaaaaaaaagaatggacaaaggctgtctcttcagtaaatcttttcctgatctctcctataagcattttgcttgcatcatctttttatagaacacatatttggccttatgtttatgttattgtctgatttttatatgtagaataatatttttaatttgcatatgtagaataaagctcctcccactgaagacagtgattgtattttattcacttttcaaaattcctctgatgactagccttatggtttgtacaaattaggcacaactaaatatttgttgaatttaattgtgctgtatcctaaaataatagaatactaatagaatagaatagaataaataatataatatttctaaaatattaatagaatcttattctattaggaatagaataacagattagatagaatatttctaaaattctaaatacaagttggtatttgactcacatctctagtgctttaaaaaagtgcaacagaatactctgtaaaatagtgttacaaagtcaggctaaacatgttagagtatgtactggtgggttttttaaaaaattagtttcagtaattatgattaaatccatggtaaatatagacctgtgataaatctagatccttacggtgatgactcattttaaaagaccctagttttctggatctccattctccttttactcagtgccttctcgttttttttctctattttaaaccagttttcattatttctctgctttgagaatcactcaaaacaaaccagtaagggatgttcaacttaaatctaaaacatcatagtcacatttaaagtcctgagaacgcagcattcctgttaaataatggtcataatgaacttattaatcctggccctctaattacactattctacaccccagtgataaaggtgttaaaaaatgatgatttaattttgttctggtcttttcacttggatgtaccgtatactgacatgaatctcatcatgactgataaactgaacttggatagaagagctgttaggatgacttaagtgcaaaagagaatctaccgtttaggcaatcagtatacagtttccttaaattttctataatttatttcctttttttgtatgatgttccagcttttcccacagagctaggagccccacaaaaatagagactttgtcttatttgtttctggtgcttgtttgtctctgtaactctagcactcagcacaatgcctgacacattgtaggtaataaaggatacatattgagtgaatgaagtacacctggggtcaagtatcacatgttccaaatgagcttggctgaggttagattacccttatattggacgtggaaaggatctattacctaatttcaacttgcctctatgtctgtggcattggtggttgggtaaggtctattgattgtgagacacagtctcactttttaccacaagtagtatatggagtatgcgtgagtgcgtgttcgtgtgtgtaacaggaatcttagccataggacatgaaaagccaaactatgggaccttgaaaggttcgcaggtaaatggtaatcaaagattcccaaggtctgtgaattctagacatctttgccatagaagcctatggcccctcgctctagcacatagtgattctgctggtccctacatgtcttctcaatgcacctgtctgttttcttcttactgtacttcctagttcttactgtacttcctagttctagttcttggcttagctaataaccattttctttcttttgggtagagcagtctgtaccaggccccatcataaaccatagtgctgagttaggagcccaagccagtggcttggagttggagtacttttctcttggaaggggctatagactgtataagttgcatgactgccatgtctaggattcctaataccgtgcactgggagccatctctgggatcttcactagaaccaggtgtacttgccaatcatatctactgggtgctaattacctactttgcggttattttgtttagagcattagattagcttcattggaggatacaaaaaagattaaagactaaatagatttatatctgaagtcaaagtgagtaagtcatagagacagtgtatgtgttggtgtgtatgtggcgggggaagcactttctgaaagagctatgtgtagtggaaaaggatcaagtttaggttgttatcttgactttgcaaccaatcgtgtgtgactatagagaagtcacctttgatcttttgttctacttcacttgttaagggttgtaatacttaacttgactgtatagacaactgttaaaacactatcataaggccaggcgctgtggctcacacctgtaatcccagcactttgggaggctgagatgggcggatcacttgtggtcaggagtttgaggccagcctggccaacattgtgaaaccctgcctctactaaaaatacaaaagctagctgggtgtggtagtacaggtctgtaatcccagctactcaggaggctgaggcagtagaatcgcttgaacccaagaggcagaggttacagtgagccgagatcgtgccactgcactccagcctgggcaacagagcgagactctgtctcagaaaaataaaaacaaaaaatactatcataaaataattgttaaattcagattattgtgtgagtagtgtatgaaaatgatataaaaatgttgaataggtagaatctatgcaaatttagagttcaattaaatttggtggggattaaaactcttgtgtatgcatttagaaaagcagattataaatacagttgtggtttggaatagttgcaggattagggctgacagttctggccttgtgctgccctcctgtgctgtttaaacagcacagcaggtcaattacattcctgcttcatgaatgttccgaattgggggagggtagtctatctcattactaatcctcttctgtcctcctgtggccacagagcgcctaactattttggatgtttctgtttcttcagtaaaggaagggaaggaaaactacttggaaacattctaggtcaaacaatcttatcctgagttatggaaaaaggcaactaattgcaaattgcatttgacattggagatataattgatacaccaatatagaagatccgagcagattatcgaggtttggagaaaaacaccatcattacagcattgggaaaggctttttgtcaagaataaatagaaatgcatcttttttttttttttttgagacggagtcttgctctctaacccaggctggagtgcagtggtgcgatcttggcccatgcctgtaatcccagctactcgggaggttgaggcaggagaatcacttgaacttgggaggcggaggttacagtgagctgagatcgtgctattgcactccagcctggtcaacaagagcgaaactccatctcagaaaaaaaaaattgctgagaatttataataaagccatacactgtttatctggttaataagatagtctattatggtgggaacagaagatgctgttctacagtgattttctaagcagaacatttgccagttgaaatgagagactcacaagcaaagctaattatttgctaattctcttagcatatcctgcaaaaatggttacttttaaagataaggtcatttgtcagcatggcaatttttttttttttgagacaggatctcgctctgttgcccaggctgaaaagtgcagtggcatgtttacagctcactgcagccttgaactcctgggttcaagagatcctctcacctcagcctccccagtagctgggactacaggcatacaccaccacacacccagctgatttttgtgttttttgtagacacagggtttcactatgttgcccaggctggtcttgaactcctgggctcaagtgattcttcagcctccacctcccaaattgctgggattagaaacatgagccaccaagcctggccagtatgataatttttttatgacagttaagaaaagatattgaaggaaacagtgtaaaaccaggcaatgaaagagtagagaaaggcagtcaatatatggcaccattttaatatgcttgcttccccgtcagccagccctcacccctggccacagcctggcctgttgccagactggtttcctgatcagaacccatctaccctctgcttagactaggagtgtgtgtgcataatttattcatgtgggtacacagcatgcataacatgactttctctttttaactcacaccagtcaggctttcacatctttaccaagactcctcttatcaagtcatcagtgaacttgatggccaaatgcaatggtcagttttcagtgtttatcttacttgacctatcagtggcattggaatcatttgatcatgctttcctccttggaacactctctttacttgatccctgggtcacctctctcttggctctcctccactctactaagggctttttccctatctcctttatctagatacttctcatcttgatttctaaaagttgtagtaccctaaggctaactgcctagctcttttctacatctaaacccactcccttggtgttcttatctagtctcatagctttaatatcatctgaatgccaaacatttccaaatgtgtatctccagcacagacccttctgccctgaattccaaactcacatatccatctgcttactcgacatctccatttggatgtctatggacatctcaaacttaacatgacccaaacaaaatctgttcatctctcaatcaaccctatctcagcaactggtcatacctttcttcagttgcttggagtcatcatgaactctttctcacacacacagaccatttccaaatcttcagcaaatcccattggctgtatcttcaaaaaacacactatcaactctctacccttcttttcatgtacactgctaccaccctggtctgaggcccatgacctcttatctggattagtgtatagtctactataatacatggtctccctacttctctcttgcctctttgaaatacttcttactcagcaaagtgacaaaagttacccgaagtcaggtaaaaaaactctatgctcaaggatgatgcacttcaattggcataaaatccagcctttaccatggcttataaagtttacatgattggggtctctacttccttcttctctgacttcatctcctactccccagcccccactcaccatgtttccagcttactagttcccttattgtccctcaactatcccagacacattcctacctcagagcctctggatttgctatttcctgtgcctgcaacacaaaattacatggtccatgctctcattccattcaggattctactcaaatatcactttattgaaaagtccttccttgttcatacagcatctgccttcattaccctccgtactcttaattagttgatttgtcgtgttagcacttacagcaacatgacatattatgcttatttatttgtccattgtctgtcttccacacttgagtgtaagttctgtttcatgacagcagggactttggctatctttgttctctgctgtgtcctcagagagtctggcatctggtgagggttcattaaaaatttaatgaatgaagaaatgaacaaatattaatgtggataattattcagagagttggtcaagaacagcaagtgggtaggttccagttttgttttacatggaagtttgtataaactgaagactaagatcagaatcagggaaaatgttctcctttatgtcttctcaatgtaaaaaatagaatgtagttgaatgtggtggattggtaataaatatgtttattgttccaaattccatattttatttatttatttttttagggacagggtctcgctctgtcgcccaggctggagtgcagtggtgccatcatagctcactgcggggtcaaactcctggcctcaagcgatcttcccaccttggcctctcgaagtgctggcattacaggcatgagtcactgcgccgagcccaaattctgtattttagtagtagaagttgtccacttatgttttaaccatggaaattaaattatgtgtgtgatcatgaatccaaattttgctatttatttcctattcttttttttttttttttttttttttttttgagatacggcctagctctgtcgcccaggctggagtgcagtggcgtgatcacagctcactacagcctcaacctccctggctcaagcgatactcccacctcagcctcctgagtagctgagactccaagcatgtgccaccatgcccagctaatttttaaattttttgtagagatggggtctcgctatttgcccaggctggtctcaaacttctgggctcaaaccatcctcccacctcggcctatttcctatccttatggtcctggcaatgctggtaaacttgcattagttcattacattttacttggaaatgaaaattttcatctaagtaaaatgcctgatgcattttttttctttaaattctgaccccactagattagttttaaacccttcttgaatctaattttttcaaagatgccatttttccaggcatttgaatcccattttccccagagcctttgttttgtgaatagtgcattctaagtaaattaaaccaatgaagccttagtgatataattgcaaacctatccagtcactgcatcttctacaatggattctggactcagcttaagtaggactaataagtacactagtcctagtgccttctctgctctcttttgtggctttggaacactcagttctctatttcagagcttcatctgcaagagtggataatagcatttgcctcacaattgtggtcttatgaggatcaaatgtgatgacaccagggaacctgctttaaagtatttaaagtggctgggcacggtggctcacgcctgtaatcccagcactttgggaagccaaggctggtggatcacgaggttaggagttcaagaccagcctggccaagatggtgaaaccccatctctactaagaatacaaaaattagctgggcgtggtggcacacacctgtaatcccagctacttgggagactgaggcagagaactgcttgaacccaggagagggagaagttgcagtgagccaagatcacgccactgcactccagactgggtgacagagcaagactccgtctaaaaaaaaaaaaaaaaattaaagtattacgttaattagggatgacttgggttcaaccaacagaaactcataacaagctagcttggagcaaagggggggaaattactttataaacacagtgctatagaacgtaaatgtagggagtagtacctcatgaactaatagaacgtaaatgtagggagtagcacctcatgagctaatagaacgtaaatatagggagtagtacctcatgagcttcaggatccggaaactgaagagtctttggttgctcggggctgtctgtcttcctaaaactatgtggtctctcttctctgccccctttgcacatttttttctttcttctgacactctgcagacagacattatctgcatcttcatcacacatgggctgaagatagtgtccttttgtttttgagacagggtctcactctgttgcccaagctggagtgcagtggcatgaacagggctcactgcagcttcgatctcctgggctcaagggatcctccacctccacctgtcgtgtagctgggatcacaggcacatgccaccacacctggttaactttttaaattttttgtagagacggatcttactttgttgcccaggctggtcttgaactctaggatcaagcagtcctcccacctcaacctcccaaagtgttgggattatgggcatgagccaccgtaccccactgaagacagtgttcttaaaagggtactttcaatctcaagtctacattacctcattagtctctgccttacaatttactaattgaagtttctcagacttgattccaaattttcgggagaaaaaatttggctagccaagtttaggtcaaacaaccacctcctctccccttgtctgatcaacttcggtaagggaatgggaacagggtttcataatctgctgtccccccagcagaggttatgggaacagagtctgagaagggagtacaggacaacagagaaacaatgagtgttgcacacctcaagtgtgatgtgaaagaattaagaataccacatgcagccaggtgcggtggctcacacctgtaatcccagcaactggggaggccgaggtgggtggatcacctgaggtcaggagttcgagaccagcctggctaacatggtgaaacctcgtttctactaaaaatacaaaaaattagctgggcctggtggcgcgcacctctaatcccagctacttgggaggctgaggcaggagaatcgtttgaacctgggaggtggaggttgcagtgagccaagatcgtgccattacactccagcttgggcaacaagaatggagctccatctccaaaaaaaaaaaaaaaataccacatgcatccttattcctgtacccgtgtaactgttaatctactcaggatccaacctggccatatgattaatggcacatttgtaaatatggataggtgtcagagagccccaccaatcataacatcccttcacattttgtgtcagatgcttgtctccagtattgtctcttttgccctctttttattttcgttacagacagagtctccctctgttgcccaggctggagtgcagtggtacactataacattgaactcctgggctcaaatggtccttctgtctcagccccccaagtagctgggactacaagtgcacaacactgtgcccagctgttttttaaaaaatttttttgtagagacagggtcttgctatgtaggccaggctggtcttgaattcctggcctcaagtaatcctcctgactcaacctaccaaagtgaggggattacaaacatgagccactgtgcctggccttctgtagccctcttaagggacataccttttcattctttcttttccctggggattaagttaatttcaatgctcatactgaccattgagtgataaaccaaattcttcaccttccctattccctatctcccaaactgttccatatgcattagttaggagtgactgtaaaatgctataaaaagtgggccggtgtggtagctcatgcctgtaatcccagcactttgggaggctgaggcaggcagatcaggatattgagaccatcctggccaacatggtgaaacctcgtctctactgaaaatacaaacattagctgggtgtggtggcacgtgcctgcaatcccagctactcgggaggctgaggcaggagaattacttgaacctgggaggtggaggttgcagtgagctgagatcacgccattgcactccagcctggcgacagaatgagactccatcaaaaaaaaaaaaaaaaaagaccccaaaatgaaaacttatttcttctcccaaatcaggtcagggacccaagttgaaggtggctctgtcatcttcaacatgtggcttccaaggttgctctagtattcacctttccagcccatgagaaaggggaaagagagtggcggattctgagggggtcacatgacaggttctatgcactaggcctggaagacacataccacctttgcttacattctattggaaaatacttcatcataaagccacacctaattgcaaaggagacaggggaatttcatgttgctgggcagttgtatgctcagttataattctgctactgggaaagaaggcaacaatggattttgatggactggatccatcagtcgcttgagagactgaggcaggaggataacttgagcccaagagttcaaggttatagtctctcctacattctccttttctgttacctctcttagttaatggcattattctctcaaatacccaagcttgagtccttaaattcgtcctccctttctccatctctctcaatcctcttatatgttccagctacctaagtaaccaccctgcatttgttccttgctttccatttcctctatagcatgacttaaatccattgtatctgttgattgaataactcatcatcctccaaaattacctccgtgtcagtctctccaggctcatcacacccatcctttactctgccgtcagacactacttccaaacacaaagatctgcttgtccaagacagcctgggcccattaacaggcacctccccactcacagtcaaggctggaagcaccatataaaaagcatctgcagctacacctttgcggctcaggagattatggcagactgcctcctttctctgccaagccctgtcctcctgggctcagggttctctgtctcacacttgaactctgcccatctccccacatcccactggatgaacaccacagtgggactgtctgcccagcttttcatttagccctgtccctagacactgtctgtcatatcaccctcagccccatctcacaaatccaaactccagagctccaacccaggcccagggcccaggcttgcttttgttcaggagacaagtttggacgctgatcattctcttcacttaaagctccatcagttcgcagtacttacggagcaacagattttttagcatgccatccatggccaaccactgtctgatcccatccccacttaccacccctaccaattcatcctcataatcatcttgacattttcttattcttcaagatctgactcatatatcacttcttccatgaggccttcctctttctccttgctttgtacttcatagcatcatgtttttctatgtattgctttctacctctagtttatttatttgagacaatgtcttgctctatcacccaggctggagtgcaatggcatgatcatagctcactgcagcctcgacctgggctcaagtgatcctcccacctctgctttctgagttgctggggctacaggtgcaggccaccaggcctggttccaacctctagtttttgtgcacatggtatatactccccacaggcaaggactctgacaaatatttcttcacttcccacattgctgagaataatgccttggacaataccttacacatggtattgatcactgcttaaaacctcctaatgccccaatggctttccatatcgccaggccaataataaaagccctacctatgcctacctggtcctatctgatctgatgcgctttttttttttttttttttttttaagacagagtctcactctgtctctcccgggctggagtgcagtggcacgatcttggctcactataacctccgcctcccaggttcaagcaattctcctgcctcagccttccgactagctgggatcacaggcgtgtgccaccatgtccagctaatttttgtattattagtagagacagggtttcaccatgttggccaggctggtcttgaactcctgacctcaagtgatccacccaccttggccttccaaagtgctaggattataggcgtgagcaccgtgcccagccctgatgctcctgttaccactccccacttgctccgccctatccaccatgggcccccctgctgttccttgaacacattaggcaagatcccacctcagagacacttcatttgctctttccccagatagctgtatggctgctctctcatgtcttcagggcttctctcaaaggccaccttttttgtgtgtgtgagatggagtctcactctgtcttccaggctggtgtgcagtggcaagatcttggctcactgcaacctccgcctcctgtgttcaagtcattatcctgcctcagcctcctgagtagctgggattacaggcctgcactaccatgcccagctaatgtttgtatttgtagtagagatgagtttcatcatgttggccaggctggtcttgaactcctgacatcaagtgatccacctgcctctgcctcccaaagtgctgggattacaggtgtgagccactgcacctggcctcaaaggccactttctccatgaggccttccctgaccacttattcacattgtgatccttgaaacacttccttttccctctccgcttattgtttctccatagcatttttcacctccttacatagtatgtacttctttcatgtgctgtgttcattttctgtctcctctcccctttttggaatgtcagcatcattctagtttaaatctgtttgtttacttctgtgttcccagagcctaaggataatgtctggcatagaggaggcactcaataaatatttgttgaaagaaagaaggaataagcaaattaatagaaggtgctccgtaaatatttgtgaaattgaattaaaagtgtcagaaggagatgactgtgaaattcccaaagtctaaaaatatgtgagcttagaagaatggtggagttgagtgctgcctcattataaacatcctcgaggaaggactgaaactgtgtgcttgcggtgggaggggcagctgggcaaggaaccgtgaaccttcgcagaaacatttggggctgcagaacttgggtgagagcgctgcatctgggagctggcgacgctggcggcttgctcattcaccccatctgaacacttgtctatgacacaggtgttttctcttaagttattttggtctttgcctctctcctcaggttgtgaagattacagaaatctgggatggcttatgggacgcttctcagccctaagtaggaaaacagcagtgaaaatggcaaccaaaacatcacgcaggactgggggttttggggaaacagctcactttagagcagtgcagtgtagagctttccgtcttttaccagggtccacctttaacactgtttatctgaaaattttccccctggcttactcgcttgcagctgcccactttgcagaaggatggcgctctgatctctacgctccctgttccttcagggactccatagtattttttttcacgcgtcgtcgctactacagcagacgcctgcgttctcattatttgctgtacagatctccggtgccttgactgtaaacaaaacactttagatcattgtgaggtcgatgtaagcacagcctttctgctggcagccagacttcttaaggtggtgtgactgtgacttgcttacttttcgagatcaacaacaacaaagcgacaaaatggtgctcctacatattagttgaaagattcagcatgtgaaggggatcgaagtgtttattttccacttccatataagacatgaattccatgagtaaaatcaaacttctgtggcaaggtgaactactctagaatgtctccatttacatacatgtggtagtttgggtgtttatgcatatggatagatgcacatatatagagttcctgtgttgtctagcaattgttttaaaatttggacaattatctaatttctagggtaaggtataaattatggtagggaggcctaccctaattttcctgttccttttcccccagtctgcagtccaataaattgacagccttaaaagtagaaaaactaaagaggatgagacctcttgcttgatcctaggtgaattcttttctgtcagttaggtaggaagtcctgacttgaaaactagttctgggcactgccccctttactgttctctgggtatcaacccctgtccttcaattttagttgaactagtggatggtgataccacaggctcaagacagctgcatttaaatatcagtgaccacaggccacatcaaggaaacatctgcaggcaacccagggcctgggaaggagccattttcagtcacttgtaagacagcaggacctgcagactacagcacaatcaaactcagacaaaaccctgaaccagtgagaaccattaggaaggaaaggaacagaaaatgaaccaacctgagtgttaggagacttgcatctagtcctgactccggtaccaaccgaatgcatgtccctggacaggaaacctctctgagtctcgatttcctccgtggtaaaaaggagagggttaaaccacagggtcccgagggtcccttccagctgtcacattctggagcgtatgagatgaggtaggcacacaaagtggacaagatgtggctaagaaaacaagctacacatcaagctcatctgtagcataggtgcttaagaaaactttgctgctgtgtaatattagaacggaaggttggtttccagtaaaatgcattaactttggctcaaaccaagatgatgggtaccgggcatgggggtggggaggcagttgaagatccactgagctttgtctcagggcagccctgctcatcgtcctactttaccttccaccacggtgctcaagcccacactgagagagaaatttccagctgcaaaagggagaagagaaacgctggaatactagtatcggacgttaggacatggttgtggtgttttaaaaatcatttcatcatctggagtttgaccccgaggggagtattttcacccttcagccctctgaaagcattcactagcatctgaatattgttctgagtttgttggagcagtgaaatctggtgagagagaagggtggaggaaggaaggagctgttgtatttggcggctggactcaggtagaggaaactgctacaatcccgggaaagaacagaaaagtagaaagggacgagttcccacacgcagccaatgtccatggccttaactgtgcttgggaaggaagatcctgggccaggggtgtaccctcgtttttcaaaactaaacgtgtctgagacagctacaaagtttattaagggacttgagagactagagttttttgttttttttttttaatcttgagttcctttcttattttcattgagggagagcttgagttcatgataagtgccgcgtctactcctggctaatttctaaaagaaagacgttcgctttggcttcttccctaggcccccagcctccccagggatggcagaaacttctgggttaaggctgagcgaaccattgcccactgcctccaccagcccccagcaaaggcacgccggcgggggggcgcccagcccccccagcaaacgctccgcggcctcccccgcagaccacgaggtgggggccgctggggagggccgagctgggggcagctcgccaccccggctcctagcgagctgccggcgaccttcgcggtcctctggtccaggtcccggcttcccgggcgaggagcgggagggaggtcggggcttaggcgccgcggcgaacccgccaacgcagcgccgggccccgaacctcaggccccgccccaggttcccggccgtttggctagtttgtttgtcttaattttaatttctccgaggccagccagagcaggtttgttggcagcagtacccctccagcagtcacgcgaccagccaatctcccggcggcgctcggggaggcggcgcgctcgggaacgaggggaggtggcggaaccgcgccggggccaccttaaggccgcgctcgccagcctcggcggggcggctcccgccgccgcaaccaatggatctcctcctctgtttaaatagactcgccgtgtcaatcattttcttcttcgtcagcctcccttccaccgccatattgggccactaaaaaaagggggctcgtcttttcggggtgtttttctccccctcccctgtccccgcttgctcacggctctgcgactccgacgccggcaaggtttggagagcggctgggttcgcgggacccgcgggcttgcacccgcccagactcggacgggctttgccaccctctccgcttgcctggtcccctctcctctccgccctcccgctcgccagtccatttgatcagcggagactcggcggccgggccggggcttccccgcagcccctgcgcgctcctagagctcgggccgtggctcgtcggggtctgtgtcttttggctccgagggcagtcgctgggcttccgagaggggttcgggctgcgtaggggcgctttgttttgttcggttttgtttttttgagagtgcgagagaggcggtcgtgcagacccgggagaaagatgtcaaacgtgcgagtgtctaacgggagccctagcctggagcggatggacgccaggcaggcggagcaccccaagccctcggcctgcaggaacctcttcggcccggtggaccacgaagagttaacccgggacttggagaagcactgcagagacatggaagaggcgagccagcgcaagtggaatttcgattttcagaatcacaaacccctagagggcaagtacgagtggcaagaggtggagaagggcagcttgcccgagttctactacagacccccgcggccccccaaaggtgcctgcaaggtgccggcgcaggagagccaggatgtcagcgggagccgcccggcggcgcctttaattggggctccggctaactctgaggacacgcatttggtggacccaaagactgatccgtcggacagccagacggggttagcggagcaatgcgcaggaataaggaagcgacctgcaaccgacggtaatgaccctttcccaaccatagaatgtgtttggggccccgctttgcctgctggagggtgttaaccttagcttgcttttcggcgtattctgatttagctttgggagagctaactttattggtcttaggtgttcagtgctacctggcccactgcttgtctgtttgtgacttttaagtcagaaactggagatggtaagatccgataatttccctaacttaatacatcgcggtccctctcactagcaactcctaggtatgtgacaaagttgggatgtttatcaacggtccgcctcctggctagggaaagagctctggggcggagaatgcactttctgttttttgaaaacaacctcattttgtgcccttaaaagccactggggatgacggatccaggattgtgggtggaggtagtgggtttttcatcccctgactatggggccaacttctgccagccattgttttttctaataaagattgtgtgttctttttaaaaatttcccctgcgcttagattcttctactcaaaacaaaagagccaacagaacagaagaaaatgtttcagacggttccccaaatgccggttctgtggagcagacgcccaagaagcctggcctcagaagacgtcaaacgtaaacagctcggtgggttgatcactaaaggagcacgcactggaacccggggccttcagacctcacgatacctgatcttactggttgctggcaaattaaaagcttatggggttttgttttgtttatacttcgtgaggtcaaaaaagtagcaatggggaaggctggggatacggtaattcctcagagtttctatgcccagagatactttctcttcaaactgttgaccagagcagctacttgtaacccaggccccatcgggtaggaaggtcgtttccctgtgagtcccactaaaacgtgttgggagcaataggttctttgcccatccgaacaagaactagggtactccctcagtccgaattaatgagaattaatttcctagaggttcagcttgagtcggtaacagattttgagccatacatggaaaaatggcaaatacatgattaagtttcaattttgagggggaatgtttggtagaaattgctcatctttggttatgcaagggattagagatgtgaataggatggtatgttgtgttctttgacattttaataaactgtcactttccctgttgtctcctaagtttggagagagaaggaaccagtatttgcaaaaaccaaatggaaagataaaaaagttactaaagtttctacagaatttctggtaacactgaagttgcaaagcagaagttaaattaactcttgtcagtaagcaatccaggaacacgtcagccagtgtatgctaattgtgccgtaacagggtgatttggatatttgtaggggaaatgggtagtaaatatcaagactggtgaccgtaggtcagcccagcacaaaggaagtggagatttttccatgcacaagaatctgatcactgtaaatagctaatttgaataattcagtccccagataaccaacatgggttggttattcataataaactacatattttaatagtttattagcttcctttagaccaagactgtgacctctttattttctaaagcacacacgtagtttagcatatgaggcgataaaatattgatgttaactttttaaatccccagttataaaaattttaaaataacagggattaaggtgagattcaggtttgttgtgtctttaaattgtatatgtgacttcacatatctttttcagcgcttatacaaaacggcactatagaacctccattttacagcaccatatgaagtgggaaaattaggtgaaaattttcctgaagcaaccttaacatgcgcagcccttgttggtttgtgacttgtggcctagctcatcagatgagccacgagaatcagacctggattttgatctggccctgttctgacatgcaatgaggcatttgtaggatttagtaatattgctagttcaaagaatactagaaatattagtaagaacctattcaaaagtattcatgagtattttctgcatatgaatcaggaattagaatattttgaaaatgatgttaataaaattttcctctggaaggcctttataatttttattcccaatcatttttcaaatttagaaagtttaatctgtcacaggagaaaaaaaattaaaaattttcaaaaatttagaaaatttttacccgtaagtattacagtttcctaattatcctatttatttcccacttgcctttgacctagattatttagagtagggtttctcagcctctgcactaatgacattttgggccgaataattctgttgtaggaggctgtcctgtgtgttttagattgtttggaattatccctggcctctcacactagatgccagcagtatcctcctcccccagtgtgacaacctaaaatgtctccagacattgccaaatgttccctgtggggcgggggcaacattgcctactgttaagaactactgctctagaccaaagaacacagcacagaggaaaggaaaaaaaaatccagttaagagaatgttaggtggagatgactatagtcatcaaacttttttccccatcaagtatttccaagctaacatagtgacaaaataattcctgtactctactggtaacgttaatctagtgctcttcctttaattcttccgttttgttttcttttgcagaattaagaatatgtttccttgtttatcagatacatcactgcttgatgaagcaaggaagatatacatgaaaattttaaaaatacatatcgctgacttcatggaatggacatcctgtataagcactgaaaaacaacaacacaataacactaaaattttaggcactcttaaatgatctgcctctaaaagcgttggatgtagcattatgcaattaggtttttccttatttgcttcattgtactacctgtgtatatagtttttaccttttatgtagcacataaactttggggaagggagggcagggtggggctgaggaactgacgtggagcggggtatgaagagcttgctttgatttacagcaagtagataaatatttgacttgcatgaagagaagcaattttggggaagggtttgaattgttttctttaaagatgtaatgtccctttcagagacagctgatacttcatttaaaaaaatcacaaaaatttgaacactggctaaagataattgctatttatttttacaagaagtttattctcatttgggagatctggtgatctcccaagctatctaaagtttgttagatagctgcatgtggcttttttaaaaaagcaacagaaacctatcctcactgccctccccagtctctcttaaagttggaatttaccagttaattactcagcagaatggtgatcactccaggtagtttggggcaaaaatccgaggtgcttgggagttttgaatgttaagaattgaccatctgcttttattaaatttgttgacaaaattttctcattttcttttcacttcgggctgtgtaaacacagtcaaaataattctaaatccctcgatatttttaaagatctgtaagtaacttcacattaaaaaatgaaatattttttaatttaaagcttactctgtccatttatccacaggaaagtgttatttttcaaggaaggttcatgtagagaaaagcacacttgtaggataagtgaaatggatactacatctttaaacagtatttcattgcctgtgtatggaaaaaccatttgaagtgtacctgtgtacataactctgtaaaaacactgaaaaattatactaacttatttatgttaaaagattttttttaatctagacaatatacaagccaaagtggcatgttttgtgcatttgtaaatgctgtgttgggtagaataggttttcccctcttttgttaaataatatggctatgcttaaaaggttgcatactgagccaagtataattttttgtaatgtgtgaaaaagatgccaattattgttacacattaagtaatcaataaagaaaacttccatagctattcattgagtcaaattgtaatgtgctttaccaaacaaggtatttgacctggcattctagtcatatttacacaaatgtaaatgtgaagtggcaaatacctaggtaattcaggcccacaactcagatgatgttttatgtagtccgaatgtagttagcagttactgttttccacttagctctgtgtgggaggacaaaactttagaaggtgaaaatggaaaagctacattttcatatgaataaggttgtcaaaagtctgcattagtaaaaatatttatgtcttctaggatatgaatgtgtcaaaaccaaagaatccttacataagtgtacactgacacatttgcaggattgaaaatgaaagtaacatggtgacttctctaaattctgtatttacacatgagaagtgtgaggaattaaagcaattgtttggaccatctaatgtataaatcttgtttaaaatattcaaacatatgggcccttaagaaattggtgtgcactctacgtagctatttttgaaatttaactggtcatacaaaaattctttcaatttctatatttagaaacggggtatttccttgttataatctacacaaccaaaaactggctaatgtaagtaaccaaatctgaggattttgagtctccatagccatacagcagatatacagtttttacctaaggaaaaaagtataagacaagacattttaaagtcagattactaaaatgattcctgtaattccacattctcaagaaaaaatgtgtttaaggtgtaatagtaaattcttataggacttattctagtaagtgggtaaatcgtaaaaatctaaatttgggttaaattttttcgctcaaatacctacatttcctttatcgtaccccaaaaggagctctcaaagagtagtttgaacagtttttgacccgaagattttttttttttttttttttttttgagcaggttggactcttcggcttcctggaagggaaaaataggtcctttagtggctgggctacatctttcaagtaggtattattttaatgaaagactagaggtgttttgtgattttgtttgaaactcgcatccaagagtgtttttcgaaaacagactgaaggagcaagaaaaacaattcgaaataggaaggagaggagggtcagaaaataatgaaattaaagttcctctgagtaaaaaaagataattcagaaagtgtctctaacagaataaaaaatatcgcctggattgctgcaggcaccccagtctcctttcctaaagaggtctctttaaacagaattttgagagattgcgttttagttatgcgggccagggagaagtggatgctcgccgcgccaggcacgtccacaggaacgcagccccgagtcaccgtgtccttcgtcctttacccgcctgtgtcaagcctcccaaaatgacccgcagttcagctcgtccttcgccgtgaacgtccctttgcggggttgcggccgccgtcgcccgccaccccttgccccactacccaagccactgcgccgtcgtctccccaaactgccccgcagttccgcgcccgcccgccgcggcagttgcggggtcgggctggctggtgcctcgggacgagaaggccatcaagtgttgctccctcatctgtaacgtgcagccccccgcactgtcgccgtcgtcgcgcgcagttcccgcgcccgggcggccgcgcctccgccgcgcagccgggctgggcggtttctcagaaactttcctccctcctcctctcctctgcgctgagaaagcagcgaaagctcccactcctctccgcaaacggactctccacctgagtaaccggccgcctccccggccgtggggatatcggagctaaggggagagccttcccgagttcgccgaccctccggcgctgcagcccgctcccacccctaccctgggctccaatgatccgcagccccgcgcatttcgaaagcccgcccggctcgccggcgcctggggagggccacggcggcgcgcagcccgggccccgcaccacggccgcccgcgtgggtcccctctgccctcacccccgctcggcaacgtgcccccatcgcaaccccggccgcccggcgcgggggcctgggacggggaagaactggggaaatgtgggtttgggggcgtgtttgggggactccgggagcgtgggcttcacaggcgaggagcggggcgagaggcctctcaggccggggtgcgcccaccgccccggcctcagggagcgactttcccggaggccgggggacgctgccttcgccatttcatcttcatcatcacagcgcccacacttgctcttctctcaagctctttgcacagaaaaagtgattctaaatctcctctaggatctcctgtctggtgttcagagtatgaatttctttttaaaacttgctgtgtctttcacctgggccacaccctacgcccacccaccccctctcagccaaaagggaggtaaaaaatcctgcgggcccagctgggggtggggaaggggcccacagtcccgctggaaaacctcagcggccacctcccggatccgggctggcctggggactggggtgggatggggtggggtccgcctcaggccgaccccgcagaaccgaaagtgccgagttgacacgtaaggcccagcccctctgcggccgcccgcgcgcccggcctgtcacgcgtggggacactgagcagcaggcatcggagcgagcagtacaaaaagaaatcaaggcgttgggcgcgaaacctcgacgcgcctctaaaggaacgttgagaaaaggcagggagcagggcgcgcggccgggggattgcatcattgcggctccccctccagaaaacgggccccgaaccgcggcgaccatcatggcgctcgcgccgggctgcgctccccgcgcgcctgccccgcgctccggccgcggccccggagcctcggacgcgcatttcacaaacattctcgccctctcccgagcgcccgcccccaccccctccttctttctgtgtgtgtgtgcgtacgtgtgtgcgtgtgtgcgcgcgcgtatttgtgtgtagggagaacttgcagatgattttttttttccctcccgtgctgctggttgtaaacttgattggcattggctgcgcccactgaccccgacgctgagtccgctgaagatttaaggtggatccgagaagctgcagcttcaggcggagtctcgcgctctagtcggttttgggaagagaaaaaaaaaaaaaaaagccccgaaccgggcgcccgccgcgtttgccgaatctcccgcggccccagcccccgcgcccgcccggggcccctccccgcctcgcgcgccgcgcgcggcctccgcccacctcccacttcttccccattggccggcgcgtgcagtttgaatttttttttttttttgatgcttgttttcttgtaaaaaatacagtcccccagatcgtgtgacgaaacctgcttcggcggcccgaggtgggggttttgagtcggttagtggaggcagtgggagcaggatgggcggagcttctgttccaaaaatttcccctaagtgcggttgacagtgtgcaggcaggcgggggtgcgcggggcggtcagcgatctgcagcttcgcggggacagagatgtaacccaactcgttcacggatgttccgcgcgccgtgtcaccggctgcgggccaggggtactcggaaggcgcgggcaggagcctggcgaggatgcaccttcccctgccttggaaaggtagaactggggagtgcgggagggtggaggtggcccggaaaagaacacctcttcgcaaccaaaaaaaaaaaaaaaaaaaaaaaagaggaaatagaggaaaaatgtgttatttcaaccgccactcagaacccatcataattcagccagtcggtgtcatttttattgaattaaattttaaaaaagttttctttgatttccagagcgtttttgcgggaggaatatgttaaaacaaactcaagatacgaaatgagacttttgaagtgcctttgatttctgggtacggaaattcttttgataaagcgtgtgtacgttaagatttaggatgactttttttttcttttttgtaatacaggtctaatggaaatgacattctttatgaattagaacccaattatgttttaaagtttataataagtcaaatgattctctcagtccctatgtccgtattagtgaaattctatctccatattagcgaaatttgcatagatacacacctttttctttttgtcttttagtcttgctgcagtgtatcggacgagtttaaccagatatccagcactagccttctaacagtttctaactcagtggtgacattttttagttcttaactcccccaatccttcttagcctaacaaacctcttaattaaggtccatgaaagaccataaaccaacctgattatgcctttagcaaggctgtgttcacttaatctctaatcccatatcataaaagtccgctagtcactcctgacctccaggaacccacctaaccagggtggacactataagaaaacatgtgttttaatggaatgagaacttttttgagttgaagacacgctagcctcaggaagcagtgagctcaccatccctggagtgtgagtcaagcactagtcttggatgaccccttgataggaacgttgtagacaagattcaaatatcaaatagtatttggactagtgatttcaaagtctattccagacccctgtgaaactgtatttccaaccttggcatttctggatttccactaaattaagccactttccttgctcattagcatcttgtagagctgtgtggctatttgagcgcttgaatgtggctagtccaaattgagatgtgctatatgagataaacaccacgtttccaagaattagtatgaagagaaaatgttaaatatttcattaataattttaatattgattacctattgaaataatattttgtcatattgggctaaataaaatatattattaaaatgaatttcatctattccattttacttttttagtggagttactagacaatttacagatgtgtctcaaattatatttctattggacattactgttcaagactatcacctgtggtaacttgaggccccatctttaaaagtggtgactattaatactgaggagtaggtggtaacttctagctgccatcctaacttctcaaattaaagtgagacccaaactcagcctctgaaagctttattatttatttatttatttattcttcttcttattttttttaaaagatagagtctccctgtcatccaggctggagtgcagtggtgtggtcatgtctcactgcaacctccaactcctgggctcatgcaatcctcccaactcagcctccagaatcactgcaattacatgtgtgctctgaaaccttttttttttttttttttaactttgtagagagtcttgctgcgttgcccaggctggtcttgaacttctggcctcaaatgattctcctgccttggcctcccaaagtgctgagatgacaggcatgagccaccatacctagcatctctgaaacctttaaatagaattctgccaacatctaacacctactgtttaatctttaattaattaattaattaatttttcttttaaagacaggtctcactctgtcacacaggctggagtgcagtgggcatgagcatggctcactgcagcctcaagctcctgggctcaggagatcctctacttcagcctcccatgtagctggactacagatgtgtgccaccacatccagcagttttttttttacttttgtagagatggggtcttgctatgttgaccaggctggtattgaatgcctgacttcaaggaatcctcacaccttggcctcccaaagtggtgggattacaggtgtgagccactgagcccagcctgtttaatacttaatgtagggttcaagcccagactatgggaatatagtatagatatgtctgatgaactcagacttggtcaccacagcttttcacattatggcaataggaagactggaggccggacacattggcttacacctgtaatccgcacactttgggaggctgaggcgggcagatcgcttgaactcaggagttctggaccagcctgggcaacatggtgaaaccccgtttctacaaaaaacaaaaaaaaatttaaccaggtgtggtggtgctgcctgtagtcccagctactcaggaagctgaggtgggaggattgcttgagcctggaaggctgaggttgcagtgagccgagatcatgccactgcatgctggcctgggcaacagtgagaccctgtctcaaaaaaaaaaaaaaaaaaaaaaaaaagagagagaaagaaaagaaagaaagagaaagattggaaactccaatatgttagttgtgactctgccaaaaaaaactatttagaccccacacaaaacctgcacaggcagagcctcactgcgactcttcaggagataggaagaaagtggggagacagagcagtatgctcattctaagattgggtctctagcagaagcctgcacaatgaaaaagtataccatattcttggatgggaacacccaacatgacaaagatggcagtcctccctaattcatctgcacctctttacactaaattctgataataggttctgatcatcctgtttcgttcctttgttgtagcagtctgtccactcaggaccataatataattactgtaaatttggaatatgtttgaattgctggtgggccgagtcctccacatctcgatgggtccctttactcctttttttcccccagaatgttcctgttttcttttgcttgccattttccccatgtggatttaaaatgaatttgtctagttttaaatataattctgtcggcattaaaaaaaaaaataaagtgggattcttatctcacacatcaggataaattcctgaagaattaaagaggatgaagtagaaagaaatgaaaccatagacatgcaaggagaaacctcaaaggatttttaaaaaaatctcagagttggggaaagactttctgagtacgacaataaacatagaattcataagatgtaatttttttttctttttggtagagacaggatctctctacgttgcctaggctggtcttgaacgcctggcctcaagtgatactcctgccttggtctccaaaagtgttgagattacagttgtgagccactgtgctcagctgggaggagctcttgcggccaggattttaagaccagcttggacaacgtagcaagacctgtttctaaaaaataaaaataaatagttaagctattctggaggctgaggcaaggggattgctctatcccaggagttcagggccgcagctcaggctacagtgagctatgattttactactgcactccagcctggcagctctaaaaaaataaaataataataataataatataaaaataatttaaaaagcaatggtttaaatggtaatttgtatcttacttgtatttaaccacaataaaaaagaatatacaactactgggacatttttttttgagaccaggtctcactctgttacctaggctggagtgcaatgactcattgcagcctcgacctcctgggctcaagtgatccccctgccttagcctcccaagtagctagggctgtaggtgcacaccaccatgcccagctaactttgtgtgtgtgtgtgtgtgtgtgtgtgtgtgtgtgtgtgtgtgtgtgtgtgtgagagagagagagagagagacagacaggttcttgctatgttgtccaggctggtattgaactcctagtctcaagtgatcttcctgccttagcctcccaaagtgctgaaattacaggcatgagccatcatgcctggctcactggaaaaatttaaagttcatccatggtatgtctaaaagaatctcacacagtgtactgggccatattatttgtgagatgctgtagtggttcaatttcaggctctggaatcctactgcctgggtttgagtccagttactgaactgccatttgcaagttacttcaccttttaaagattttatttcggccaggcatggtggctcacacctgtaatgccagcactttgggaggccagggcgggcagatcacttgaggtcaggaattggagaccagtctggacaacatggtgaaaccccatctctactaaaaatacaaaaattagccgggcgtggtggcaggcacctgtaatcccagctactggagaggctgaggcaggagaatcgcttgaacctgggaggcagaggttgcagtgagctgagatcatgccattgtgctccagcctgggggacgagattgagacttcctctaaaaaaaaaaaaaaaaaagaaagaaagaaaaaagttttttttttttttgtctatataatgaggatgcttataactctcatagggtattaaaagtattcgatggaataatgtatgtgttgtatttagcccaatacatggtatataataatgaccattacatatttgtaaacaatcaaattggccaggcacagtggctcacgcctgtaatcccagcactttgggaggccgaggcaggcggatcacaaggtcaggagatcgagaccatcttggctaacacggtgaaaccccgtctctactaaaaataaaaaaaattagccgggcgtggtggcgggcgcctgtagtcccagctactcgggaggctgaggcaggagaatggcgtgaacccgggaggcggagcttgcagtgggccgagatcgcaccactgcactccagcctgggcgacagagcaagacgccatctcaaaaaaacaaacaaacaaacaaacaaaaaatcaaattaatggggatatccagtttttattttgtcttctcccagtaaccacagccagtactatgttaaccttgtcaatatgtcttattatttttaattactgctgatactaccattaagaaaaacaaatattttaaattggcatttaataaagagaattagatatgcaaaaacagttaaaatggtaaattttatgtatttttaccacaataaaatctttttaaggcacttgttgaatttagtgtcacttccaatgatttctgaaaggacttggtatagatttatttgtggtaataaatcagtagcacatacacccacatacatatgcaatgacaaattgggaaaaatgtttgcaacccacatatcacagggttaatttccccaataaataaagagtttctacaaatccatgaagaaaacacaaaccagtagaaaaataagcaaaggatatgaacacagttatcggaaaagaaaatatgaaaggcttttaataaatgaaaacatgctcaattgtagactattgggatataaaccatatacagaatatataaatatagggaaattgaggcactcagatacaaagacggccattattctttcttgacagtttaatccttgcttccctcctttctacctaagggttagtgatatttttccagcttcattggtgaccaaagaagcaaagagtttgcatgcgtggaagccacgaccgtctttcaggttcagtgtaaaatccctcccatccaaataatgttatctttagcttagtggcatctccttactttgtacatagaaatcccccgaatcagcctcttaaggccagcacaactataagtatgtaagaggctgatgctctcaacacatccccatccattcctgcttttaagtttaatgcctgtacgttgctggtgataccagtctctccaaaaccatcaccttattctggcttttcgttcaagctctctattctcttttaaaagcctcatgaagagttgattacatgataaacataaattgtctaattagtagagagaaactatgctatgcaataaatggtgttaggttacagctaaccgtttggagaaaaatattaaatctcccttacatacacacacattttatatactgcgcatttaaaatgtatgtacttttcagctgggcgccgtgattgttaattactgctgttattaccgttaagaaaaataaatattttaaattggcatttaataaagagattcaaatatgcaaaaacagttaaaatggtttggtcttaatgtgttatggaaactttacacctgtaatcccaggactttgggaggctgaggcgagaggatcacttgaggtcaggagtttgagaccagcctggccaacatggcgaaaccccgtctctactaaaagtacaaaaattagccaggtgtggtggtgcatgcctgtgatcccatctacttgggaggctgaggcaggagaatcgcttaaacctgggaggcggaggttgaagtgagcagagattacactactgcactccactccagcctaggcaacagagtgagactctgtctcaaaaaaaaaaaaaaaagaaaagaaaaaagaaaaagaaaaagcatgtacttttctacgaatttaattttgagaaataatcagacgtatgactaaagatatatttatcaaagtaatcactataatgttaaatattagattttaaaaagaacaaaagagtaaacaaccaaataaaaaccctttagatgtagggttacagaattgattatttgattgaactaaccatagtatatgcaagaagggtacaaattatagccattaaaacaccctgggtagctttatatgtattaacagttatatatcttggctgggcagggtggctcatgcctgtaatcccagcactttgggagaccgagagaggcagatggataaagcccaggagtttgagaccagcctgggcaacgtggtgaaactccatctctacaaaaaacaccaaaaaaaaaaaaaaaattagctggatatggtggcacaggcctgtagtcacagctactcagaaggttgaggtaggaggatcacctaagaaaggaggtctagactgcagtgagctgtgatcacgccactgcactccagcctgggtggcagaacaagactgtctcaaaaaaaaaaaagttatatggcttaatgttaaagtttccatagcacattaagaccaaaagcaggcacagaacagtatctatggtatgaatgtatttttgtgaaaaatttaaaaattcacatgtatataggcatacaattgaaggttacccaccacattaacatctgtagttcctatttctgagggcaggattatgaagagactttcccttaaacatttatgtactgtttgcatttttaacagtagattttaacaaggaaaaaaccatgaaggtatttcaattttttttctttttttttgagacagagtttcgctctgttgccgaggctagagtgcagtggcacgatctcggctcactgcaaccttcgcctcctgggttcaagcaattctcctgcctcagcctcctgagtagctgggattacagatgagtgccaccacacccagctaattttttgtatttttagtagagacagggtttctccatgttggccaggttgatctcaaactcctgacctcaggtgatctgccctcctctgtcccccaaagtgttgggattacaggcgtgagccaccgcgcccagccggtatttcaaatttgaaataattatttttacaatttct

SEQ ID NO: 92 - DNA, 2606 bp, Homo sapiens
  source 1..2606: mol_type = genomic DNA
ctatcaccgtatgtgtatgtgcacactgtcatgccaaataaaacacatttccattcaaggcagtagcaaaacagggttgccgattgtgtggctgaaaagcagtgcatgtcaccaactgtccctaactcacggtgagtgatccatccctgtgaccttgattttcacgatctttcatttttatttaccttttatcttttgtagagatgggttctcactatgttgcccaggctgatcttgaactcctgggatcgagcagtcatccctcctcggcctcccaagtagctgggactacaagctggcccagatataagcaggcagtttttaattttttttattattattttttgaaacgaactctctattgcccaggctggagtgcagtggcgcgatctcagctcactgcaacctccacctcccaggttcaagagattctcttgcctcagcctcccgagtagctgggattacagctacttggctgtacaccatgcccggctaattttgtatttttagtagagacggggtttcactatgttggccaggctgatctccaactcttgatctgctcacttcagcctcccaaagtgctgggattacaggcgtgagccaccgtgcccggctagagcaggcagtttaatgctgggctcccatagtggtaagtcttcagggtactgaaatttcgaatttagatttatttgttggtttgtgtgtttttctctattatataggctttagaaggacagaaatttgttctgtttttctcagtattccctgagcctaggacagtgcctgtacacatgggtaaaatgaataaactttttgggagaagggtatttttttttcttttgtcacaggctaattagaatgatgtcctttcactcagagaacacagccctcaggttcttctcttgtctattctggtgtcttgaatgccaatttgtcttcaaataattttgatgaatttcagctgatcaaccatcagatttttgtgtgtgtttccatataagaacacttaaatccagtgtgataaaagcaacttacaagcccgaggcttggaagaaaggaaaggaattttttacttcttgggctgaatacatttcatcacatcccaatttatttccctgaggcttttctttgtcaagcttgggaaagtgctgtttcctaggagaaccacacaagaacaaactttaaatatgagaaaagagaaaagcacaccccaaagcaaaacaaaacaaaaaaaacccccaaaaacaataagagaagcattttagatggattttctccaaagatcgattgcattgtgttccaaacgcatttcttttctttcttttttaaattttttttgagatgaagtttcactctgttacgcaggctgaggtgcagtggcatgatcttggctgactgcaacctccacctcctgggttcaagtgattctcccgcctcagcttttcaagtagcttcaggtgcccaccaccatgcctggctaattttgtatttttagtagagatggggtttcaccacgttggctaggctggtctcaaactcctgacctcaagtgatccacccgcctcagcctcccaaagtgctgggattacaggcgtgagtcactgtgcccagtgtaaagtgcatttcttttctaaactgacttgaaccaaaatggatgaacaaggacccttcagatgatatacaccaaactggaaacagatgagaatgccagcaaatgggctcaggaggaatttatcttcttgaattttcaggcataagctgattttgacaatgttttctcttacaaaaacagggtgagcgtgttctggatggaggctgggtgggaaccccaggtcagagcagatgtggaactggggcatggggaagactataccccaaagaggtgggggtggggaagaagatgaaaagtgaaagacgaatgttcccaggggcaggaattcataaactttttccattgattctgccctctcaagccaatcactttctgcctttttggaccaaattgggaaagcctggacagtctgctacaaaccagaccagagcctttccttgtcaacagagcagcgcttcctaaacttatactgcgttaaaaatcacatgggaatttgttaaaaatgcagtgtctggaggcctcctagaggttctgatttagttggtctgagtcagggtccaagaatttgtatccagagcaagtatcccggcgattcttctgcttggacagggttgggacaaggcgtcggccagtcatccacattgtctttttgcagatccactaatcttccatgcaggctccaacagctccttcccggcctgggaacccaaatccgcaggaagaatctcggggtgttgtcttggcttattcattcagagctgtcgtgtgtggttctgcaaacagtactcagatgcgttccctctccccgtagggatcttgctggagatgcccagggttaacagtggaactccatatggagacagaggcatggggggagcttcgctggagatgggacagcctgctccaccgcgaagcctactgaggctctcttcttacgtaccccgcgcaatctcatctccctgaacaacttccacctccacctttcagctca
